United States Patent 10,233,495 (METHODS AND COMPOSITIONS FOR SCREENING AND TREATING DEVELOPMENTAL DISORDERS) - sequence listing, part 36

SEQ ID NO: 378 - DNA, 207029 bp, Homo sapiens
attgctttctttgtgtttttatatggctttcacagtataccttcctctagtgtttccagcggatctgcttttgaggcacagtatgtttcctgctctgtttttgttgatgcttgtggtccaggaggtggtatagtgaatatattgggtctgaggagggaaaaatcagagagaacaactttgaaaacatttctgtgaactttactcaagatacagatatctcagatagctgggctgtcagataacctgtagtgatagctacagtatatattcagggcacaattgttcttctatatcctggcataatagagttgccaggttttacagtgccagctttctgggacctatcttccatggactctaattcagtagttttaggtagggctcaggaatttgtacctttattttaaaaatgcagctgacttaaaaataccagtggtctgtgttattcaaacttcaggtcaaaacccatatagggatcctaagatcaatttagtgatttaaaaccagacaaattaaaatggaatggaaaatatcagagtttgtcacacattttaaaagcatacactgttgcataaaaattttccagttttaattatatatggatatgtctatgcatatgtgtgtatgttattttactatagacaacatggaaactgggttacaatgtaaatatgtttcttactatgggttagatgaaaaaatttgaaaaattctgtgagatatagcttcttatatttccactattattgcagtgttagagtttattgtactttcattttatattgtcccttctgttagactgtaaacttgacaaaggcagaggaatatgtctgtactgcttactacagcctcttcagcatctagcatgtatgtgttcttagtacaggtatcactagttgtattgaaaagatttataaggagaacttaattcctcaaacagaaatatttttctgtgtgatctaagaactctttttggtgtgtccatttttatgttattactaggtcatttagtctgtgtttaatgtgtggacctgtgaggtttaaagccataagcaaatcaaagttctcttggcagttgttttgggcttccaggttaatttgctgatttgtcagtaaggatcttgcccataatttctagagaaactaaaacttttatttatgcagtggggtatatcagggttagggtggtgggtgtggtgtgtcccagggtacagacaatgaggtacgttgtctgtaagacatttaaaaacaataaaactgacaaaaataatgttgctttttattgtcactttgcattggaatttctaacctacgtcactgttaaaatagtcttctctgccggaatgacctctcatacctcttttcttactttagtaagacaatgttatttggactcagctttttctttatgatatcactgaaaattttaaactaggtttttttttttttttttttttaggaaggaatgctgttttaagttctctaatgacctttgttagtacatatgttagtacatatagtatggttaaaggtcactgaagcacacgctttggggtgtgacttttccttcatcactattctctaagacaagataatcctccgggctgttttcaaaattttactgaaaatggtttataattttacctttatcaggaaatcattctccttgcatttttctcaagttatatttcagcttgataagtcaccctatatcaattatatttctagaaaagaatctatttctatttaggaaaccttaaactgccctgcagttgtctaatttagtactagttggtattttaaggaggaaattatttcactgaccttcagaatatatggatttttttttttttttttttttttgagacggagtctcgctctgtcgcccaggctggagcgcagtagcgcaatctcagctcactgcaagctccgcctcctgggttcatggcattctcctgcctcagcctcctgagtagttgggactacaggcgcccgccaccatgcccggctaatttttttgtgtgtgtttttagcagagacggtgtttcactgtgttagcctgacctcgtgatcctcccgccttggcctcccaaagtgctgggattacaggcgtgagccactgcgccggcctatatggatattttttatgagctcaggttgttagatagtattcctgtagttgagatacaaggttttattcttgtgccttccaggattgcaagtgtcacttacattattttggcttgaaggaaaatcatttcccttagttctagtatgcagcatactgttagaatgcctttacttttcctttgttagcagataaccaatgatatgcaaatcttcttactgagttaaacagaggaaatcaactattgacagatcttttctgaccatctgctaagttttaaatttgagaaatgagtacatgcttgtcaaggaaatttcattatcagtacccatttatctactgaactcctcttgaggggtttaccaaatggttgacacgtgattcgccttcagacaaacatttaattgcatttttctaaatgtgatgggcataatgtaaggaggacccataaaaacaagatttaaaaataggggcatttgttttcatccatgctgctttattccttctttgtgagtaaacccctctgagtatagtaaggtggcatatagtgccttagtaggtctgactgtaaagcctagctccagcttttgaattcttttagtcagaaaataggtgaaaatagatattcacaactaatgatagatatgttctaccgcttcagaaaaatagactttgaggtaagatcaatttgtttgatcatcctcagggctgatgtaattattgggtctaaatttattttatttgaaacacagcacttatactaaaataatttttctatggtttttcattgtatatcttatttcaatactactttattaaagtgctgtttttccttttagagatcaaaagcaaaaattattctaaaatgttatagaatgatagtttctgaggacgattttccacaagccttgcaatttactgaagagtcagagttcatggggcaggggtagtagagagtaaaaaaaaaaaaaagaaaagaaaaaaagaaaagggggccaatgtacaacgtaatggggaaactggggaccctctgttacatttgttgtattccttttgcattacctttgaagcagcaaaaagcaaaaaaatctaatggatagcagtcactttttaaattattattacatagcttcttttattatcctccttatatcagcatctataaccatttaaagcattaatgctgtaagtacaaaaatacatacagatactctcatggattttatttataacattataaagtggagagtgctaccgtgtatgctttccaacttcattttataaaatgttgttgaaattaatctttgcaaaattgtaatcgttttctattaaaagattgcctttctttaatggacattatgagtcagttggagggttttttacctgtaccttctcaaccaacttataaatatatatatgattgcaaactcacaggaaattttccagatattcttctataattgtaagcctccatttttattactgtaaaggttatgtgtgtgtgtgtgtgtgtgtgtgtgtgtgtgtgtgtgtgtaagcgagagagagagtttttctaaaaagaaggcttctggaactaaaattaaactaaggcctgggagcaggctgcttgcataccttgtgtcagtctgagttcacacatacatatttgagaggctgatagctattcatagcagtgagttagcagttttgaaaacactgatgtaccaaaggtccctttggattttattcacgtgaaggttctaaaagttgcaggaaaaattttggtgcataagggccttaaaattaattactcatgattacatactgggtggtgttcagaaacaaacaagtatgataaattgagaccaacatacgttttatgatttcctttgtattttgttttacaaaggcatgaaaattcaaagaatattcagaaacaaagtataagtatattaaattcaaaatccacttagaaacaaacttaagatatataactagtttcccctagtgcatttcttgtacttatattatagaaatacttccaaaagggatttgaggtagtatcaatgaagagagtcaaactctgtaaaatatttgaagagatttattctaagccaaatgtgagtgaccatggaccgtgacacagccctcaggacgtcccaagaacatgtgcacaaggtggtcagggtgcagcttggttttatacattttagggaggcacgagacatcaatcaaatacatttaagaaatacattggtttggtccagaaaggcgggacaactcgaagtggggggagaaaaacagagatcttgcttcagctgtttcctaactcatttatgaaaaggtaagatagccctctgtcagaagcaaaaatatctacgtgattgtatagattttaaaaatctatataaatagctgttttaaagttcttatctactaattccaacatttgtgtcatctttagtactgttacagtgactttttttctcgttaatatatgtttcaatttttattgcttcttcctcatctggcaattgttttgattgtattctgggcattgtggatgttctgttgagagatttaaggattattgagttttgttttgatagctactagagaatcaggttgatcctgttgaggtttatttttagtttagttttttttttaaggaagatctaaagtgatacttattatagaactagagtagtatatttttatatctgttaccagcggcaaatctatatgggtctgcagcaacctcaattcttgcctcctcagaagaaagaatttgactgaggggcataaggcaaaaggagagaccaaggcaagttttagagcaggagtgaaagtttattaaaaagctttagggcaggaatgaaagggagtaaattacacttggaagagggccaagtgggcaacttgagagatcaagtgcccagtttggcctttgatttagagttttatacgttggcatacttcccaggtcttgcatcccttctcccctgattcttcccttgcagtgggctgtccatatgtgcaatggcctgctggcatttgggagaggccgcatgcacagtgtgtttactggagttgcacacatgctcacttgaggcattcttcccttaccagtcaactgttcctagaaggtcatataccagttaaactctgacattttgcctcttaatgcacatgcttgagcccacttgcccaactccagtgtgaagccactaattatcagtagatcttattgggaaactactgagtatcagtttcaggtttttttctatctattgggagactgcctttccctggtgcctgctgcaaccaattcttattttagagaaacagtgtaacaactgcctgaccatcacctgagggtcgcctgacattcctggttgctggggagccctctccagccccactggagcctggctagctacttactgtaacacatccatattttttttgttacgacagtaaacataagatttgtgtatctgaggcagactgattatttacctgcagaatatcttgtattagtttcccatgctccatttttttcccatggtgctgtgataaatgcagatgtcacctgcatgtatgaggaggggcctctagtacatgagagaaaccccaaattcttagtcttgaagcttatatagaagctgcttacataactgcaccttctcccctccaggacggaaagagagaacacagagagaaactgagaccttgtcttcctaatgtaaacaaatcctctctgaagagaaaagtcaaaggtgttttggccaataatcttttggaatataaacaaatggctccacatttttgataccctttgaaatgtaaacacatagttcttagagataaatttccatattgctctttttttttctttgagacccagtctcactgctctgtcgcccaggctgtagtgcactggcgcgatctccgttcaccgcaacctccgcctccagggttcaagcaattctcctgcctcagcctcccgagtagctgggactacaggtgtgtgccaccatgcccaacttatttttttacttttagtagagtcagggttttaccatgttggccatgctggtctcaaactcctgacctcagatgatctgcctgccttggcctcccaacgtgctgtgattacaggcgtgagccactgcgcccggcctaaatgtccatattgctcttatcatttctatctattcagtcaccctttaatcaaagtgccaattttctttgctcagaaggccattaccatgcagaaacatgaaaatattcacattgtttcttgacacagagtcgcctcacacctaaggcatggctgttcttggacttcagatatataatctgggtattcattgaggtctcttcactctatttggttggaattgcaatgtctcccagttccatgtgacccatagatactcttcatctcacagcccctcaatagttatattttgctaggctttgtggaattataccctgtgtacccacatcctaatatttagccaaatactcaagagacccctatgcagacttctggagttccttctctacaaggttccctcctctccattcctcttcacccaaattccagtagcctcaacagacccaaattctgacttctatttcatctacccagtgagacctctgttctgtctctagctccacttccctatgctatgatctgtaagtaccctcaggcagaaagccgagatgaacgtggcttttatatgtctgtcttctcccaaggatcacagccctgagctagtcaacatctgcttcatatattttgtccagtttcatagttgtttacattgggaaggtgagtctgatgctgtcatggcaaaaactgcaagctctatctaccagattttcaaattgtcatgattgtatatcatctctgccatttacctgtctggtacttaaagaatatggaattccccttaaatcaacaatacattctttctgtatttaacaacctgtgtgtgtgtgtgtgtgtgtgtgtgtgtgtgtgtgtgtgtgtgtgtatctgtctgtctgtccaggttattagacgggttgaatttgtttcctttttatttgtttttagtattaaagatgtttttttttttgtaggactgaaactcagcttgctcaggaaggaaaataattgcctgaccattaagggcattgggcttggttaaaagaggagggtattttcttctttaaaaaattttgcttccatgcaagtaaggaagttgggattctccataaggaggatacttctggaagtgaaacagttaggcttgtttatcctggatgcacaggaaggtatcacagtgacttaattatacaccccaaaatatcttaaaaagtagtttagaactgtcaactagtctctgggcattgtttggttttgttttaaacattttttaaatcaacaaataaaagttgtatatatttgtggtatacaagataatgttttgatatatatatatacacacattatagaatgactaaaaccaattaacatatatgttacctcacatacttatcttttttgtaataacatttaatgtcttatttaaagattttattaaagaacatttaaagtcttagcagttttcaagtatacaatacattgttattaaatataatcaccatgttgaactaattcctcctgtctaactgaaattttgtatcctttgaccaacatctccccaatcaccctacatgaccatagcctctgataactaccattctactctcagcttctatgagttcaacttttttagatttctcatatgagtgagatcatgttgtatttgtttttctgtgcctggcttatttcacttagcataatatcctccaggtttgtccatgttgtcaaaaattacaggatttacttctgtttgaggctaaattgtattccactgtgcatatatataccacattttctttatccattcattatttaaagatgcttaggttgattccatatcttggttattgtgaataatgctgcaatgaacatgggagtacagatacgttttcaacatactaattttatttccttcagaatatacctggaaatgggattgctggttcatatggtagctctaattttaatttttttaggaacctccatactcttttttataatgattgtactaatttatattgacagcaacaatgtacagggttttcttctctccacattctcacccacacttatctgttgtcttttttataaaatacccatcctaacaggtgtgagatgatatctcattgtggttttaatttaatgaatttccttgatgatttttttcatctacattttggccatttgtaatcctcttttgggaaatgtctattgtagtcccttttttttcataaaacttcctttttatggcttaaaaagaaatagacaatgtcaattatagacccccaggttagagaccatagtttttagtttaggaatatcctgggaagcactgagtaaatgtgaaataagattaataatatttttctgctagtttcttcagacttgtttttggggcttgctttttggcatttcatgggtattggcttgttattcttcaaaatgacctacttcagggattatgagtgatgccagtttttcatagctgggtgggtttaggatctaagattatcttagggatatcctgaggatgtgttatttttacctcaatagtgatagctagtagctgatcctcctccttcctgtcctttacaatttcattaaaataccttctccatctctttcatctaaagaattcaagtttttttccaagttggttgttgaagaacattgattatgtatctttatgtttaaaacaccaaaaaaggcattgtggagagtaacagaagttaaacatatgacttttgttttccatgagtgtataacctaatgacagagaacatacaaagacgtgagtgacagaaacatgaaaaaaaaaccttgcagcttttggaaaagccaacagcttgagaatcacagtctgtcacttagcagttctagtataaagagcgcttcatctctgattgctctggcaaaaggttctgaagagccttaatgttcaaaattgtgtccttgaaccagcagtattagcatcactgggaagcttattggaagcccaggatctcaagccctaccctagacattctgggtgagaactgtcattttaaaaaggtctcctggtgatttaaatgcacattacagtctgggaagcactgctgcagaggattctgattgtgttcatttaggtcaggtgcccacttggaatgaatcgccgcagccagggacatacaggacatactgaatgctcaatcctgggacatatggtccttatcccctaggacaatgggtgtgggatcagtttgtggaatgggtttactacaggaaaggggtgttttattaccaagggaagggaagttgggaaagaagataataacaatagttgtccaataaacttatttcctctttcatgcctttgctcacattaatgttagaactagctaactcctttactttgggtcatttcatcccatttcctgtgtgtgtgtatgtgtgtgcacacgtgtgtgttcgtgtgtgttctactttcaatctcccccacccctcattgccatctgtctgcctgacctagatatcagaggttcttccttattccacagcatggttctcctgtccctctcagagagttcatatctttcaaatatatataaacacgttatggataagcacacacatacctctgcctaagtctaactttacttcattgcactcctgatagagcatgtgtgcttcacctactgcttttcattctaccactaaggcattaacccttggagtcacgccttttaaagctgtgaatatctgttaaaatgtacttgtattaatattacagggggtcatacttttagccctcaggaattctgattccattagcaaagttttttttttttttttgcatacagggaacaaaagagggatgtaatcctttactattattatttattttgatgttcatattttctctgatttctcaagaagggtcctgtggtcttttgatgtgtcctcattctttaagtacttccttcctttctggcccaacaagatgttccaggctcatcttatacttttgcagtcctagctctggaatcagccatttctccaaggagttctaatgacttttagtggagaatgctgtttagaaactaagatttgagtgcaaggtgtgcttatcctttttgagttatcattgtttctgggccatctcagtggatagaattaggaaatatgcatgtgtatatgtatgtgtgtatgtgtgtatttagataacttaaattggtatcatatacatgattctttgcaggccagttggtctctgtttcaagtacttaactttccctttgtaacacaaaagcagccataaataatatgtaaatgaatgggcagagctgtgtttcaataaaacttatttatggaccctgaaatttgtatttcatatcattttcacatatgacatattcttcttttgacattttttctaaccattttaaaacatagaggccattattaacttgtgggccatacaaaaacaggtgatagagcatatttggcctgtgggctgtagtttgccaagtcctggtctttccgaaacactttcagtttacatacaacacacatacctatatagtcatacactgagtaacaacattttggtcaacgatggaccacatttacaatggtggttacctagactataaaggagctgaaaagctcctgttgtctagtgatatcatagccattataacatcataccgcaacttattacatatatatttttgctgatgctgatgtaaacaaacctactgagctgccagtcatatcaaagcgtagcacatacagttatctatggcacacaatacttgttaattataataagtgaccctgtttttggtttatgatgtactatatagttttccctccatatctttatgggattccttctaggaacccactcgacccctcccgtggataccaaaatccaccaatgctccccaatataaaatggcataatatttgtgtataacctatgcacatgcttctgtatactttaaatcatctctagatttcttacaatacctatcacaatacctacacatcacttcatttgtgtgaatacagtgtagtacttggcacacagtaaattcaagttttactttttggaactttgtgaaattttatattttatattttgtttttatttatttttaaaattttaagttcggggctacatatgcgggtttgttacatgggtaaattgtgggtcgctgaggcttggtatatgaatgatcccattaccaaggtagtgagcacagtaccagataggcggacttccaagatatgccttcccctcaccctcccccatcaagtggtccccagtgtctttgttcccttctttgtattcatgtgtattcatcgtctggctcccacttataagtgagaacatgcaatatttggttttctgttcttatgttagtttgcttaggataatgtcctccatctgtatccatgttgctgcaaaagatatttcattattttttatgtctgtgtagtattctatggtgtatatgtaccacattttctttattcagtccatcgatgatggacatcttggttgattccgtgtctgctgttgtaaatagtgctgtgattaacatgtgtctttttggtagaatgatttattttcatttggatatatacccaatagtggtattgctgggtcaaatggtaattctgttttaagttctttgaggaatctccacactgctttccacaatggatgaactaatttacactcccaccagcagtgtataagtgttcccttttctccaatgtataagtattctcccttttcaccagcgtatcattgtggttttgatttgcatttatctaatgattagtgatgatatgagcattttttcatatatttgttggccacatgtatgtcttcttttaagaaatgtctgttcatgttctttgaccattttataatggggttatttgttttttgcttactgattcaagttttttataaattctggatattagacctttgtcagatgcatagtttgcaaatattttctcccattctgtaggttgtctgtttactctgttggtagtttcttttgctgtgcagaagctgtttagtttaattaggtcctacttgtcaattttttgttttgttgcattgtttttgaagacttagtcataaattctttgccaaggccaacgtccagaatggtatttacttggttttctcctagggtttttattggtttaggtcttagatttaagtctttaatccatgttgagttaatttttgtatatggtgagaggaaggggtctggtttcaatcttctgcatgtggctagcaagttatctcaacaccatttattgaataggaaatactttccccattgtttgttattgctgactttgtcaatgatcaggtagttgtaggtgtgtggctttatttctgggttctctatcctgttccattggtccatgtttctgttttcataccagtaccatgctgtttcagttactgtagctttgtaatatagtttgaggttaggtaatgttatgcctctggattcattctttttattaggattgctgtggctattctagctctcttttggttcctccatatagatttttataattttttttctaattctgtgaaaaatgacattggtagtatgataggaatggcactgaatctgtaaattgctttgggtagtatggtcattttatcaatgttgattcttcttatccttgagcatggaatgtgtttccatttgtttatgttgcctctgatttctttcagcaatgcattgtattgctcattgtagacatctttcccctccttagtaagctgtatccttaggtattttattctttttctggctactataaatgggattgtgttcttgattttgctgagcctagacattattggtgtatagaaatgctactgattttcttacattgattttgtatcctgaaactttactaaggttgtttatcagttctagaagccttatgatggagtctgtgggttttcctaggtatagaattatattgtccatgcagatagacagtttagctttctgtctccctaatttagatgccttttatttctttttcttgcctgatagctctggttaggacttctagtactatgttgaataggagcagtgaaaatgggcatccttgtctttttccagttctcaaggggaatgcttccagcttttgcccattcagtaagatgacattgtctataggtttatgttatatgggtcttattattttgaagtgttttcctttgatgcctaatttgttgatggtttttaacatgaagggatgatgaatttttttgaaggccttttctgtgtctattcagatggtcatatggtttttattatgaattcagtttatgtggtgaatcacatttattgatttgtgtatgttgaaccaactttgcatcccaggaataaagtctacttgatcatgatgaatgagctttttgatgtgcttctgaatttgcttgtattttgttgaggatttttacatctgtgttcatcagggacgttggcatgaagcttttttttttttttctgtgtctctgctgggctttggtatcagaatgatgctggctttgtagtctgaattagagagtagtccctccttctcaattttttgaaataaatttagtaggattggcactagctcttctttgtatatctggtagaattcaactgtgaatccatctggtctagggctttttttggttggtagactttttattattgatttaatttctgaactcattattggactgttcaatattgattgctatttttattgtgctgttgtccaagtgtgtggttgattttattttgatttttgaatttgctgagacttgccttataactgagcatgtagtcagtcagagtatgtgccatgtgcagatgagaagaatgtatactttcttgttgatggttggagtgttctgtagatgtctattaggtccagttagtcaagtgtcaagtttaagtccggaatatctttgctggtttactgccttgatgatctgtctaatgctattagtgggggttgaagtcctgagtattattgtttggttgtctgaatctcttcacagatcgctaagaacttttttttaaaatctgggtgctccactgttgggttgggtgtgtatatatttaaaataattaagtgttcttgttggattgagccctttatcattatgtaatgccctttctttgtcctttttgatcattgttggtttaaagcctgttttatctgatgtatgaatagctacccgttttttgtttcctattagcctgatagatctttctccatttctttactttgagcctatatatgttgttacttgtgagatgtgtctcttgaagaccatagtcagttggtttgtgcttctttatctaactgggcacactatcccttttaagtgggggcatttagtccatttaaattcagggtcggtattggactgtgaggatttgatcctgtcatcatgctattagctggctattatgtagacttgatcatatagttgctttataatatcaatgaagtatgtgcttaagtatgtctttatggtggcaggtatcattcattaatttccatgtttagcacttcctttagaagctcttgtaaggcaggtctaggggtaatgaatactcttagctttgcttgtttgaaaaggatttcatttctcctttgctgatgaggtttagtttggaatgatatggaattcttggttggaatttcttttcttcaaggatattgaaaacagaccccaaatctcttctggcttataaggtttctactaaaaggtccattgttaacctgatagggttccctttgtaagtttttctctagatgcttttaagattttttcttttgcattgaccttggagaatctgatgactgtgctttggggatgatcatcttgcatagtatctcacaggtgttctctgagtttcttgaatttgtatatcaccctctcaagcaagattgggaaaattttcatggactatatcctcaaatacgttttccaggttgcttgttgtttctcctctttctggaatgcaaatgagttacaggtttggtctctatgtaatcccctatttctcagctattctgttatttttttaaattattttttctttatttttgtcttcctttgttgcttcaaaggagtgaccttcaagctgtgaggtttttatttttcatttttatttatttatttattgagacagagtcttgctctgtctcctagactgtagtgcagtggcgtgatcttggctcactgcaacctccacctcctgggttcaagcgattctccagcctcagtctcccgagtacttgactctacaagcatgtgccaccatgcccagctaatttttgtatttttaatagagatggggttttgccatgttggacaggctggtctcaaactcctgacctcagatgatccacctgccttggcttcccaaagtgctgggattacaggtgtgagccaccatgcctggccaagctgccagattcttttctcaacttggtctattctgcttttaatgcatccaattgtattttgaaattcctggaatttttcatttccagaagttcagtttggtctttttttaaatggttatgtcatctttcaactgttgggttgttttactgttttgcctgggttgggtttcaacctcttcttgtgtctcagtgtgcttccttatcatcccgattctgaattctctgcctggcatttcagccatttcattctggttaggatccactactggggagctagtgtgatcatctggaggtaagaagacatgctggtttttagagttgccagagttcttgtgctgggtctttcttctgtgacagctgatgattctttattatttgaagttattgtcctttgggtgaggctttttgtttttatgatctttattgcccttagggttttttgactgtggtgtaagctggatatagttgaatcacttcatttctggatgcttttagggggcaagactcagctccatactgctgggatgcatgctctaaccctgtgggactgggactgggtcagcagctttgtcctctggtctctcactgttgagctttggctgggatagagaggctggggtgttcccagaccattgacagggcatgggtgtaggtgctccagcaggggcagcaggggcactgtgggcaggatatgctccagtgggcagggctgtgggcgaaaggcactctggcaggggcactgagggtgggaggtgctctggtagggggcaccgtgggcttgggaggtgtgctccagcagaagtggtggaggcgttgtggccgggaggcactccagcttggggtgctgtgggtagggtcgcttctgcagggggaaaccatgggtgggtgggttgctctggctggaaatgccgcaggcaggaggcctggaatttacttttttttaaatctgaggttgattgaattcatagatgtagaacacatggatatggagggccaactggaccatatttttactgttattttagagtgtattcttacttatcaaaaaaaagttaactgtaaaacagcctcaggcaggtccttcaagaagtattcccaaagaaggcattgttatcttaggagatgacagctccatggatgttaaagcccctgaagacttttccctgggacagttgtggtctgtggttacaagtaataagggaagaattttctaccctttctagtcttagccccaagctttgagataggcaatatttcaggggctgtcagtaagaaagtttataactaatccagttttgagggtcttgctcttagggtcccagatttatcaacaggtgtctactagttagactctccaacttgagtggctcctaggattgtcttctatctctcagccttgaagatcatgtaaaccaaatctcaatttcattaggtttagcaaaatgccatcacagcataaaggtcagtttctacattctatttacctctcttggttcctacgtttatttattgatttagttttctatgtagtcctcatttgttttttttagcagatcatgaatgcatttgagaccagtagttttagttcatcattctctcagaatacaaacacctgtattatgtgtacttttctttaactgtgcattactctttaatatttgatcatatattatacatctttctagttattttatgtttgtcagttgtgtatatttcagtccttgtgagcacgcttgatgatttattctattgttccatttcacttcagccctctaggcaaatagtaactattcagaaaaatcctcactgatcaatataaaataagtggcttttcattaagattatttcagagatcatggtaccttgctggtataaaagagtaaaagccctttttctaaagtacttagcttacttaggggaggaaaatttctaattggagaaatttgactgatatttaggaattgttagttaaatatctatgctgtgtgatacatgcatatatgggaattttatttctttctctgtattttattaagtaagcataaaatggactaaaatattttcttttcctttcgggatatgaattttggtcagtagggacagactgtttctctataggttctttagcagataggaagcagatgtggcaatgtgaggagactactaggggaagaacaaatgtatgagtaatctggaaaaagattaaagtcaattataagttaaatgtcagcctttggaccaaagctttttcattcttggtactctaaagagatgagagcaattgagtgttcttaaaccctctgccaaaaaaaaaaaaaaaaggtggggtggcgagagagagagactgtttttaaaagccagtatttcactatacttactgttttatttccaggtgtttttttttaaacagtctgcttttgattttgtttggttaggtaaaatataacccatcattagcctgtatttgtacttaagagtattgttttatttggttagagaatgtctttaaaatcatatggtctttgtcagtgaacttctaggaatgtctggcatggttattggtcaaatgcctggcagatggaaatgaaattttgtgaggaatcttctggatcaaatacagatttatttttactttaataaaactattcaaagcataaagacttcagtctgagtgtcaacagtagtagctgatgtgggagcagttgcccggatagtacttgctgaggactgcagtgatgttcccattcctgatgccacttttttgttgtgcttgaattacagacatagaccatatgggcatctacaggtcttttagatctctgaagttctttataatgtatactgggcatactgttttcttctatacataaaaaagtgctttgtatttaattaaatgaagatactgtttagttttgtgtgtgacaccacccattcttagaccaattccattggcaattattagatcaatttaattccccaaaggaatacttgagagacagggctgagaacagttacaatcattttagtttaaaattctacttagcaatgagaaacaaatgatagactctacaatctggcttgtaaataaatagtaaatagcaataaaattagaatctatctataataaaattaagttttccagcttgtctatgcttttgtacatattattttcacttttaagtgcatctgcctaattagtaatatatagggtcataatgctacttaaatatcatgttatcctttaaataataattccaataaaagtgtaagaaaattcactcattcactttttttttaatcaaggataagccttttggaattattccagttcatcacatttttttcattcattcaccgaaactttattgcacacttactaaagattggtcttaagttaggtgttggggcagtggtcacagtatctttccagtcttcaagaaacttacagtttaattctattgagttaggttgagtattggaaaaaaaaatgctcttcaacatctactggctctgttacctctgctcttcacattagttaataccttaaggtggaaattagtgagcccatcctatggtagttggaggaaaacttagtgaaaacccttttgaaatgtatcttaatggccattggccaccaacataacagtgttccaggaaaaggagacttgatagatgaaaagataatctgtcaaatatatattttttatagtttaaaatttctctgtaaattaatttttaaagatataatttacatataataaaatgcacacattttaagtgtagagttcaatgaattttgacagagtatgtacccttgtaaccataactctagttgttcacctgagagagaaacttggagttattctggattcctttccttatcacatccaaatgattactaatttctgtccatgctacactctaaacttccatagaacatctcccctctttactctcctgactactaccttggtttttgacatgttaagccctgtttttcacctctgttaccgcaatctgctttataactagcttttgattcttatctcttttctttttcgtatacccttcatgacgttattaatttgtgatttttctaaaatactattctgatcatattaactgccttgcttaaaatcccttcatgactctttacagttcccattcttaattattgttttgatggtggcatcatttatcaagtagaaaatacacatagaaaagcagatttgtggagggaaagtgatgagttagttcactttaacaaagtggaagaaataaaacattgccttcagaagcatttttatttgattcaagctttatgtacacaactatgggggaaggagagaaaagccatcacaaataccagaaactgttctgagatttttatactgatgaagaaaatgaattttggcaatgctgggtaggaaaaattatgtttgttcaagcttgtttatactttaagtgatgattaagtttaaatttataaactcacatcttcaccttcatatactagtttgttaaaaaatgccttccaatatttatctaaacatgtctcaaacactatgagttgcgtataaattgtgaggtttaccttttagattggtaaagacaagctctgaggtaaaataattaatagcagggtatctttttaccttgagtgtgaggaaaacatagaagaaatatttaaatatgacaataaaagcagtgaactttattcttgctgtagaacttgcctcaaccttgttagtacctacattattttctataccatgaatattctatatcatctagcttttcttgacacagtgagaagagatatttaatttagtgcctgaataaataaagtatttatagtactataaagtactggtaatttagtgcctgaataaataaagtatttataaagtatttgtgtactgaatgagaatgactctaatataaatgagttttaccaaggtgccctgtggtattatttagaaaagtgattatttctttaaaaaataaaaatcccggctggatgcggtggctcacgcctgtaatcccagcactctgggaggccgaggcgggcggatcacctgaggtcaggagttcaagaccagcctggccatggtgaaaccctgtctctactaaaaatacaaagaattagccgggtgtggtggtgcatgcctgtaatcccagctactcgggaggccgaggcaggaaaatcgcttgaaccagggaggcggaggttgcagtgagccgagattgtgccattgcgctccagtctgggcaactagagcaaaactccatgaaagaaagaaaggaaggaaggagggagggagggagggaggaaaggagggaaggaaggaaggaaggaaggaaggaaggaaggaaggaaggaaggaaggaaggaaggaaggaagggagggaaattccagtcaaaatcccataggttatttatagatatcaacaattggattctaaagtttatatgaaaaggccagaaagaaagaaaatcccaatcaaaatcccataggttatttatagatatcaacaattgaattctaaagtttatatgaaaaggccagacctggaatagtgacacaatactgaagaaaaagttagaggagtcacactaaccttttgcaagactgttttgtatggttaaaataaacagatgatcaaagtatgttttcacaaatcacacagtttattgccatacaaagagcttatcatttttattcataatgctcaaagaatggaagaataacaggaagaaacatcatagggaatatactcaatagataaagtacattatccacatattggatgagttccaatttagtttagagtccagtttttaaagtctagttgctaaattaggatggaagcttgcctctgtggatgtaaagtctaatcaaagtttggagagtacttttctataagtggtttcaggagggatggtttgatcaccacagtgtacatccataacaatgtgcaatgtccctcaacactaacaagcagtgccagtgttactgggctttggaggatagttcaaaggctgacagagagcaaccctgctagtctgatattttggtctttggagaagtgtctgacatagagtagccctgacaaagcctaagttatcaatctgtcaaaatcttgggtttatatgtgtttttaaagtccagtcgttgagcccaataactcatgtatgtggtctgatgaggagtgatataacaatcttacagggagaggaattaaacttcatgttcttatcagagcaaaacgtgtatcattcatgtagtaaataaactaagtgtttaaatcatttcaaagctatataataaagattccttataaaactacagtaatcatgacagtgtggtattggtgaaagagtagacacatgtatcaatggaaccaaataaaaggcccagaaatagacccatacaaatatattcaggtgatctttgataaaggagcaaaagcaattcaatagagaaaggatagtcttttcagcaaatggtaatggaacaattggatgtccatatgaaaaaaaggaatatagacatgggccttacaccttttactaaattaactcaaaatggatcatagacttaaatgtaaaacacaaaaccattaaacttctaaagaaaacttaggagaaaatccagacaaccttggatttggcaattagtttttagatacaggaccaaaagtaggatctatgaaagagaaaattgttaagttgggcatcattaaaattagaaacatctgttctgtgaaagacactgttaagagaaggaaaagacaagccacagactgagataaatatttgcaaaatatatatctaataaaagacttgtatccaaattttaaaaaaatcttagaattccacagtaagagaagaaagaatccaatttaaaataggcaaaagagctgaaaacacaaagaagatacatggatggcaagtatgcatatgaaaagatgctcagcatcttttgtcattagggaattgcatattaaaacagtgagataccactatgtacctcttggagtcactgaaattccagaacacagataccaaatgctggtgaggatggtgagctgttaagattgcaagatgatacagccactttggaagatagttcggcagtttcttacaaagctaaaataaacatagtcttactgtaatatacagcagttatactcttaggtatttatccatttgaattgaaaacttatgcccacacaaaaagttgcaggtgaatatttacagcagctttattcataatcaacaaaaactggaagcagccaagatgtcctcagaaggtgaatggataaagaagctatggtatatccatacaatggaatattgctcagtgataaaaagaaatgagctatgaagccacagaaagacatggatgaaacaaatgcatattgctaagtgaaagaagtcaatctgaaaaggctacatattacatgattccaattatatgacattctagaaatggcagaactatagtgacagtagaaagatttgtggttgccagtgatttgggaggaggagagaagatcaaatggctaaagtacagcagatttttctagtgtcatgaaacggttctctaagatactttaatggtggatacatgacattaagcctgtagaaatttacacaattaaaaagtaagccttaatatatgcaaatgttaaaaaatcacttaggagtttagaggatctcagaaaggaatgcagaccgacaagagaatctaactgtattaaaaatgtatgaaacaacctccctaagggggtgggggaaaaggcactgatctaagaaacttcggaaatgagcctgtaagactaaatggaaaagcaattatacctaatcattgtactttagttgataaagttgtttctcattgggggtacacattaaacattctgatacctctatacatacatattggaattgaataattaagtaaatggagagttgatggtttgaagccaaacttcttgttgaagtagaaatgttcagataagcaagggaaggaggctagaatgattcatttggtgatggattagagttggagacatcagtataaactcatctttagcttaatatagacacagatggcacagatggacagatggttacttagagaaatatttatagatatatgcatatacacaggtttctgtacacacatatattttcttgctgtgtcagctgagagggactaaaggaaatgaccccacagtagcaagaagtacacttagcccccagatctttgtttctaatactagtctccaataaaaggaactatggctcctcagaaatggccgattctaggaccaggaccggaattagtctagaaaatacatgagtatagaaaatcttatagtgccagaaagtaagaaagtgctcagaaaaagaaaaaaaaaatccacatcgatgggaaccaaagggacatagaagccaattgaaagagcttccaatggccaaagctggaacaatttgaacaacaaaatagtaaaattgtattggataataacccaaagcatagaataaatatccatgagttcagactctgtgtcctcaaggaggaggagcttaacttcccactccctgagtgtgggctgtacatggtgacttccttacaaatagttgagtatgaaaaggagaggatgcaatggtaactttacattggagaaacctgaagaacataacctcagcctcagccttgaacatgttgatcagggtcaacatcaacagtaataagtcatattaataatatataccacctgggcatagtggtcatgcctgttaattccagcactttgggggggcaaggtgggaggatcgcttaaacaggagttcgagaccagcttgggcaacatagtgagacgctttttattttgtagacaaaataaaaagtaaaacattagccaggcatgatggtacatacctgtagttccaactacttgggttgctcaggtgggaggattgctcgagcccaagagtttgaggttaggattagctatgattgcaccactgaaacccagcctggatgacagagtgagacctggtctcaaaaaaaaaaaaaaaaaaaaaagtaggtatcttaacccccatctaatcatgagaaaaatatcagacaaatcctaatagggggtcatcctacaaaataactgatgagtattcctcgaaactgtcaactcatcaaaaacaaggcaagtctgagaaattgtcacagccaagaggagcctcaggagatatgacaactaaatgtaatatggtatcctccatgggatcctggaacagaaaaaggacattaggtaaaaactaagggaaacctggataaaatacaggctttagctactaagaatatgtttactttggttgattaattgtaacaaatgtactatactaacacaagatgttagcaataggggaaactgggtatggggtataggggaactctgtactatcttctcaatttttctgtaaatctaaaactgtgctaaaaataaagtctattaaaaatgaaagtattatcttaaggcctcagaataatccagtggtttctgtctctcctgcagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggtgagaacccttccaaagtgttcaccatgttgttgtccttagtgtggattaggaaattgggatgcatattctttgcttgaaatgcttcttaattttagtgaactatgggttatcatgattgtatacttcataattgcaattatgtagtttttactgcctgatcccatcccaagtttaattgagcaagacttttaaaattcctagccttctgtttaaattaatcatcgtgtttatttttcattcttgcttaatatccaaataataatttattttgaaatgaatgagtgagaatttctttaagttatgtagcatagtggttaagagcatggacactggagccagattgcctgcgtctgaattctggcttgactgctttctaacgatagtcctttggcaatgtatttaatctttgtatacctcattttcctcaaagtaaaatggggatcagaattaagtcataggtttgtcgcgaagatgaaataaagtactacaccttagaaaataaggtactacactttagactgcgaggctcctaggaggcatttgtatgtagttgttattgttgatgttatatctcccaaagtagctacctctttttattcatcgtatctccatgttaagatattttctacacttagatgttttaatatggtttctgatctaaggaaatgctgtgcataatatccccctctttttaggtgtacaatgtgtattagcatattataggatccaagaagttctgtaattaaataaacttgtttaactttgtttctttgaccaggtttatttgttatgagaaaacacattttaataatctcagtttgatagtctctgacctagaaaaatatcctaagcctctacctattttctctcttctggactgctgattttcatgtgaattctgttgatcacctaggtttatgcagttgccaactgacctatttctttgtatattagcatcacaatgtgtgcagttttcatttatgcgttggcaatactgtggacctctaaggtggctagctaatagctaaaagtgtggatgaattgatggataccagaggtcttctagggttctgcctctctctctattccatggtggagctatggttctttgtcctcttagttaattcagctctatagtgtcaacactgtttcatatttttgtggtgactctttacccttatctccatgtctttcttagttaagcatctatgctacttcttaaattgctctttctaatgaggttgagatgagtgggataagatttagagctaactcgtttatataaattagtacttaattatatggtatgttcctcatagtgaatttatttgtcagtcttgtctacccaaacaatatatagtctttaaaggcagaaaccattcttctttcttgcctggcacctacagattactagcatctaattctcacaccacattgaacttttaccagttatatcaatattgttctttacagcaaaaagatgcagtttaaaattatacattgcattatagctgaattttgttgtcatgtctctaaagtcatcatttttctggaactatttctcagtctttctttgattttcatgactgatatttatgaaaattacaggttagtttttttgtagaatgaccctcaattcagattttttgatgtttcctcatgattaatttttacttataggtttttggcattaatatcatagcagtgattttgtattcttctcattgcatcttagaccagcatgtcttacaacatgttcttcatatttatctctttattgaggatgcttactttaggatgatttctgccaagcttttctttgtgaagattctctttttccctttgtaatcccattcctcataaaaatgtaaatttattcattcattcatatctatatggacttatggtatttagtctcgtcttttatttataactttttagtaactttagtgtggaagctgtaccttttttaaggactttttataacaaatgtcaacaaacagcctgtgagctggctacctgtttttgtaaataaagttgtattggaacacagtgatgcccattcatttatgtattatctatgtttgctttgatgctgcaatggcagagtcaagtagttgctatggatactatgtggcctacaagcccaaaatatttattatctggctgaaaaagtttgctgatgccagtaactattttttctctttaagaaacaatatcttaattgaatttttgtgtaaattaccatataaacattctcactgtggtggattacacaaatatttaatgaacttctgtgcactggggcagtggttcctaaactgcgtgcagaggatgctgcagtgaactcatagggagtgatttttaacttccaggggaaacacagtgagatttgacatctctgagactgtgggcaaattagtagctcaaatagtttaccatttcaacatgacctcacactatatttgtttcaatcacttcctatctttgaaaagctgaattttcagtagttgttgtaataaaaataaataccttgccaaaatcagtatcgaacaggaaatggggatggcagtgtccaatgtgattctctgtttgagaaattgtataacgtcctcctggttctacacattccattgataagtagttgtggttatttaaaaatgatataaaatattttttctttctatttacatatattattttttaattgctactaaagtgctagaccatgaatacttattaaattgtttggaccaaactacttagtaaacagagttgtcacatatttcttttggcctagaggcactgtgaaaaaatccctgagactattaggtatcttgaactcacgagtttctgtactaggatatatattagacagtagagatgaaaagatcaaaatcacagttcatgccctaaagttacttgcagttgtctgcagaggcaaccatgcagctggattacagtgcaaaatgacaatctagagagataagattactagatggatcaatagagatatatgtttgtgtcaacacacttacacccagggcaaaatgatatcaaagagcaaagcaatcccaagtctacctgaaaaacagaaaagttccaaaggagaaaataattgactcaagactttaagggtggtaaagaagaaggaggatgtatttgtggaaaataaaggcatgcaaaatgcagaaggaagctgagagaatatagcagctgacaggagttcaacatggctaagcattgagtgtacatggctgagggacatagaaggagacaactatgtctgacaggcaaggacaggcaaggactagggcattttatatcataataaggagtttagatttttgtcttggacataataggagaaacccttgaagagtttaaggtagttaaattggatttgcctattaagaagactgtctttctgggttcagccttgaagatagatcggagaggatgcgatgggtgatgagatgagaagcaaggagattaatcagagtaagagtctgggaatctgatccagaggaatggcaagagataatatgatgccatctatcactggcctcaactcctattttgctttatctttcttcagaagaaggggttttagtttgtaaagattagcataaagattaataagataaaagtgaagcttaggataggtaaataaataagttggaactcaggcccacatctagagcaagggttggcaaattttatctataaaggacctgatagtaaatattttaggctttggggcctgcatattgtctgttgaaactactcagtttgcccattgtagtatgaaaaaaggcatggacaatacatatatgaataagcatgattctgttccaggagaatgttatttagaaaaacaggtggctgactttggcctgtggcctagagtttggcagtccttaatctagagcactgaataaatcgctgaaccactgagagttttgtctaggtagggttatagaataatggagcagctgaaaggtaagatgaagtaactttttttttttttgcaatattgctttatttatttatttgtttatttttgattatactttaagttctgggatacatgtgcagaatgtgcaggtttgttacataggtatacaggtgccatggtggtttgctgcacctatcaacccgtaatctgcattagatatttctcctaatgctatccctctccttgcctccacaccccaacaggccctggtatgtgatgttcccctccctgtgcccatgtgttctcattgttaaactcccattatgaatgagaacatgcagtgcttggttttctgtccttgcaatagtttgctcagaatgatggtttccagcttcatccatgtccgtacaaaggacatgaactcattcttttttatggctgcatagtattccatggtgtatacgtgccacattttctttatccagcctaagattgatgggcattttggttccaagtctttgctattgtgaatagtgctgcaataaacatacgtatgcatgtgtctttatagtagaataacttataatcctttgggtatatacccagtaatgggattgctgggtcaaatggtatttctagttctagatccttgaggaattgctgcactgtcttccacaatggttgaactaacttacactcccaccaacagtgtaaaagcattcctatttgtccacattctctccggcatctgttgtttcctgacttttgaatgatcaccattctaaatggcatgatttgcgtttctctaatgtggtttgctttgcatttctctaatgaccagtgatgatgagctttttttcatgtttgatggctacataaatgtcttcttttgagaagtgtctgttcatatccttcccccactttctgatggggttgtttgtttctttcttgtaaatttgtttacgttccttgtagattctggatattagtcctttgtcggatggatagattgcaaaaattttcttccgttctgtaggttacctgttgactctgatgatagtttcttttgctgtgcagaagctcttttgtttgattaggtcccatttgtcaattttggcttttgttaccgttgcttttggtgttttagtcatgaagtcttcgcccatgcctatgtcctgaatggtattgcctaggttttcttctagggttttcatggttttaggtcttaagtttaagtctttaatctattttgaattaatttttgtgtaaggtgtaaggaaggggtccagtttcagctttctgcatatggctagccagttttcccagcaccattcattaaatagggaatcctttacccattgcttgtttttgtcaggtttgtcaaagatcagatggttgtagatgtgtggcattatttctgagggctctgttctgttccattggtctatatatctgttttggtaccagtaccttgttgttttggttactgtagccttgtagtatagtttgaagtcaggtagcatgatgcctccagctttgttcattttcttaggattgtcttggctatatgggctcttttttggttctaaatgaatttaaagtagttttttctaattctgtgaagaaagtcaatggtagcttgatgggattagcattaaatatataaattactttgggcagtatggccattttcactatattgattcttcctatccacgagcatagaatgtttttccatttgtttatgtcctctcttatttccttgagcagtggtttttagttctccttgaagaggtccttcacatcccttgtaagttgtatgcctagacgttttcttctgtttgtagcaattgtgaatgggagtttgctcatgatttggctctctgtctattattggtgtataggaatgcttgtgatttttggatattgattttgtatcctgagactttgctgaagttgcttatcagcttaaggagttttggggctgagatgatggggttttctaaatatacaatcatatcatctgcaaacagagataatctgactcctgtcttcctatctgaataccctttatttctttctcttgcctgattgccctggccggaacttccaatactatgttgaataggagtggtgagagagggcatccttgtcttgtgccagttttcaaagggaatgcgtccagcttttgcacattcagtatgatattggctatgggtttgtcataaatagctcttattattttgagatatgttccatcaatacctagtttgttgagtgtttttagcatgaagcggtattgaatttttatcgaaggccttttctgcatctattgagataatcatatggtttttgtcattggttctgtttatgtgatggattacatttattgatttgagtatgttgaaccagccttgcatcccagggatgaagctgggttgatcgtggtggataagctttttaatgtgctgctggattcggtttgcccctattttactgaggattttcgcattgatgttcatcagggatactggcctgaaattttctttttttgttgttgttgtgtctctgccaggatttagtatcaggatgatgctggcctcataaaatgagttagggaggagtccctctttttctattgtttggagtagtttcagaagggatgctacctgctcctctttgtacctctggtagaattcagctgtgaatccatctggtcctgggctttttttggttggtaggctattaattactgcctcaattacagaacttgttattggtctattcagggattcaacttcttcatggtttagtcttgggagggtatatgtgtccaggaatttatctgtttcttctagattttctagtttatttgcatagaggtgtttatagtattctctgatggtagtttgtatttctgtggcatcagtggtgatctcccctttatcattttttattgtgtatatttgattcttctctcccttcttctttattaatctggctagcagtctacctattttgttgatcttttcaaaaaatcagctcctggattcattgattttttgaagggtcattcgttctctatccccttcagttctgctctgatcttagttatttcttgtcttctactaccttttgaatttgtttgctcttgcttctctaattctttcaattgtgatgttagggtgtcaattttagatctttcccactttcttctgtggccatttagtactataaatttccctctaaacactgctttagcacccagagattctggtacattgtgtcttttttctcattggtttcaaagaacttctttatttctcccttaaattcattatttacccagtagtcattcaggagcaggttgttcagtttccatgtagttttgtggttttgagtgtgtttcttaatcctgagttctaacgtgattgcactgtggtccgagagactgtttgttgtgatttccattcttttgcatgttttacttccaattatgcggttgattttagaataagtacgatgtggtgctgagaagactgtatattctgttgatttggggtggagagttctgtagatgtctattaggtccacatgctccagagctgagttcaagtcctgaatatccttgttaattttctgtcttgttaatctgtctaatattgacagtggggtgttaaaatctcccattattattgtgtgggagtctaagtctccttgtgggtctctaagaagttgttttatgaatctgagtgctcctatattgggtgcatatgtatttaggatggttagttcttcttattgcattagatccctttattattatgcaatgcccttctttgtcttttttgatctttgttggtttaaagtctgttttgtcagagactaggattgtaaccactcctttttttttttttttttttttgctttccatttccttggtaaatcttcctctatcactttattttgagtctatgtgtgtctttgcatgtgagatgggtctgctgaatacagcacaccaatgggtcttgactctttatccaatttgccagtctgtttcttttaactggggcatttagcccatttacatttaaggttaatattgttatgtgtgaaattgatcctgtaattatgatgctagctggtgttttttgcccattagttgatgcagtttcttcatagtgtcgatggtctttacactttggtttgtttttgtagtggctggtactgttttttcctttccatatttagtgcttccttcaggagctcttgtaaggcaggcctggtggtgacaaaatacctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgcagagagatccaatgttagtctgatgggctcccctttgtagataacgcaacctttctctctggctgtgcttaacattttttccttcatttcaaccttggtgtatctgatgattatgtgtcttgaggttgattttcttgaggagtatctttgtggtgttctccgtatttcctgaatttgaatgttggcctgtcttgctaggttggggaagttctcctggataatatcctgaagtgtgttttccaacttgcttccattctccccgtcactttcaggtacagcaatcaaatgtaggtttggtcttttcacatagtcccatatttcttggctgctttgttcattccttttcattcttttttctctaatcttgtcttcacgcttcatttcattaagttgatcttcagtctctgatatcctttcctctgcttgatcgatttagctattgatacttgtgtacgcttcacgaaattcttgtgctgtgtttttcagctccatcaggtcatttatgttcttctctaaactggttattcttgttagcagttcctgtaaccttttttcagggttcttagcttcattccattgggttagaacatgctcctttagcctggaggagtttgttactacccaccttctgaagcctacttctgtcaattcgtcaaactcattctccatccagttttgttcccttgctggtgaggagttgtgatcctttggagaagtggcattctggtttttggaattttcaacctttttgtgctggtttttcctcatcttcgtggatttatccacctttggtctttgctgttggtgacctttggatggagtttttgcgtagttatcctttttgttgatgttgatgctattgctttctgttttttcccttctaacagtcaggcccctcttctgcaggtctgctggagtttgctgggggtccactccacaccctgtttgcctgggtgtcaccagcagatgctgcagaacagcaaaacattgctgcctgctctttcctctggaagcttcatcccagaggggcacccgccagatgccagttggagctctcctgtatgaagtgtctgtcaacacctgctgggaggtatctccccatcagaaggcaggggggtcagggacccacttgaggaggcagtctgtcccttagcagagctcgagcactctgctgggagatccgctgctctcttcagagctggcaggcaggaacatttatgtctgctgaagctgtgcccacaaccgccacttcccccaggtgctctgtcccagggagatgggagttttatctataagctctgagtggggctgctgcctttctttcagagttgctgagcttagagaagaggaatctagagaggcagtcagtctggctacagtgactttgtggcactgtggtttttttaatgtcaaaagtacagaatataaattccacaaattgtgacagtcaacttgatgttgattctgaaataaatttaaattgcattattaaaagatggtttgtggcccagtgcggtggcttactcctgtaatcccagtactttgggaggttgaggtgggcggatcacaaggtcaggagattgagaccatcctagccaacatggtgaaaccccatctgtactaaaaatacaaaaattagctgggcatggtggtgcgtgcctgtaatcccagctactcgggaggctgaggctggagaatcacttgaaccagggagttggaggttgcggtgagccgagatcgcgccactgcactccagcctggcaacagaaggggactctgtctcaaaaaaataaaataataaaataaaataaaaagatggtttgtgagtacttaggaattggtcactaggaggcagcattagctcactaaaaaacaattcatgccagaaaagaattagtttcctgacctagaaattacaaatagaccttgttagaggagtgctatagacagtgttttggtatttaagcaaagcatttggcaaagtcttttatggcatcattttgagtaaattgtatgacatggttatgtagatttttgattcaagtatacttacagaacatgaagtaatggattaatgccagcctttagagaaatctgtactggcatgccatgaggcttttttcctccagtccattctattcacatttttattaatgtctaggagaaaatatttgttattctggtaaagtatgtgaatgacagaaactagagaaattagagttcttggtatattggttgatcaaatgagaatccaaaagtatctccatagtctagaacagggtttggcaaactacagcctatgggctagatccatctggcagcctgctttttgtacagctctcaagctaataatggcttttatgttttcaaagcattgtaaaaaaaaaaaaaaagaacaacaaagaaggatatgagatagagatcacatacagctcacaaagcctaaaatatttaccatactatctgaccctctacagaaaaagtttgtttatgcctagtctagaaaagtaagcagaatttaacaacataaaaaatagatgaattgaacatcctggactttattccataacaacaatcaagcaaaacaattcttagcacaaattcagtattatacaagattagacttagcagcgtgtgttaaagtgacttggaattgctaaattcaagttcaattaattatgagatgtgattattaaaagttaatatggcttaaaacaatattcatttatagaaaaagagaattcagacaatggagacagtcccatcccatttttttctacagtggtcagattacacctgaactattactagttttagagggcagacaataaactagagcatttccaaagaatctgacatgattagttgacaaaggagaagacataaggaagatatcccagtgatcttcacctgttttcacaactattcaaaaaaagagagaacagacacatgttgaggggctagaacaaggacccttatatagaaaattctgggaggcagaattttcctttttatttctaaggcagcattttgtgaatgcaggcagtattctcacaattctgaaacagggttgggcgtggtggctcatgcctgtaatcctagcactttgggaggccaaggtgggcagatcacttgagtcaggagtttgagaccagctggccaacatgacaaaaccctgtctctacaaaaaatacaaaaaatttagccgagtgtggaggcacacgcctgtagtaccagagacttgggggactgaggcaggaggatcgcttgaacccaggaggtcaaagctgcagtgagccaagatctcgccactgcactcaagcctgggggacagaatgagatcctgtctcaaaacaaaacaacaacacaattcagaaacaaacaatgtctaaagttttcacctcaagctcacatttaattggcttagtgtgaacttgtttacaatttgctctccaaaaaaaaaaaggagctcatctcatgtgtacgttttctgttttggtagacattactaatgttcaccaatatgctctggttctcctcctttttgacatgtgggaagatgtttggccaatgaaatgtgagcagaaataatgtatatcatttccaggcagaagcatttaaaagcatgattctcatgcttccttcccatgtggtagtcactgcggaagcctatataaagttgaggatgccatcagatcatagcactcaggaatacttagccactacattgaagacaggtgcagtgttctttgcgtgatcaagaaataaacttttttaaagtcataagccagtgaaagttttgaagttgttacagcagcataacctatcctgttctgactatttccctccccagtatttaacagctaatatccctggaccagaagtcaggtgacatggcttctaatcttcactctaacactaggtgtgaccctgcaaaaaaatcagttttgtttgctaaaagtgattgtttgagtaaaaattattgaccacctctttgagggaaaaaaccctgtgattttaaagtctgttttaatattttatatgttcaaagaaaataatgtttataactaaagtatatggttaaaacacaccttgccatttgatttttaaaatttcataaaatgctgcctatattaggactactattatttattttggatcagtctttttcttgtgtgatatgtgcattgttttaggccttaatatctgctaacaaagtataatctaggttatcaaacacctattaaatcactgcatggcttaattgacttgaaattatttctatattgggtcttcatggccaaaatgaagtgaggaaaaagtagttttttgtcccagatcccagattccccccccaacttatttatttttttatttttattttttgctatgtaaaggatatggcttttgtcccagaaattggactattatcaagaagataccagaattttagtttttctttcttaccaacagatttataacttatcttcacaattagaggttttttttctaagtttagttactctgtaattatttgggctgaaatatagctctcagatacataaattccttaaaatattcaatatttgaattgatttggtgtaaatccagttttccaaggtttagctttccttttaagccctactgcctttaatagaagctcaaattcttttcaaaaatctgatgaaatcatctcgtaagtatgtgtagtacgtgatccatacagtttccagtactgtttgaaattggctctttgaaaaaacaatctgtttctagttcacattttatagatgagtcaacaattgaacatcaatgtattttgctcttttaaacactttattctgaaatagattgtactctgtaggtaccaagtcagtatttactgaataaaagaatttaacagaattattaaaccagatattttgtgaagctaggattcaaagttctgcatttttaatttagtttatttctcctcattacctctatttagtttttaaaagttaagaataattattttccagctgggcattggtggctcacgcctgtaattgtagcactttgggaggctgaagtgggcagatcacatgaggctaggcgtttgagaccagcctggccaacatggtaaaaccctgtctctactaaaaatacaaaaattagcctggcatggtggcacatgcctgtaatcccagcttcttgggaggctaagacatgagaattgcttgaacccaggaggcggaggttgcagtgagctgacattgcaccatggcactccaagcctgggcaacaagcaagacacaagactgtcttaaaaaaataataattattattattttccatattgtaaaagacactttaaattcactaaaattacattacatttccatttccatttcctttaaaacaactaaatcatatggcagatcacttctgagttctaaactcttctttatctatctaaaatcagtaaaattaatttaaatacatctttattataaaaaaaatatgaattttgtttctagcaggccatggcttctggtcctgatcctggccttgtcactagctatgtgacctcatacaagttactaatgtcttggagcatttgttaccttatttctaaaattagagttgtctagtatatgctttcttagttttctttttaaactctgtgttggtttctgtttgtgcatttttaaatataattatttaatctaggttttttctttgttttcaggagcatgtataatggcccatcctctagaacacattttcatagtctctttgaccttctttaattctaatataacatatatatactggtcagcataggctagattgtgctgcagtaacagcttctctaacttcagtgaattaaaacaacaaagtttatttcaggcttctaatacctgtctgcctatgatgtgtgatttgggatctttgctctatgttgtcctcattctagtactcaggctttcaaagtacccacctgtggagttttgcaggtgctgtagcaaggtgagagagagaatagttgtatcatacattgtctttgaaagttttcaaccagaagtaaatacatgtcacttttgtccatatgacattggccaaagcaagtcacatggccacatctaacctcaagggggctagaagtgctatctcacaatgtgtcttggatatgcaaagacacaagaatatttggtgaacagcttttatgaataaccatcaggttttaaatcaaatgttgaaatctggtaggagtataaattagaactgcatttatggagggcagtttgcagacatatcaaaaggatagaaatatgtctaccatttgatacagcagtttcggttttaataaattactgaacagacatggttcatacattcatagagcttattttatggcgtgggaggcaagagggatagcaccagaaaaaattaaaatgaaacaggttaagtgctatgatagagaagtatgtagggtgatactaaaacatatagaaaacattctcatcctctattttccagttgactgattctctcttcagctgtgtataatctgctattaaatctccctttgttgaattttaaatttcaattcttataattttttgtttctaaaagagttattcttcaaatctgctaagttacttgttatggtttcctgtctctgaagatgttttcaagcttgtcttttatgaataaattgttttctcaaattatcgtattattttgagtatctacaaatcttttggtaatgaaaattaaaagttacgtggttataatttattaaaatctgacagtcttcgggggaaaaattgtccagattgtgtatatagattataacctttaaaaaaattgctcatagtgaatattataaactgatacacagaaattgtaagatttgagttaggtgtttgggattatgactgatttttaagcatttttctaaactgtttgtaaggttattttgtcatttctactttttccagctttgttgaggtatgattgatgaaactatataaaattaaggtgtacagtgtggtgatttgatgtgtatgataaaatgattaccacaatcaagttagttaatatttctatcacttcacctgattatctttttttttttgtagttagaacatataagatctattctcttagcaaatgccaagattacaatacaagattattaactacggtcatcatgctatatttcatagcttttagaatttaaaaaatgagactgggcaacacaatttaaaaacaaaccaaaagtaattatattaatggggagtaatttattaatataattggagttttaaaagatatttaccctggttttttcatcaaaaagttctgattttctatcacagatccagtcaacattgttagatgtatcacttttatccttcttaccttgatgatagaaagtttaaacctatgtggaaccatgatgcacagcgtacaaaaggaaaatgatgcaaacatacttctccttttcttctcattcttttttctttcttgtatgagctaggttcacgtcacctccagagttgggaatagagttaggaatgcacagatttttagcattaagaggaaagaagaaaataaagagaaacatactaaatttttctttgagagtatattttctgctagtaaatactatgcctctcaagaagaaaactgtgcttaataggaccaatgatatttagcattaaaaaatggttaaactcttcataatacttttcggaaaatgtcttttaggaagaagaaaggcgtatggcatctgttttagccaaaaaagaggaagagaagaagcgggaaagtcataaacaatctttgcttaaggtattttctctgatgtctacatggatgtgtgtgcacacgtagacacacataccccaaagccagctagctagtctactggaaaagtggtttctaaactttgtaagttttttgttcctatcaacagaatgtacgtacccctaaaacttttacaagttattacctataaataaacctgtacttaagaaataaaatatgatatacattataaaataaatgcaaaggctagttttaaaaggaagagatgataaataaatataattgaagttataacacttttatttcataccagtgcatcatcttgtgtatcccatggcctattcacttccttttggaacgtactgtaattgactgtcatctttactgatatattttaatgagctctgctacgttttttttttttaatgatagctttttaaatttaaaaagtttatgatatagaagtgataaagattttgtggaacttaggaatgaaaatttgttttaaactggttttaaatgatttagcagatattaatttccttaaataaaatattctcttttaaatattttatattaacattgcaaagtataagtaaaggcagctttaagtttatagttcataatatgcatcatgctgtgttctaaaattaaggacatcaccctgattatcattactcattcatgttctatatagatgcttttctttttaaaattaaagtggcactcagaattcaaaaaaatgactagccaggcaaggtggtatgtacctgaagtcttaactacttgggaggctaaggtagaggattgcttgagcccaggaattaagtccagcttggaaaatacagtgagacaaaacaaaatgtcactaaataggactctttagttacgaggtttacttagtatttttatttttagtaagaggaaaagcatggggaatcaggagacccaggttctagccctagctcagatttggaatcatgatacaacagaccctcagcatttgctgaggattgctcgtgcaactctacatattgatcattaagaaaatgggatggacattctcagcaaactaacacaggaacagaaaaccaaacactgcatgttcttactcatgagtgggagttgaacaatgagaacacatggacacagggaggggaacatcacacaccggggcctgttggagggtgggggggctaggggacggatagcattaggagaaatacctaatgtagatgacgggttgatgggtgcagcaaaccaccatggcacatgtatacctatgtaacaaacctgcacgttctgcatatgtatcctagaacttaaagtataatttaaaaaaaaaaagaatgctaaaaaataaaaaaaagaaaatggaatggattggttacaggaagagtgtatagatactgtcttctgccttgttgcttttctattttttttattttccttgtaaccttagaagtgaaggaaagtgaaacttatggcatatactggtatggtcttgcctggactatgaaaagtagactcaaatggcagaaactggaatttggcaccttctaaaatatttgtcactttagcacagacttggccatttattggcacctagctattagaaacataattgtcgctgatatcccaaatgcttctgtgatctttacactttactttgggtacccccttatgccttgcagaatctctagcattctctaacctttcttttgcttcttcttttttttttttttttttttcctccacagatgcatagagcccttatgtgtcctcctggccagccattaatccccacctgacattaagacaggctatactcctgtcttaaaatatgtcttcccttttccgggccccagtaaaattaatcattctcttagtcaacctggtaatgatctgattttaataacccaaattaaagaagcttaacttttgcactaatataggaaaacgtttgcattttcaaagattatcttattataaatttaacatactcagtggtctaaagatattttatgccctttttctaagcactgctttatctatgtcattctgagtatttctttcgcctacccctgccagccagaaatccaaaagcatgaagccaactgagaaccatcagccattaactcactgccctggcctctttcaaagtggccttgatactgagtaaaaaaaacagagttgcttagattacaaattgggttggcatagtcatcagcaagtaacttaaatagaattccttaaggtaagaagcatttttattatagaatggggaaaaaatgtttttacaataggaattgcagatttctacttgctttatataaggagcacatacatagaatgtcagaaagtctccaaagtatatacatattaaatataacccactgaattgtacacaaaattttgaaacaccaaacaacagaaaaaaagaaagccaggcccaaaacattttttttagagatggggtcttgctgtgttgcccaggctggaatgcagttcacaggtgtgactgtagcacactacagctttcaactcctgggttcaagcagtcctcctgcattagcctcccaagtagttgagatttcaagtgtgcaccactgcactcccccagaaaacatgtttaaaacagaaatagaacttttaaaactttagttttaattaagcaagccatatcactttttattcctatctaatgccatgcatacatgctaaaatcttagataaccaaaaattatgcaaacatatgcaaagaggtacaactaaaaagaattattctacatgtactgaaggagtggacagagaatcttcctactagccttctgtggcttcagggccagcaggtgaagaggggtcagtatcacactcagctgatttttcaatgcaggattgtagtcttagtaaagaggaaaaggaaagtgtctgttttcagcattctgatctaattgacaagctgtaattaaatattatcttttgataatggaaactttaccagaatagggatttttttttctattaatatatataaattgaatagaaacgtttcaatttagcacaatttctttcagtagtctagatctgctttttcacaagagggtttctatgagatgactgagctccaatgctggaagtcagtggttctcaaagtgaggttcatgaactagcaatattagaatacttaggagaattcaaattctcaaaccctatgcccaaaactctaaatcagcaatctgttataagctccaggtgatttgaggtaccctgaaatttgagaaccactaccttaagacatccgttgcttataatgaattaatttctttcctactcatctggaatggtactagttatctagagacatttcaacctagtacaatttcttttaatagtctagagaataatttttaaatttcagacagtataatttattctgagaaacttggaacattgatcaactccttcccttccccccctccaagattatttcaccttaccagtcttaattattgagtagaaaaactaaaatatcattagttttttcttactgtgttagaggcatataaatttctgtttaaaacttcagataacattaagtatgtaaaaatttatgtgaaattaaaacttcagattttgaatttttaatctctagttggttgtatatttatttttaataaaattaagttcctaaagagcaataattgtttgcatttttttcctttagagttagataattattgagatttttggatgcagagagtaaatacaggcctcttgaatcttgttttagaatgtattgggtatctacttaaaaggaacaggctccttttaaaagtattataagaaggcacaaacaatatgccccttagatgtcacttctgctacaaaaattgcattatataacttttgtcacaattaactttttcataggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggtatgcaatggtattttttcaagatacaagcatctttgataattgaatttggagtgggaattagaaaccattttacatataattattttaaaagggttttcttaagaaaacttgctgaaattagaaattaagatggaaaagttgaaaatataaatcttactataacattctccaaattaaaacatgcttcatagggcatttcatattttttatagggaaaagtctagatttcttaatatagtctatgatgtcttttgcccacttcatctcttttatctcatgccatcaaccatgttcttctgctattgcagcatcactgtctgtctttcagttcagttacttcctacttcagaacatttcttttttattattattactattattattatactttaagttttagggtacatgtgcacaatgtgcaggttagttacatatgtatacatgtgccatgctggtgtgctgcaccaattaactcgtcatttagcattaggtatatctcctaaagctatccctcccccctccccccaccccacaacagtccccagagtgtgatgttccccttcctgtgtccatgtgttctcattgttcagttcccacctatgagtgagaatacgcggtgtttggttttctgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtgtatacccagtaatgggatggctgggtcaaatggtatttctagttctagatccctgaggaatcgccacactgacttccacaatggttgaactagtttaccgtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttttggctgcataaatgtcctcttcagaagtgtctgttcatgtccttcgcccactttttgatggggttgtttgtttttttcttgtaaatgtgtttgagttcattgtcgattctggatattagccctttgtcacatgagtaggttgggaaaattttctcccattttgtaagttgcctgttcactctgatggtagtttcttttgctgtgcagaagctcttgagttcaattagatcccatttgtcaattttggcttttgttgccattgcttttggtgttttagacataaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtatcatgctgttttggttattgtagccttccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgagcagtatggccattttcatgatattgattcttcctacccatgagcatggaatgttcttctatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagacattgctgaagttgcttatcagcttaaggagattttgggctgagacattggggttttctagatatacaatcatgtcatctacaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtctgatattggctgtgggattgtcatagatagctcttattattttgagatacgtctcatcaatacctaatttattgagagtttttagcatgaagggctgttgaattttgtcaaaggccttttctgcatctattgagataatcatgtggtttttgtctttggttctgtttatatgctggattacatttattgatttgcgtatattgagccatccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctacccggctttggtatcaggatgatgctgacctcataaaatgagttagggaggattccctctttttctattgattggaatagtttcagaaggaatggtaccatttcttccttgtacctctggtagaattcggctgtgaatccatctggtcctggactctttttggttggtaagctattgattattgccacaatttcagctcctgttattggtctattcagagagtcaacttcttcctggtttaatcttgggagggtgtatgtgtcgaggaatttatccatttcttctagattttctagtttatttgcatagaggtgtttgtagtattctctgatggcaatttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctactagcttttgaatgtgttttctcttgcttttctagttcttttaattgtgatgttagggtgtcaattttggatctttcctgctttctcttgtgggcatttagtgctataagtttccctctacacactgctttgaatgtgtcccagcgattctggtatgttgtgtctttgttctcgttggtttcaaagaacatctttatttctgccttcattttgttatgtacctagtagtcaatcaggagcaggttgttcagtttccatgtagttgagcggttttgagtgagtttcttcatcctgagttctagtttgattgcactgtggtctgagagatagtttgttataatttctgatcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttctatttgcttggtagatcttcctccatctttttattttgagcctatgtgtgtctctgcatgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcattagttgatgcagtttcttcctagtctcgatggcctttacaatttggcatgattttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctgtatatgaaattctgggttgaaaattcttttctttaagaatgttgaatattgacccccactctcttctggcttgtagagtttctgctgagagatctgctgttagtctgatgggcttccctttgtgggtaacctgacctttctctctggctgtgcttaacattttttccttcatttcaactttggtgaatctaacaattatgtgtcttggagttgctcttctcgaggagtatctttgtggcattctctgtatttcctgaatctgaatgttggcctgccttgctggattgggaaagttctcctggataatatcctgcagagtgttttccaacttggttccattctccccatcactttcaggtacaccaatcagacgtagatttggtcttttcatatagtcccatagttcttggaggctttgttcgtttctattcttttttttctaaacttcccttcttgcttcatttcattcatttcatcttccatcactgatatcctttcttccagttgatcgcatcggctcctgaggcttctgcattcttcacgtagttctcgagccttggctttcagctccatcagctcctttcagcacttctctgtattggttattctagttatacattcgtctaaatttttttcagttttcaacttctttgcctttggtttgaatttcctcctgtagctcggagtagtttgatcatctgaagccttcttctttcaactcgtcaaagtcattctccgtccagctttgttccattgctggtgaggagctgtgttactttggaggaggagaggcgctctgctttttagagtttccagtttttctgctctgttttttccccatctttgtggttttgtctacttttggtctttgatgatggtgatgtacagatgggtttttggtgtggatgtcctttctgtttgttagttttccttctaacagacaggaccctcagctgcaggtttgttggagtttgctagaggcccactccagaccctgtttgcctgggtaccagcagcggtggcggcagaacagcggatttttgtgaaccgcgaatgctgctgtctgatcgttcctcttgaagttttgtctcagaggagtacccggctgtgtgaggtgtcattctgcccctactggggggtgcctcccagttaggctgctcgggggtcaggggtcagggacccacttgaggaggcagtctgcccgttctcagatctccagctgcgtgctgggagaaccactgctgtcttcaaagctgtcagatagggacatttaagtctgcggaggttactgctgtctttttgtttgtctgtgccctgcccccagaggtggagcctacagaggcaggcaggcctccttgagctgtggtgggctccactcagttggagcttcctggctgctgtgtttacctaagcaagcctgggcaatggcaggctcccctcccccagcctcgctgctgccttgcagtttgatctcagactgctgtgctagcaatcagtgagactccgtgggcataggaccctccgagccaggtgcgggatataatctcctggtgcgccgttttttaagcccatcggaaaagcacagtattggggtgggagtgacccaattttccaggtgccatctgtcaccgctttctttgactaggaaagggaactccctgaccccttgcacttcccaagtgaggcaatgcctcaccctgcttcggctcatgcatggtgcgctgcacccactgtcctgcgcccactgtctggcactccctagtgagatgaacccagtacctcagatggaaatgcagaaatcacccgtcttctgcgtcactcacgctgggagctgtagaccggagctgttcctattcggccatcttggctccagccagaacctttcttatagggatagtgtttttctgccctaacaccaatcacttccctgcactatttctctgatcccgccctagctaacttcagcaaacccacagaggtctgaagtttaaacttcacatgttccaaaaaagccttccctaactccaagttggtaggtagttgtttcatgtgtgtcttccccattagaatgtaagcttcatgaggaaaggaatcctgcttgattgacttgactcctgctgtgtcctcagcagccagcacaaaaccttcctctttaactactggtagtaagcaattgggcatataatctgaaagttactccagctgtgatctatactatctgtctattccagtggctcacaacctcttttcttctatgatacatttatcacatgataatatatccctaggtttatgagcaatgctgaatgcattatctagactccacatgtttctcttcctcttagaaaagcatattggaatcaagtaaattcagagggacataaagcatttatatctttatagtgcatgtataatttaaatatatatttgtacagctgtccctcagtatccacaggggattggttccctgcaaatacccaaatctgcagatactcaattcccttatataaaatgggatagtatttgcatataacctatattcttcctgccatatacttgaaatcatctctggattacttaaatagtatttaatacagtgcctacacatcactccatttgcatggatttggtatagtactcagcatgtggcaagttcaagttttgcttttggaactttgtggaatttttttcggatatttttgatccatttggtttaatctatggatgcagaacccactgatactgagggctgactatatttacataattttaaaataaagcctaaaaatcaaagatagaatacattttagttttgtttaatttgatgaagcatatgtgtcttattaccttaactaaactctgaaacaccttttaaaactaaatataatatagcttttacttcaggtttttagctggaattctttaagcctttcatatgcaaaaaatatatagtaaaggaagtaatttgagtgacatgagaataatgttttggaaattgtctgtagttagagtctaacatatatttaggcaaatatgctttttaaattttagttatagaattaacttatatcagtgtatttccttcagctcacttgggatccacatgtagaccttgtcagctctttcagctacaaaaataaatcaagaataaaaattcaatcactgatacccttgcttccagttgattgaattggctgctgaagcttgtgcattcatcacatagttcccgtgccatggttttcagctccatcaggtcatttaaggacttctctacactggttattctagttagctatttgtctaatcttttctcaaggtttttagcttgtttgcaatgggttcgaacttcctccattagctcggagaagtttgatcgtctgaagccttcttctctcaactcgtcagtcattctccgtccagctttgttccgttgctggcgaggagctgcgttcctttggagggggagaggcgctctgatttttagaattttcagcttttctgctctgttttttccccatctttgtggttttatccaactttggtctttgatgatggtgacgtacagatggggttttggtgtggatgtcctttccgtttgttagttttccttctaacagtcaggaccctcagctgtaggtctgttggagtttgctggaggtccactccagaccttgtttgcccaggtatcagcagcagaggctgcagaacagcaaatattgctgaacagcaaatgtccactccagaccttgtttgcctgggtatcagcagcagaggctgcagaacagcgaatattgctcaacagaaaatgttgctgtctgattgttcctctggaggtttcgtctcagaggggtacctggctgtgtgaggtgtcagtctgcccctactcgggggtgcctcccagttaggctactcgggggtcagggacccacttaaggaggcagtctgtctgttctcagatctcaaactccatactgggagaacctctactcttcaaagctgtcagacagggacatttaagtctgcagaggtttctgccgcattttgttcagctatgccctgcctgcagaggtggagtctacagaggcaggcaggcctccttgagctgcggtgggttccacccagctcgagcttgctggctgctttgtttacctactcaagcctcagcaatggtgggtgcccctccgcaagcctcgctgccaccttgcagttagatctcagactgccatgctagcaatgagcgaggctctgtggacgtaggaaccctcctagccatgtgcgggatataatctcctggtgtgccatttgttaagaccgttggaaaagtgctgtattagggtgggagtgacctgattttccaggtgccgtctgtcacagcttcccttggctaggaaagggaattccctgaccctttgcccttcccaggtgaggtgatgcctcaccctgctttggctcacgcttggtgggctgcactcactgtcctgcacccactgtccaacaagccccagtaagatgaacccagtacctcagttggaaatgcagaaatcacctgtcttctgcactcacgctgggagctgtagactggagctgttcctattcgaccatcttggaactgcctggcctagtgtcaagaataaaaattctaatgaagtgacaatttatgtaactaatataccactcttatatagccctagagctatatttaatattatttaaatggcaaaatataattttacttggttagaactataatactttataatgttaaaactttatagcattgggctttagatttatgaaataatacaggtcagttctatttctaatttcttttttaaaaattatttttcagtttcaagtttatccaagtaatatggaatttaatattctaaaattataataaggttttagaagttagtccttcaatccgtcaaatttttttctttcttcttttggagatggagtctcgctgtgtctcccaggctggagggcagtggtgcgatgttggctcacggcaacctttgcctcccaggttcaagtgatgctcctgcctcagcctcttgagtagctgggattttccaggtgcccaccaccacacctggctaatttttgtatttttaaaagaggcagggtttcaccatgttggccaggctggtctcgaactcctgatctcaagtgatcctcctgcctcggcttcccaaactgctaggattacaggcttgagccaccgcacatggcctcaaacttatttttatacacaatgttagataagggtctaacttgattttatttcaattgactagtcaatttgctaataaccttttaaaaattaaacttcttttttcatgagaatgccatctttatctcatgttaagattttgtaaatatgtgcacatatttctggactatccatttcacttatctgttttaatgccaacaccagactcttttgattatagtaattttgtagtaagttttcacaacttgtaggggaaataggtttccactgttcttttcaagtttcaattgtcacacacctattcttccatatgagctttatttatttatttatttatttatttattgagacagggcctcactctgtctcccaggctgaagtgcggtggcatgatctcggctcactgcaacctccgcctcccaggcttgagcagtcctcccacctcagccttccaaatagcttggacaataggtgcacacctctatgtccagctaatttttgtattttttgtagagatggagttttgccatgttgcccaggctggtcttgaactcttaggctcaagtgatctgcctgccttgacctcccaaagtgctgggattacaggcatgagccactgtgcccagcctcatgtgaactttaaaatcagtttacctaaatagaaaagaaatgatgagaatcttgttcaaatcacatttaagtttacttattaatttcagaagaattaacattgttatgacagtaacgtcactttaagaaacaggtctcgtttgatatccagagggagctaactgggaaaatgttgaaagattgaaggaaaattctgaggaactaaatgaggttagagaccatgaaattatagcaactttagcctgaatggttgagtgagtttattccaagatcgcagagtagctaagtataacagaagagaagctaaatgtctgaaaaagaacaaagagacaagggatcaaaggcaaggaattaaaaaattcaagtgtgatgacaaaggaaaagatagaaatgatgggtcagatagtctaggcgagatttttaaagaattaaaaaccagaaggtttgcaacagattggaagaaaattttgtttctgggactgtaagtctaattaaagttgcaaatgaggagcatataaagtaagagcattaataatgagctggaatagtgggaatttatggtcaaagtaagtttttgaggttaaatattttagaggtagaacacatttaagtaatgaaatctaagcaatatggaagccattgttgtggttatcagagtggattgttggaaaagagtaaaagcaaaaggtcaccagaagagagatccgttgaagccattattatagatattgaagttactgatggtagaacaaggtatgctaccagaggccgtacatcctgttctcttgtgatagggctattcactgtataagttttactagttttggcagcttcagtgaatgcaggagtatcttttttattaaatgactcttttatctggcaaaactacctctgatcagtggattgcagactattaacgtgactttcatgacattttgaacttttaaagtggcatatggccaaacattttatgaccctctaaaataacttaaaatcatagcgtctttatggtctcaaaacaagcaagctgttccaagagaaagaggaagtatctgttagtgaaaattgttgtgccttatgcttactgccaagagtttcagaatttttattaggagttccacaaagtcgttagcttttaagaagggagcatagagaaagagtttgggagagatgggagaagtgatgtggggggttcaatggagaggatgtaaaaagtaatgatgaataattaggaaagggatccacaatttctggcaaaagatttactttctacaaatgtatgtttaaagtgtcatggaaacactattacattctcttagtttgattctttttttaatgaccggaaaactagcaagttgagtagccacagaagatatttatatatgaaggtagaaaaataaaattttagggataaatagtatataactggtagagattataatgcaaaatcagttacttataacttctactggttgtagatttttcttcagtttattttgtagttatctgattcctttaaaatctcctagaactgaaatttagagatatttctaaaagaactttttataccttgcattttatctaaacaaggaactcttaaccagtgcattcagtttggcttcttgaattttaagtccttattttacttgacctccttacagcatttgacgtagttgaaactcctcattcacctgattttccttttatgtatgtggctactctctcttttttttaagtggtatcttactggctccttctctaccaaatctttaaatgtatattatgcagttttttaaatttgtaagatttagatatactacttgctaaaatagatgaagattcagctccctcacctcttttcctcccaaaactatatatctatagttgctttattggtagcttttgtaatgtgtatctaaatctctgtttttttgtttcatccactataggcaataggcctcaagtctgcatttgcaagatgagtctatcctttttatttttcccactttgtacattgcaacttctatcagctacacttttgtaatttcccttgtgatttcttctttttccagtgtttgtttaagactgcagtgtttaatttgtgaatttaccagatttgttcattgtggtcagagaagacattttgtagaatttaatctttttagattgattgagacttgctttatggctgaacatatggtctatcccagagaattttccatgcgtacttgagaagaatatgtattctgttgctgggtggggttttctatatatgtctgctagttggttttatagtgtacttcaagtcctctttacttgctgatcttctgtctggttgttctatccattattgaaggtagggtattgaagtctccaactattattgtagaactgtttcttctttcaactttgtccattttgcttcatgtattttagatgttaagtgcatatacctttataattgttgtaccttccttatggattaaccaatttttcaatataaaatgttcttccttgactctcataaaaatatttgatataaaatctatttaacgtaatattagtagctactctggctctcttttggttactgtttgcatggaatatctgtttctattctttccatttcattctatttgtgtcttttaatcctgtagaaagcatatacttggagctttaaaaaaaaaatcctggctgggagtggtggttcacacctgtaatcctagcactttgggaggctgaggcgggtggataacctgaggtcaagagtttgagaccatcctggccaacatggcgaaaccccgtctctactaaaaatatgaaaattagccaagcgtggtggtgcatgcctgtaatgccagctactcaggaggctgaggcaggagaatcacttgaacccaggaggtggaggttgcagtgagccaagattgtgccattgcactccagcctgggcgacagagcatgactccatcttgaaaaaaagaaaatcctttctgctaatttctgccttttaatttgggtagtttaatctttgaagtcctgataaggaaggacacacatctaccattttgttacttgctttctatctgttgtatatccttttttggctcctcaattcttttattgctttcttcttttgtatttaactgattttcttagtgtaccgtttttgatccctttcttgttccttttaccatacattttctagctattttcttagttgttaccctggggattacaattaacattttaatttagctagttagaattaataccaacctagttgtaatagtatataagaactttgcttctgtttaactctactcccttttctgttactattttcagaaattacgtctttaaacattgtgtgcacattatagatttataattaattttatacatttttcttctaaatcatatattaaaaagaggaattaccaccttaaaaattcagtaatactggcttttattatgcacctgtgtaattacctttcttgatgttatttcttcgtatgacttcaagttaccaactagtgttctttaatttccagagaatttcctttagcatttcctgtaggtcaggtatactagtaataaattccctcagcttttgtttatcagggaatgtcttaatttatctcttatttgtgaagtccagttttgccatatataattttgggttgacaggttttttttttctttcagcactttaaatatatcatccactactttgtggtctccatgatttctgatgagaaatcagctgtttttcttagtgaggatcccttgtccattatgagtaacttctctctcactactttcaagattgtctctttatttttgtctttcagtagtttgattataatgtgtcttggtgtggatctatgagtttatcctagtcagagttcattgagcctcttggatatgttgttttatgtcttttatcaaatttgggaagtttctggccattgttttttcaaatattctttctgcttttttttttctctcatgtctgtgcttccgaaactcccattatgtttatattggtatgctggatagtgtcccacagttttcctggttctgttcatttatctttattctttatttaacctcactcctcagactacataatttaattgacctatctaagtttactgattctttcttctgcctgctaaaatctgctgttgaaaccctctagagagcttttcagttattgtacttttcaactccagaatttctatttgattcctttttaatttccatttctttattgatattctttatttggtgagacatcattctcctggttttccttagttatttcagcatatttaaaatagttgacttaaaagtttttgtctagtaagtccaatgcctgggcttcctcagggacagtttctgttcatttctgtttttcctgtgagtgggttagtctttcttgtttctttgtatgcatcatattttttgttgaaactggacatttatgtgacaactctggagatcagatcattcttcccccctagggtttgttgttgctgcttgttttgattgttgtcttctatttttttaatgactttcctaattatttctgtgaagactgtattatttagcatgtgtacccactgaaatctctgttcttttagcttagtggtcagttagtgattttcagagattttcttaaatgcctggagaaaaaaggaaaaaataaacctctcccagactctatcgattggttctgttttgaggcactctttcactgcttatctaggcagtttaccactctgccttaaccttcattcctgcttgtgtggaacctgaagatcagccaggggttagggttagggttaaggttagtgtcttctcaggtcttttccaaacatgtgtctgaccctggacatatatgtggccttttagattccctggactcacaggagcttctcaaaactctattctcccagacatctctttccctagcctcttccttctcagcctttttggtctgtctgttgcttgctgcagctactatcctttgtccaatgtggtggcagctaatacatttttgcctttaactactttcaacaaatgccacttagaagccacctcagccctagggaagctccagggcaagtgatacaaaggcaagcccttgagctaatccttcagagagccaccaaacatgtcaaaacacacaactacaactttttgagaatatggtctgcattgcttcctctgttgccagcaatctgcaccaggaatgtgggctgttcaacttcaaggccaccaccaagctggggagtggggaatggtaacagggtaagttaagatgcttcagaactctcttattgaaattcagcagtttttcttttcttcattaagtgtttccctggttttgtaatttattagattccagatttctgaaaaagttgattttgtttttggggtttttttgttcctagcatatttgttgcttttgtggagggatggagtgtttcggagttccctactctagcatttttgctctctctttgggattccaatttggctttattctatgagttatacttttaaatttcaagattaatgtcatttatatctgttctataatcataaaactttgtcagttggtaggatttaaaacttgaaaactggtaaacagtatttaagtctctataatataacaattttttactttacagtaaagaattaagctatgtttgtctccttttccgcttcctaagccactccaagaatagtcatagcatcaaattcaaatggacccctcttcattataccttaaaagttgtccaaacccatgccacattttagtttgccccatatttgagccatgcctttcatatatagtttgtttttttctggagtttctgattgcctttttaaaaaattgaacaaagaaatttactgctgtttctacatttctgacttctagaatctactctttttgaagcctgtctccgtgatctaatttagactcatcatttgcttttgggccattctttatagtttattattttatatcatattattagtagcctttgatttttttcttgtattatgtgtctttctcatatcttcaagtatttctgtcctctcaacctctcgatggtagagttcttcggattttggtcctgggctctgtttacactctctgctttcctcctaggcagtctcgtacatgcctttgactttaaatactatttatatactgaagacacaaaaatatatacctgttcctttatggtttacccacttagattgtgtttaggaaaacaagtcctttaccacattgagattttaaaaacattctcccattttgtcttcctaaagttttaacatttggccttttttatttaaatttttattatacctgtaattgatttttatatttgaggttaagttctgatttgggtggggaggggttttccttccataggaataatcagttaccctagtgctatttattgagtgttctttcctttctcattgaactgcaatgccactctgtgagacttttgttggcagtgagagaagtaggtgggagagaccttttgcagatcttcaattaatgcccctgtgttcagtctcacttctcattcccatcctccatcatacttactgttagttgctttccagagttccactgagcaatttggctgccatctttttcttatttccagtgcatatttgagaacacagcccttttttatccttcttcatcacttaacactttttctttctagcttccagaaattttctgaaatctcctgctgccaatagtcttcccctactgcacttgttgttgttgtgggtttatgtctttttcattactttactattcttcaatggggtcttggagggagagcttttaaacacatgtgcttagtctatctgctatttttttttttgtgagacggagtctcacgctctgtcccccaggctggagtgcagtggcacaatctcggctcactgcaacctctgcctcccaggttcacaccattctcctgcctcagcctcctgagtagctgggactacaggtgcccgccaccacgcccggttaattttttgtatttttagtagagacagggtttcaccttgttagccaggatggtctcaatctcctgaccttgtgatccgcccacctcggcctcccaaagtgctgggattacaggcgtgagccaccgtgcccggctgtctatctgctatttttatctgaaagtacaaagtgaagaattttaaacattagaggttatatttctacattttctgtaagtcttcaaaaagataattaaattttatcatttgggaccctgaatgatacaatttaactatttctgaacataaaaagctagtcagagggccgcaaagtttcttacctagtgtttcgatttgttttttaatactgcatagggttttccatttttaataatcatttatatttatagtctttagtatttcataatgccaaaaaagtggatatttcttgggttacaatgtctataacctttggcttatggggggggcgtgtaactaaatgcctggaaacaagtctctatgaaaaaattatagacacaaaaagggaagaaattctctaaaactttgctatatcccactaatgatttcactattcactgtacttgggacagctctacagtaaaatgacatattgcaggtttcttttctctggcagaaattggaaagtacttggtgtaatgttttttttttgcttacattggatgcatgcagtgaagctgggttatttttggtcatttcctgtctatgaacactgtggtattttagccaacactactataataaaatataatgcatacaatgaattttcacacctatgaatgttgtaatagaaattcataaaataaattattataggaatcagcaccacttattcattgggaaaagaatcttccgaaatattttaagtctttctgttcaggcctgttacgaaaagcctaaaggttaaaaaaacaataataatcctcctaaataatgtctcttttcatctagacatttaagagtatgttctacatttagctgggctttcagagtcattattgcattgagctagtcaccctgtcttttcttagggtcctttattgaaaaggcataggatattttctggccttttttttttttttttttttttttttgagacagagtttttgaggctggagcgcaatggtgcaatctcagcccaccgcaacctctgcctcccaggttcaagcaattctcctgcctcagcctcccgagtagctgggattacaggcatgcaccaccatgcccagctaattttgtatttttagtagagatggggtttcatcatattgaccaggctgatctctaactcctgaccttgtgatccacccacctcggcctcccagagtgctgggattacaggcatgagccactgtgcccagcctcctgacttattcttatgtaaagatcaagttgaattgatgaaactttggacttaaattaaccactaaaaatcttgaagagaattcatatttgatttcattctgcctgctgttatataattaatatttcagttggagaatataattggaaatgtattggactttatgggaaaacacattttaaacagatcctccagagaagaataccagctttcttagagtacagatttagactagacagaggtaggaaactgggtcagatgaccagttacccactctagaaatctgactcacacttaattccaccctttccttcattctccagtcaaccactaagtcttacttttatttattcttgaatgtctgataaatctgtgttctcttttattaataataatcatgaaaatgtactgagctaagtatgaggcatagtttagaatatttttttctaatcttcacaacaactctgaaaatatatgtattatgataatcatttacatacaagcaaactgaaactcaaagaattgaataacttgccccagaagtcatcagttaccaatggcagatctggaatttgaactaaagtctatctcactttcttgccattgccattttgactacaccatacccttttttgttatgccagcatatggtctagttgacacttttgcaatggtctcttactcatcccctacattcagcctctccctactatgtcctccacaaagttgattgacttatctgtctgaagtggggctttgagagcagagagcatatcttattcatctttgtatccctaacaccagtacctagatccatgcatgatactttggaggtgcttaaaaacttgcattgaatataatctcatcactttttaaatttaaaaacctttttctgcttctgaaccatgcaggataaaatctgacttttcaggctcatctccagctcctactcccctccatgtttcaatgttcctgccctgtattttagtgttccagccatagaaatattgttcaacccagcaatcccattattgagtgtatacccaaaggaatataaatttctctagtataaagacacatgcacatgtatgttcattgcagcactattcacaatagcaaagatgtggaatcaatctaaatgcccatcagtgatatactggataaagaaaatgtgggaggccgaggcaggcagatcacttgaggtcaggagttcgagaccagcctggccaacatggtgaaaccccgtctctactaaatatacaaaaattagctgggcaaggtggcatgtgcctgtaatcccagctactcgggaggctgagacacaagaatctcttgaatccgggaggcggaggttgcagtgggctgagattgtgccactgcactccagcctgggtgacagagtgaaactgtgttaaaaaaaaaaaaaaaagaaagaaagagagaaaatgtggtacatatacaccaaggaatactatgcagccataaaaaagaatgagatcatgttattttcagggacatggatggagctggaggccattatcattagcaaactaacacagaacagaaaatcaaataccgcatgctcttatttataagcaggagctaaatgatgagaacacagggacacactgaagggaaagacacaccagggcctattggatggtaaaaggtgggaggaggaggaaaaaataactaacgggtactaggcttaatatctgggtgatgaagtaatctgtaaaataaacccccatgacacagtttgcctgtgttacaaacctgtacatgtacctctgaacttaaaataagagttaaaaaaagaaattattcttacataaatatattatacataatcaggttttattttccatacaaaataatgtctgtgtcaggtttgcgcatgtgcccctgaacttaaagtagtcattcctgcgcccttcttcattctgttttcccaacttctgctcctgataaaaatctgctatttatctctcaaggatcagttcaaatccaaccttcctttttaaaattgacttttcccctctggaagaattagtcattcctttctctgtgttcccttagcatatggtttaaatattcgttatatcacaataagcacattatattatatttaatatatatattcatcttcctctccgccccacccatccagattgagagctctttgagggcaaatatatcttgatttattatatccccaatgcttaacacaatatctgacacataataaattctccacaaaaacctatttgtttaatgagatattgaggtcattttagtttagaaattatatcccatgtgtttattaggttgattgcagaggaggattagagcagttatatttctgaaactatgacccagtaaaagtgagcaataattttgctatatccagaaacctttgtatgatctcagtgttgattgttcttatcaatacagatgatttagtggcatgtgccagaattcttagcacagtgttttgtagatagtgggctttgaggacatgtttggtgaatgaaagaaagaaagaattaattagttaattaattaatatgtgtgtatgtataactaaaaagatgtacccatatctgctaaggatacaaggaaaactagaagaacaatccccaaaatataaacattgtttggcaagctaagtcactttttaatggagctcagaacacactttcccagaggagcaaatttgtaaacattgaccagagtttaaggctaaactcaaaagcttccttcagaaaataactgaaatgggttaggtgttatatggcctgtttactaggtgctagtgaaaaggatgagcctgtctgcagcccaggagacttgccgtttgtttttaccaaatgggcatgtgatagctatataaattggaaattacttctgctttgttttgtaaccatgtcactgttttactgaatgtagccttgtttattatgtcacttatttcctgaagagtttacttgacaagccctttacacaaaataaataatccctttctgatgacagactttttattgtggagcttatattcttaaacttttaattatgtggaaaaagaaaagcaagacacttttaaatatatgatgtggagcaacatcatttcccaaagggtttgttgatgtttttgatacataactctgattccccatcatttttacattaaacttttttgctggttactgtggccatcaggcgtccctatgtgggtaaaccttcttgctaaacctgattctgtgtctatatcactgattctgcccctttactgaaactatagcttatggttcaaacatccttcttaagatataatacatactcattaaaaacttcatcattgtcccacttcattaattcatccaagaaatatgtattgagcagagcataggctaggagctgtactagatgttggatctactatagtaatcgtgacaaaattcaagccctcaaggatcactgtgtttagtaagagagatatagataaggcaacaagtaattgcagtacaatgtggcaagtattgtaatagcagtatgcactcttttcatcttctttgttttagtggcagtgaagctgtcctttgttctgttccagtattgattatataagcaacctcaatgagatataatctaactcaatgtatcacacaaagcacaatgtatggaactaattgttaagttagtttttcctattatcagccttcacctttctaagattattatctaagaccattcatgtactactactcattggatatttgatttttgtcacataataatcattgtcttaagtgctagtctggtagaaatcaagcctttttgtattttcttggttgcatattcacttaaagtagactgatgtcattattcatcttgttattgaataaacaaatgtgtagaaggttaactggtacctctgaaataagtatgataaacaacagggcagcgctttcttagttttatcccttaacatcattgtaaatgtttgaagatatttaataattcattcagtatacattgttaaaagctgattactagattttgggtccccaaagatgaaaaaatatataatctttagcctcactcactatctggaataacaggcaaaattgtaagcataaaattgtaatatagttatgagaagtgtgttccaggagtataccaaagaccatgggagcacaaataagagcgagacactaattttagtaggggcaaataaatactggatgaaaggagaaatcccagaaggaaaatgcagaaacaaaaaccatgctttgtttaagttttgaggttgggtaaaacaaatagttatgtctctattcacaaagcagataatatgagttggattaagatatttcatttattctctagctatgatttagatagccttatataaaaaatgtggcttctaccttggaaataataattaccaaattcagtgcagtatgagaagcatgtatatatatatatatatatatatatatatatagtgtgtatatataatataaataatgattccttttcactgtttcttatttcaaagtgaggaggaaatctacactgattttactgattataactgtagtatacactttaaaaatttcaaaaaccattgaagtatccaaaagtagaaagttagagttaccccctaatacaacctctgagaaataaactatttttagcagttattacttggttcataaacatatttttatatgtatggttcttactatagaaatactaatttgtaaactgtacttttttctagtcagaaaagtttatagattgggaaaacctatctgtgttgacatggaaagataaccataatgtagtaaacggcttgttttaaaactaaagggaatattagttatctttcatggatagaaataatttgggtttagaggtgatcttttttgttcataacatgcctcttaaattaaaatatatgattagaataatacaaaactgctagatagtctattgaaaattagtctttaatgctctaggtttaattactgaaatgaaaaaagaatataaaattgtgaagagcttttctgacaggtcattatactgttaggtattctgcatgatatctttcatttaaaattatactttgggttttccaggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctggtaaatatttccttttagtagtatatttgaatattcttagtcaatgacttgtgtgttcaggccaaagacctgttttaacttgtatttatgtagtttctatctggcaggaagatttaagttttgtgttgattttcttgagctaggatttaaattagtattcataaatggccttgaagttttatgttaacatttgaaattctatctcaaaaaaaatgatcctttgtggagtagaaaaagactgatataattttattcaagttatatatttctactttataagtgattcaccttaccacatagccttatgtattcacctatggtacctggtaatggtgaaatgtatatttactgtataatttttacagttgtcccctaacaatgttgaaaataattttaatagctcattaaaattactttgagaaattagccttcctcaattatggtgtcattgtattatttagtatgcatttgtagaaactgtgatttctgtaatgagttctctcttgagtttctattattgttgtgtttttctctgtcagccaagagacttccctcacctgcctttttggtgggtttttgtttttattttcacttcattctccctaaaaaagatagttagaggtgaagacagtatgtttagaaaagagcatctagattcacagacagaatgcttgcgttaacattgcagttttagtgatttgatttttctatagccagtataactatcctacgtagtgtttggcaagatacaagtaataataactaactagttcttctcaggaaaattgtgggggcctgtatttataaagttctgaaattttcatttccagtctttttaaaaaaatttatttaatgtcaatgtaaagcatataaaatcaataattcctgaaagaatctgcattatttgatatttatgtatctttaaagaatgttggtttataagtgagactgtcatttgtagaaggagtcacccagaattcaatattggatggattccatcaatggtgcattggatgaattaaagttatgtaagtttagtacattcagttgatttaatgtaattgaaaacatatttgctaagcctaaagtttacatatttacctggggaatgattagtgaagctttaatgttaatatttcaatatggttaaaatcaatgttctgatctgtatttgtgttttatcattgcagcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtaagctaaaaactagatgaactatagaataaaaatattccttcttagtgaaaatagttactttaaatgtttaggaatttaagtaaccatgatagaacatttgagatataatggttttttttaaattgacatttaaaatgtcaaaaggctaagaatctattttaaaacttccaaagaactaaataaattgtaaaaataaaatagtaaccaggttatagtaaatggcaaatacttatactgttgtttgtaagcattcagtgaaataaaatggtggggtgacagttaaaaataaaaataaaaaataactcttttataagtaatgtgatctttgtatttctcaaagtactttgcagactgcctgctatgcaagaggggataaggaagtaaaacctaaatgtcaactaataagggtattgtggtagagaaagggaagaataaaatggaaaaaaaaggggaggaagaagatgacttacaaaaagaagagatgaaaaggagaaataagccaggaagaaagataaaataagagaaagtgaaaataagagaaaaagaaaataaaataagtataagtaaatgtctggaaagctttgttaatagctggtagcaaccactgtgccatgactacattgggtaactcaggtctggagctgaatagctggaaaattattagtgaaaagttatttttagattgattctgctaagcttgtcacaaggtaatcccccagctactcaaaagccatgttcttttaaaatattaatttggaaggaaagagagaagctatgcttccacctctactaaatttaaacactcctccagaggaaaaaaaaaacatctttaatatgttgttagtcttattacaatatctcttgaaattcagaagacctctttattgtaagattaactgtaatcaactttctggcacagtaactgtgtttccctgcagctgatacagtacaggtagatacttaactccaaaaattcagcatactatgaggagactgtacatctctggatcaatgtacaagcagctatatgaaatttgcatcaaccatggtatttctgtaacctcagaatcagccatctgctgaagatgttgggtaaatctgaatcttcagatgacttttaatttctccagctagttctcaagagggttggctcagtcttgtgtactcatgtatactatttggtacttcccccgaggtgaggttgtgagtccctggaaggacctaataattagtcctaaaggttttcaaagttagcccagactggaaatagaatggttatttttactgtgggtgactgagtctcccttaattgaggtaacacaccgttacctcagttaaccctaaatggtgtatttacccagatatggattattactagaataatacccattattatcaaactttgaatcaggaaggaatagtgtagttatataaagtggagaagaattagaaagaattagaaagaaccaatataatttattctgatttaaatttctgaaaatctcaatgccagggatatttgacactttattaaaatacctaaaatatattcctgtttgttaggtccttgaccttagatagtaatgttacactgcatttttacttctctgtgtataaaaaagaatgatattgcttgaggtagaattaaattgaattaatagcatcaagaaaacatggagtagtggcctgcattggccactaggtgactatattggaccaaacactacttagttattagctaaggaagaatttgaagtctccttaactgtgaagatccagggaagggaagagagttagcctgcactgattcataggtatgtttgtgaattattggtttgttttaaagaaaatgcctgtgaagagtattacagatagtgtcaggaacaaattttcaaaagatccaaaatttaattataccagggtttctaaaccttggctctgttgacattttgagccagataattctttgttgtgggggctgtcctctgcattgtgacatgtttaacagcaaccctggtctctacccactagatgcccgtaatgtccagaaataactaaacatgtctccagacattgccagttgttctgtagggggcaaaatggctcttggctgggatcattgaattatatatagacaaaaaaacagtatttaaaatgtaagcaaccctattttatattaaagaaaatatccccagatagtaatacaggtactgctttcagcttttagtactttcttggttaatgtaagaatgggtcctcatagggtatacttgtgacaagttattctttttggggagaaagactgatagaatgaacaggagcatccttgctaattcagtgaaagttccatctctcaggaagggacaaaattatccctataggagcaaggtatgaccaacaccttggcttacctttgacacattattaaaatgaatctatcccattgatacttgggaattttttcctctaaatcattctaatccaagaagctataggatttctgaaaaaaaaaaatactaaaaattgaaggtacctcaagtgtaattctcaggaaagacagcttctaaatcagagctgactcatcacctccaatcagcttccatcatcatgaaccacaattatacgtcttcattttaactcaagaaagaaaaatatcaatgaaaactcttctttccacagcacaggagaatgtgcttttgtgggcttaaaagataatatttaatttggatctctctttgggattatatcagttttattcagctaagagttggtgtcatttttttacccctttctattgtgtctcttcaggtgacacagaatgatatgataatggctgaaaggctctttggaatcctagcacatgtagcatcttctgagttaccccagtatcgtctgatttccattctgggtgatgccaggtaacctttaatttttgtagttttttatagaattactgttacactagaaaaagaaataaattccacatacctcctaactatgctaattatgtgttccataaacatgtatcctagactggcctattgaaagtgttggggatcttaagataaataagatgaagtccttattctcgtatggcttatagtctaataagttaaagatatacacatacaattaaaacgtaatgtttcaggtgctataagggagggctgtaggagggactaaccatattttggaataacactggggaaggcttcacaaaggagaaaacattttatctagttctttgggaatgagtaggagttttcaggtagaggatatggggaaaagatatctgcaaaagcacaagtaattgtaaatagctcagtataattggaacatgggatgattatgaataaatgataggaaatgaagctagaaagactgattgtggtctgactttgaagagctttccaatccatgccaagcaaaaatgaaaacttgtgttttgtaatgaagcacaagcaatcatataattggatttacattgtagaaaggctgccatttgagcaggcagagcttgaagtaatgaagaccaatcaaatggttactctgtaggccaggagagattatgagggcctgagccagggcagcaagatggagaagaggaaacctgacagaacacactaactgacgaggtggagcatggatgaagaaatagtcaaggatggttgaccagtcatgattcagttacagatcatacaagtcactctggttagagtaagcaaggaattagatatctacaaaatatttgaaagcgttgaggaagcagtttctagactgagcctccagagatatctcccagaattataccatagaacaagcccacaaaggaaactgcctccttgctatggtcatggagcactttgctacagtcaaggacaacaggagactgttgtcccagctgtgagcaccaggatcataccgctttagctgcgctgaggatcaggaagttccctactctgctccccagaatctggctccagaaccatgttaccctactataatttacactaacaaagtgagtcttttgcatgctactcctacttccccacttagcccagttctgaattcaaatcttacccaagtgtatcggattgatggaatataaatcccatctaaaacccacaaaaccattctgaaaaaaaaggaggcattgaattcaagaaacaatgatgtagaaagaaatcggtaaaaattatagttgtctgaataagtattaatgtataatgttaaaaagattaaataacctacaaggaaaaatccaagaaaatcctaagagaatgtaagttaaagtttactttctttccctgtttaggtgagataataggtactaattaacaataaaaattgatggaaaaatacacgtttgtgtgtattaaaatattaagggttttcatagaaaaagattagatggataatttctaaactactaaaaggaaaaaagtgatcaacgaaaagcaggaaggaaaaaaaagcatttgggttatcaccataaatattaataaagtcttctattaatagatgctctcagattgaattaaaaacatgtttttcagagatacccctaaaaaacccctaaaggcttaaaagaaagggatgggaaatatataatgaactaaatgccaacaacaaacagatacaggaatattagtggttaataatgatagacttgatgacactaaaaactacaatccaccagaaaatagttatgaaacagtgtaactaagactacagcttttaaacatatcaacaaatacaggcatatattgacaaatttttcagttattataatagtcattaatatgcttctttcataaatcagatcaaatcaactaacataagaaagactatagaggatttgcataacatagttaacacattttatcaaataaatatacttaaaatcttgtgttgacaaccttattcccaattcagaaaaaaacatatattttattcaaacatctatggaatgtttgtaaaagttgaacatctattaaactgaaagtaaatcttcaagtatctcaaaaagcatactcatacagatcacattttctaatcataatattataaaattagaaaataatgggtcaggatagccaaaaacttatctagttggaattgggatgggtagtggggtagacagtggacacaagcttccagaaaacaaaatacaaatgcctttaaactttaagaagaggatgtttggtcaaagttatagacaaccaaattttaaaataatgagataactttgtgggaaaagactagaagtttgatgatatgcagcggcagtcctcaacctttttggcaccagggactggtttcgtgacagacaattttgccatggacggttggggctaggggatggttttggaatgaaactgttccaccacaggcattagattctcataaggagtgggcaaccaagatccctggcatgtgcagttcacaatagggtttgcgttcctatgagaatctaacgccactgctgatctgacaggaggcggagctcagcggtaatgcttgcccgcagttcaccacctgctatgtggcccggttcctaacagccatggacaggcctgaatagcacagttatttcaccatgctatatatcggggtctccaagccccaggctgtggactagggctcgggaacccctgatatacagcatagcaaaatagagttcttacatacttttggtggtaatgaaagttactgtaatacttgttcatagtaacttagcaatatctaataaattgtaaatgcacatacctttacacttagcaatttcacttaaaggaatttgttctacagataattttctttacatgagcacaaatatctatgtgcaaggattttccttgcagccagtgtttatattagcaaaaatatgaaaactcactaaatgtccatcaatagagcgagacgaattacttgcagctctaaaaataattggatgttcttatatgaaacggttaaggtgtttcagaaaataaaaatataaggtacagaacaattgtatagtatgctgcaatttgtgagaaatggggcatatgtgtcaaagatactcttgtgcaatttaaaaatatttgattttttcaatatgcttgcctctaagtgttgaactggagggagacactaggattccaaagtacatagatactttttactctatgtttctatgaacctcttgaattatcttcttgctttttgttctatcttgtttttttattttttatcctttttaaaaaagcatttaaaaatactttaatgcttctgaattaaagaggaaataaagctaaaataataaatcatatataaatgaatttgataataagaatactatatgtcaaaacctctgggatgtgaccaaagctgtgctgacaggaaattatacatctttaatgtacttattagaaaacaagaaagattagaaagtaatgaatgaagcttttacttcaggaacctagagaaataccaaagtaaggcaaaattttaaaaaatggaaaaaagaagttcataaagataatagcagcttctaaagaaataagaatttgaaagagaatagttgaccaataaaagcaaacactgacgctccagaaaatccaagaattcaactattacacttttggaattaattggaatatataacaatgaggccagatactagattaacatatcaaaataattaatatttcttcataccaataataagctgttgaaaatagtattagaaaaagtaccccatttatagaggcaaagaaactatgaaatatcagaaaatacaccttataaaaagtaactctgacatacacaataaaattgggaacaggcctggcatggtggctcacgcctgtagtcccagcactttgggaggctgaggcaggtggatcacttgagcccaggagtttgagaccagcctgggcaacatggcaagactccatctctacaaaaaatacaaagactaaccaggcatgtggctcgcacctgtggtcccagctacttgttgggcttgaggcaggagggagaatcacttgagcctgggaggctgaggctgcagtgagccatgatctacaccactgtactctgatctgggtgacagagcaagaccctgtctctaaataaataaataaataaaaatacaattaggaacaaaaaggaagcttaaaaatgaatatttacaatgttaacaaattccaagacttaatattgtaaagatgccaatttatcctaattaaattacaaatttacttaattcccaatcacaaatcccaatatgatttctcaggaccctaaaacaagatacattttatatcttagaaaggcatttatcatctcatgttaatgaaaatgttctactatactttctcatacttcctgaaggtttgtaacatgtagctcacaaacatttttacagttttatatgatgaaatacatcataaagtgaaaatacataagcagacaggagaatatatttgcagcatgtttaacagaatttttaagaaatcctacaaatttagtaagaaaaaagacagttgagataatagaaaaaaaaaggcaaagcatataaagagaaaactcacaagaagaaatatgaatagccagaaaatgtaagcccaactcacttctcatcagagaaatacaacttaaattaaaataatgcgatgtcatttttgccaatgagattgacttaaaaatttaaaaaccaataatatcaatgacttattagtattcaggacaatgtacactgtacatgttggtagaagtgtaacatgacttttggtggaaggtagtttcacaatgtctatcaaaatttaaagcatacatatatttgaacccagtagttttagtactaggaatatattctaatgaaatacacatatgcacaagttatttatgtagtaagctgccatgctttattgtttgtagttacttaactttggaaagtaaccaaatgccaaataattggtaaaactaagtatatcatagtacttccacatttatagatgtagaatctatatgatactgtttatattacagtagataatatgactgtaaaaggaggaggaggagggggagaaagattgaggtaaatctcctgttctaacatgaaatgatccagagacagttcattgaatgaaatatggcataaaactatttatattatgacccaatgttatttaaaaacaacataataaatatgtagacattaaaaatatggaaacacagaaagggaactgacaggatgaacacctgggaggatatagatatgaggagtaaggtagagtagttgaagagtgcttttcaggttttattctatgtctgtacggtttgaaaagagtagtttttgagttttaatctgtataagattaggaatatattgaacttctatttctgacaatgatgagtttggttgtttttaccatttcttgagttaaaaacaatacaaaatgctagacaaaataaaaaccttcattaaagttttggggagctggtaaggtataacataattactaggccaggatctatgggaaaatgagaacattgagaattaaggtagacacaaagctcttagaaccgaacttacttttcctgctcttacacaccattcaacacagatatgtgagggggttttccctacacactagccaggcaattcagcagcagacaccagctgggtgccctctaattcaatttaattctgacactgcctacctggagatagtgtcagatcctacaggttgaaagatcattcccacaagacggctcctccccaccaaacccagcctccctacatcacatgccagttgcaagcactagttgtgacctgtgcttctgactgaccagctaagaattgagattctgacaacccccttcttggggggttctattaatttgcttagagtggctcacagaacacaaggaaacactttaattacatttacccgtttattataaaagatattacaaaggatacagatgaacagccagatagaaaaaatgcaaagggcaaggtatgtgggaaggggcacagagcttccatgccctctccaggcataccacccttcaggaacctccacatgttcatctatccagaagttctctgaatcttgtccttttgggtttttgtggagacatcattatgtaggcatgataaatgaaatcattggctattggtaatcaagtcagttttcagctcctctcccctccccagaggttggggatggggctggaggtcccacccctctaattatgccttggtctttccagtgaccagcccccatcctgaagctatctggctcacacaccccagttaccagccatctcattagcataaaaaacattctcgttactcttgcaattccaagggttttaggaactttttgccaggaaatgggaatggagagaatacagggatggacaaagaccaaatgtatattttatcatatcacagagactgtttgatccagaggcatttcaaggaaacataaatttttgttctgctagtctagaacagtagaaatgatggaaatcaaagcccagggctccatctaaaatggtaaatgtgaattgacgtcttcctaagggttaaaatgaaaccccagtggctataccatcaggtcagaaataaacctacctcttctccccactcaggaatttccaaggaaggttgccttgatatgagcagaaaagaggaaagttgtccctaagcaaatgtaaacaaaaagcagtcctcatatagatgtgcagcctgaattcataacacataactagtttaaaataatataaagatttaaatatcactgtctctaaatatctggaaaaagcaaatatacctcctctctggaagaagttactttcatcttgtctcaaagaatcctcatggctaatttttaagggcaattaccagcatacaatgaaaaaataaataaccagtcacacaagaaaataagacatcatgtaaaagaactggaaggaaaaaatagattacagaaacagacccatgaatactttaaatattggtattatcatgcatagactataaaacgactgtgcctgctatatctcatgatatacaagataagcatgaaaatatctgaagagaataagaaattgcaaaaagtgatccagaagacctgaaaggaaaccaaaagaaattatataaatgaaatatgtaatacacaaagttaaaatttaatgaggaggcttaacagctgactagacacagttgaaaagagatccataaactgagaaacagactagaagagattttctggaatgtagtacaaaaagaaaagaagatagagtatatgagaaagtggctaagaaatttggaggataaagtgagttgggaggtttaacatctgactgaagtttctaaaagacacaatggagagcatagggtagagtcagtattaaaacagataatggcaaaaattgttcagaactgatgaaatacacaaactacatattaaataagcccagctaatcgcaaaaaggataaatgaaatctacacctagtcacatcacagtgaaactacagaactctaaatataaggtgaaaaaatttaaaaacaaccaggaaaagagaagttaccttcaaaagagtggagatcaacaaattgatttcataacagcagcggtggaagccagaagataggataatgaatgatatgttcaatgtactgaaggaaattaccaacctagaattctatgcacagcaaatatgtcttttaagaatgaaggtgaaataaagacatttgaaacaaaataataaaaacaaaatctaagagaattcccattagtattcttacactaaaagaaattataaagcttataattaaggcaggacagtgaccccagttagaaggtctgagatgcaagaaaagctaaagaacaaggaaagtactaactatgttggataaggctaaatgaacattgaccatataaattaggagtatccaatcttttggtttccttgggccacattggaagaagaattgccttgggctacacgtaaaatacactaacactaatgatagctgatgagctagaaaaaaatcacaaaaaaaaaatctcatgttttaagaaagtttacaaatttatgttgggccacgttcaaagccatcctggatcccatgtagtggcccgtcagccacaggttggacaagtttgatatagatcaacagtaacaacattttgtggggtttaaaaatataaaattaaaatacactgcaacagaagcatatgtagtcggaaggagtaaatggagatattgtattctaggacctcgtattatctgggatggagataaatatagtgactaactttagatattagtgggttaatgttgttcatgttgtaatttctatggtaaccaaataataagcaaatatatagcttccaaattagtaaggtaaggcaaagagaaaacgaaaaatagaacatgtggattaaacagaaagaaatgaaaatggtagatttaaacataaatagtggtatatcagcatgtatgttcctgtcactttgccagtactgtgtgacaaacaccccaaatcttagtggcttaaaacaggaagcatatatttttttctttgagactataggtcagctaggtggatcttatgccttcagctggggtcctcatgtgtcagtagtcacctgtggattggataggcggctctgctgatcaaaccttggctctctcacttgtttgagggttggctggctgtaacctggtctaggaaggccttagctgggacaacctgtctctgctccacatggtctctcatactccagaaatctgcctgggcttgttctcatggcagaggcagggttcaaagaaaaagcagaaacatgcaaggcctcttgagtcctatgctaagaactgacataccatcatttcacccacaaacttttggtcaaatcagataacagagcaacacttaaggggcctgagagtaggccttacgtaattgtaaaatcacattttaaaggacgtggatgcaaggaagccataatacaaccatcaatgtaatgaatccacctcaatgataaaatgcaaatatattaattgttctgattaaaatgcaaagattagccaggcctggtggctcatgcctataatcccagcactttgggaggctgagacaggcagatcacctgaggtcaggagttcaagaccagcctgttcaacattgtgaaaccctgtctctactaaaaatacaaaaattagctgggtgtggtggaacgtgcctgtaatcccagctactcaggaggctgaggcatgagaatcacttgaacccaggaggcagaggttgcagtgagttgagattgtgcaactgcaccccagcctgggtgacagagcgagaccctgtctccaaaaaaaaccaaaaaaataaaatgcaaagattgtcagactgaataaaaaaatgaagttcaactatatgttgtttacaagagatacatctgacatatgtttacataaatattgaaagtaaaaaagtgagaaaagataaacaacataaatacttaccgaaataaaaatggagtagctattgaggactcaatagacttgaaagttgaaagtaatactagaaataaaaaggatcatttcaaaatgataataggttcagttcactagaaaaatataggacatttaaatttgtatgcacttattagcataaccttaaaaatgtataaccccaaaattgacagaactacaaatccacaattacaattagtggaaagttttaacacatctctgagtaattaatagaaaaaggatataaaatgcttgaataatgtgataaatttgacctaattaccacttagagaacattgcccccagcaactgcacattcttgtcaagcatacatggaacatttataaaaattgaccaaatactgttcataaagcaaatgtcaagagattgcaaagaattgaaatcacatggagcatgttttctattcaaaatgtggtcaatctttaacctgattacaaaatgataaccaggaaattcccatatatttgaattaagaaacacatttctaaataacccacaggttaaagataatttcataatagaaatctgaaactaccttgaactgaaatataataaaaatacccatttcaaaacttgtgggatcaagttaaagtggtgctaaatggaaacagccttgcaatgggtatagtgggaaagaataaaagctgaaagtgaatgcgctaaaacacttatctcaccaagatagcaaaagagcagcaaaataatccagaagaaagttaaagaaaagaaatgatgttcaaagagtattaatgtaaagctgattatgtgaaaagactaataaaagtgataacaaatgtgtacagacattgcttctgtaattttaaaaaaatcagtaaagataataaatggaaataggggccaagatggccaactagtagtagctgtggttggagactcccactgagaagaacaaaaatggtgagtgaatcctgcaccagcaactgaggtatccaggccctcttattgagactgacttgggcagttggcacaacccatggagagagaggaaaaacagggtggtgcgatggcccacctgagagccacacagggcaaggggagctcccacccccagccaagggaggcattgagtgattgtgctaccctgcctgggaaaccacaatttttccatggatctgtgcaacccacagatcaggagatcccccttatgagcccatgccaccagggccttggatctcaagcacagagctgtgcagattctcagtgaccactcggctggagactgcctaagactactgagttcctcgggggagaggcagtcaccatcactgaggctgcctgctgcctaagacaactgaactccttgagggagggacagaggccatcactgcagctgcctgctgcctaagacgactgagcttcccaggggaggggcagatgccatcactgcatctgactgctgcctaagaccactgagctcccagagacaggaatggcagccatcactgcagtaacccatccctgcttactaggtagggcctccctgcaggaatttcagcaactccagccaggggtttagggacagacctctgatctccctgggactgagcccctgaggggcagccacagtctccacagatcagccgatttagtctttctcctgctggctctgaggtatctgggtagtccagacaagtgggattcctcccagtgcagtgcaccccttccactaagggacagccagagtgcttcattaagcgggtgctggatcccatgcctcctgactgggtgagactcccctcaacaagggttgccagacaccttatactggagcattcccactggcatcagattggtgcccttctaggacagagaccccggaggaaggagcaggcagtcatctttactgttttgcagcctccactgatgacacctccaagtgcaggagggacccagttgaatagtgtctggagtggaccccccacaaaccacagtagccctacagaagaggggctgactgttgaaggaaagcaacaacaacaacaacagcataaacaaaaaagtccccataagaaccccatccaaaggtcagcagcctcaaagatcgaagataaattaactcacgaagatgagaaagaatcaatgaaaaaaaaaaacattgaaaactcaaaaagctagaatgcctctcctcctccaaatgatcacaacacctctccagcaaggacacagaactgggtgaaggctgatttggatgaattgacaaaatagtgcaaagaagccaagaaccatgctaaaagattacaggagctgttaaccagaataaccagtttagagaggaacatagcgacctgatggaactgaaaaacacaagaacttcacaatgcaaccacaagtatcaataactgaatataccaagcagagtaaagaatttcagagcttgaagactgtcttgctgaaataagaaggcagacaagattagaggaaaaagaatgaaaaggaatgaacaaaatctctgagaactatgggattatgtaaaaagacaaaacctacagctgactggggaacctgaaagagacagggagaatggaaccaagctggaaaacatacttcaagatatcatccaggagaacttcccgtacctaacaagacaggctaacattcatattcaggaaatccagagaaccccagtaagatactccatgagaagatcaaccccaagacacacaattatcagattctccaagattgaaatgaaggaaaaaatgttaagggcagccagagagaaaagccagtcacctacaaagggaagcctatcaggctaacagtggacctctcagcagaaagcctacaagccagaagagattggaggaaaagccattaccagccactgcaaaaacacactgaagtacaaagaccaatgacactatgaagcaactacatcaacaagtctgcaaaataaccagctagcatcatgatgacaggatcaaattcacacaaaacaatattaaccttaaatgggctaaatgccccaattaaaagacacagaatggcaagctggataaaaagtcaagacccatcggtgtgctgtattcaagagacccatctcatgtgcaaagacacacaaaataaaataaaatgaaataataaaataaaacaaagggatggaggaaaatttaccaagcaaatagaaagaaaaaaaaaaacaggggttgcaatcctagtttctgacaaaacggactttaaaccaacacagatcaaaaaagacagagaagggcattacataatagtaaatggatcaaggagagctaactatcctaagtatatatgcacccaatacaggagcacccagattcatgaaacaacttcttagagacctacaaagagacttagactcccacacaataatagtgagagactttaacaccccactgtcaacattagatcattgagacagaaaattaacaaggattttcagaacttgaactcagctctggatcaagtggaccttatagatatctacaggtatttctcctaatgttattccctcccttagccccccaccccctgacaggccctgttgtgtgatgttcccctccctgtgtccatgtgttcttatttttcaactcccacctatgagtgagaacatgcagtgtttggttttctgctcctctgttggtttgctgagaataatgacttccagcttcatccatgtccctgcaaaggacatgaactcattcttttttatggctgcgtagtattccatggtgtatatgtgccacatttttttattcagtctatcactgatgggcatttgggttggttccaagtctttgctattataaatagtgctgcaataaacatacatgtgcatgtgtcttcgtagtagaatgatttataatcttttgggtatatacccagtaataggattgctgggtcaaatggtatttctggttctagatccttgaggaatcaccacacagtcttccacgatggttgaactaatttacactcccaccaacagtgtaaaagaacttcaccccagcctgggtgacagagcaagaccctatttctccacagcttcgccagcatctgttgtttgttgactttttaataatcgccattctaactgacatattatctcattgtggttttgatttgcatttctctaataaccagtgatgatgagctttttttcatgtgtttgttggccacataaatgtcttcttttgagaagtgtcttttcatatccttcacccactttttgatggggttgtttgtttttttcttgtaaatttgctttaagttccttgtagattctggatattagacctttgtcagatgggtcgcttgcaaaaattttctcccattctgtaggttgcctgttcactctgatgatagtttcttttgctgtgcagaagctctatagtttgattatatcccatttgtcaattttggcttttgttgccattgcttttcatgttttagtcatgaagtctttgcccatgactatgtcctgaatggtattgcctaggttttcttctaggggttttgtggttttaggttttacatttaagtctttaatccatcttgagatactttttgtaaaaggtgtaaggaaggggtccagtttcagttttctgcatatggctagccagttttcccagcaccatttattaaatagggaatcctttccccattgcttgtttttgtcagatttgttgaagatcagatggttgtagatgtgtggtgtaatttctgaggtctctgttctgttccattggtctatatgtctgttttggtaccagtaccatgttgttttggttactgtagccttgtagcctagtttgaagtcaggtagcgtgatgcctccagctttgttctttttgcttaggattgccttgcctatatgggctcttttttggttccatatgaaatttaaagtacttttatctaattctacaaggaaactcactggtagcttgatgggaatagcattgaatctataaattactttgggcagtatggccattttcatgatattgattccttctatccatgagcatggaatatttttccatttgtttgtgtcctctcttatttcctatttgattatttgtagttctccttgaagaggtccttcacatcccttgtaagttgtattcctaggtattttattctctttgtagcaattgtgaatggtagttcactcatgatttggctctgtgcttgtctgttgttggtgtataggaatgcctgtgatttttgcacattgattttgtatcctgagactttgctgaaaagttgcttatcagcttaaggagtttttgggctgagacaatggggttttctaaatatacagtcatgtcgtctgcaaacagaaacaatttgatttcctctcttcctatttgaatacactttatttctttctcttgcctgattgtcctggccagaacttccaatactatgttgaatagcagtggtgagagagggcatccttgtctcgttacagttatcaaagggaatgcttccagcttttgcccattcagtataatactggctatgggtttgtcataaatagctcttattattttgagatatgttccatcaataaccaatttattgagagtttttggcatgaagcgatgtttaattttatcgaaggccttttctgcatctgttgagataatcatatggtttttgtcattggttttgtttatgtgatggattacgtttattgatttgtgtatgttgaaccagccttgtatcccagggataaagccaacttgatcatgctggataagcttcttgatgtcctgctggattcagttggccagtattatattgaggatttttgtatcaatgttcatcattgatattggcctgaaattttctttttttgttgtgtctctgccaggtttcagtatcaggatgatgctggcttcataaaatgagttagggaggagtccttctttttctgttgtttggaatagtttcagaaggaatgctaccggctcctctttgtacctctggtagaattcagctgtgaatccatctggatctgggcttttttggttggcacactattaattactgcctcaatttcagaagttgttattggtgtattcagagattcgacttcttcctggtttagtcttgggagggtgtatgtgtccaggaatttatcagtttcttctaagttttctagtttattggcatagagatgtttatagtattctctgatggtagtttgtatttctgtgggatcagtggtgaactcccctttatcattttttattgtgtctatttgattcctctctcttttcttctttattagtctggctagcagtccgtctactttgttaatcttttcaaaaaaccagctcctggattcactgatttttttgaagggtttttcatgtctctatctccttcatttctgctctgatatttgttatttcttgtcttctgctagttttagaatttctttgctcttgtttctctagttcttttaattgtaacgttagggtgtcgattttatatctttccagctttctgttttggggcatttagtgctataaatttccctcttaacactgctttagctgtgtcccagagattctggtatgtgtctatttgttctcattggttttaaagaacttctttattgctgccttaatttcattatttaccgagtagtcattcaggagcagattgttcaatttccatgtagttgtgtactattttcccagtagtcattcaggagcagagtgttcaatttccatgtagtcccatgcagattgttcaatttccatgtagtttggagtgagtttcttaatcctgagttctaatttgattgcactgtggtgtgagagactgttatggtttctcttcttttgcatttgctgaggagtgttttgcttccagttatgtggtcaattttagaattcatgctatgtggtgctgagaagaatgtatattctgttgatttggggtggagagttctgtggatgtctattaggttcgcttggtccagagctgagttcaaatcctgaatatccttgttaattttgtgtcttgttgatctgtctaatattgacagtgggctgttaaagtctcccactgttactgtgtgggagtctaagtccctttgtaggtctctaagaagttgttttatgaatctgggtgctcccgtattagacgcatatatatttaggatagttagctcttcttgttgcattgatccctttaccattatgtaatgcccttctctgtcttttttgacctgtgttgatttaaagtctgttttatcacagactaagattgcaacccttgctttttttgctttccatttgcttggtaaatatttctccatccctttattttgagcctatgtgtgtctctgcatgtgagatgggtctcctgaatacagcacaccgatgggtcttaaccctttatctgatttgctagtctgattattttaattggggcatttagcccatttacatttaaggttaatattattatgtgtgaatttgattctctcatcatgatactagctggttattttgtacattagttgatgcagtttctacatagtatctttggtctttatattttggtatgtttttgcagtggctggtaccaatttttcctttccatatttagtgctttctttaggagctcttgtaaggcaggcctggtggtgacaaaatcccttagcatttgcttgtctgtaattttatttctccttcacttatgaagcttagtttggctggatatgaaattctgggttgaaaattcttttctttaagaatgttgaatataggccaccactctcttctggctttcagggtttctgcagagagatccactgttagtctgacgggcttccctttgtgggtaacctgagctttctctctggctgcccttaacattttttcctttgtttcaaccttggagaatctggggattatgtgtcttggggttgctcttcttgaggagtatcttagtggtgttctctgtatttcctgaatttgaatgttggcctgtcttgctaggttggggaagttctcctggataatattctgaagtgtgttttccaacttggttccattcactccttcactttcaggtacaccaatcaatcgtaggtttggtcttttcatatagtcacatatttcttggaggctttgttcattccttttcattcttttttctctaatcttgtcttcatgccttatttcagtaagttgatcttcaatctctgatatcctttcttctgcttgaaagattcagctattgatacttatatatgcttcatgaagttctcgtgctgtgtttttcagctccatcaggtcatttatgttcctttctaaactggttattctagttagcaattcctgtaaccttttatcaagaacattgggttagaccatgctcctttagctcaaaagagtttgttattacccatcttctgaagcctacttctgtcaaattgtcaatctcattctctgtccagatttgtgccattgctggggaggagttgcaatcatttggagaaggggcattctggttttgggaattttcagcatttttgagctggtttttcctcatctttgtggatttatctacctttgatctttgaggctaatgacctttggatggggtttttgtgtggggatcctttatgttgatgttgctttctgtttgttagtttttcttctaacagtcaggccccttttttgcaggtctgctgcagtttgctggaggtccactccagtccctgttcacctgggtatcaccagtggaggctgcagaacagcaaagattgctgcctgctccttcctctggaagcttcgtcccagaggggcattggcctgatgccagccagcactcttctgtatgaggtgtctgttggcccctgttgggaggtttctcccattcaggaggcacgggggtcagggatccacttgaggaggcagtctgtcccttagcagagctcgtgcactgtgctgggagaatccctcttgtcaggatcagctgctgtcttcagagctggcaggcaggaacgattaaatccactgaagctgtgcccatagccaccccttccccaggtgctctgtcccaggaagatggggattttgtctgtaagcccctgaatggggctgttacctttccttcagagatgccctgcccagtaaggaggaatctagagaagcagtctggccagagtcactttgccatgcccagcccagacctcccagcctccttagcactgtcaggggaaaactgcctactaaaacctcagtaatggtggacacccctccccccaccaagctcgatcatcccgggtcaacttcagcctactgtgctggcagtgagaatttcaagccggtggttcttagcttgctggactctgtgggagtgggacccactgagtgagaccacttggcttcctggcttcagaccgctttccaggggagtgaacggttctgtctcactggggttccaggcgccactggggtatgaaaaaatactcctaaagctagttcaatgtcttcccaaacagctgcccagttttgtgcttgaaactcaggaccctggtgatgtaggcacatgagggaatctcctgatcagcagattgcaaattaatgggaaaagtgtagtaacccagcggggtagcacagtccctcacggcttcccttggcttggggagggagatccctggctccttgcacttcccaggtgaagtgatgccccaccctgcttctgctcaccctctgtgggttggacccattgcctaaccagtcccaatgagatgaactgggtacctcagttggaaatgcagaaatcacccgccttctgtgttggtctcgctgggagctgcagactggagctgttcctattctgccctcttggttccttctattctgtactatttcttccaaaactattccaaacaattgaaaaggagggacttctccctatctcattttatgaggccattatcatcctgataccaaaacctggcagaggtacaacaaaatagaaaacttcaggccaatatccctgatgatcattaatacaaaaatcttcaatcaaatactggcaaaccaaatcaagcatcacatcaaaaagcttattcaacaccatcactttggcctcatccctgggatgcaaggttggttcaacataggcaaatcaataaacgtaattcatcacataaacagaactaaagaccaaaaccacatgattatctcaatagacgcagaaaaggccattaataaaatttgacatcccttcatgttaaaaactttcaataaaccaggtattgatggaatgtacctcaaaataataggagtcatttatgataaacccatagtcaatatcatactgaatggtcaaaagctggaagtattctccttgaaaaccagcagaagataaggatgccctctctcactactcctattcaacatagtattggaagttctggccagggcaatcaggcaagagaaagaaataaagcgtattcaaaaaggaagagaagaagtcaaactgtctctatttgcagatgacatggtcctatatctagaaaaccccattgtctcagcccaaaagctgcttaagctgataagcaacttttcagcagtctcaggatacaaaatcaatgtgcaaaaattgcaagcattcctacacaccaatattagacgagcagagacccaaatcatgaatggactcccattcacaattgctacaaagagaataaaatgcctgggaatacagctaacaagggaagtgaaggacctcttcaaggagaactgcttgttctattttcaagaagaactacaaatcactgctgaaggaaatcatagaggacacaaacaaatagaaaaacattccatgctcatggataagaagaatcaatatcatgaaaatggccatactgcccaaagcaatttacagattcaatgctacttccattaaactaccattgacattcttcacagaattagaaaaaaactactttaaaatttatatggaaccaaaaaagagcccatacagccaagacaatcctaagcaaaagaacaaagctggaggcatcaagctacctgacttcaaactatactacaaggctacagtaaccaaaacagcatggtactggtaccaaaacagacacatacaccagtggaacagaatagaaatctcagaaataagaccacacatctacaaccatctgatcttcaacaaacttgacaaaaaccagcaatggggaagggattccctatttaataaatagtactgggaaaactggctagccatatgcagaaaattgaaactggaccccttccttacaccttacacaaaaattctcaagatagattaaagacttaaatgtaaaacccaaaactataaaaagcctagaagaaaatctaggcaataccattcaggcataggcacaagcaaagatttcatgacgaaaacatcaaaagtaattgccacaaaagcaaaaattgacaaaggggatctaaacaaactaaagagcttctgcacagcaaaagaaactatcatcagagcaaacaaggcaacctacagaatgggagaaaatttttgcaagctacccatctgacaaaggcctaatatccagaatctacaaggaacttaaacaaatttacaagaaaaaaacaaaccccatcaaaaagtgggcaaaggacatgagcagacacttctcaaaagaagagatttatgtggccaacaaacatatgaaaaaaaggtcgacatcactgattattagagaaatgcaaatcaaacctcaatgaaatactatctcatgccattcagaatgacgattattaaaaaatctagaaacaacagatgctggagaggatgtggagaaataggaatgcttttacactgttagtgggaatgtaatttagttcaaccattgtggaagacagtgtggtgactcttcaaagacctggaaccagaaatacgatttgacccagcaattccattagtgggtatatacccaaaggaatataaatcattctattataacatgtacatgtatgtttattgcaggactattcacaataacaaagacatggaatcaacccaaatgcccatcagtgatagactggataaagaaattgtggtatggatatgccatggaatatgccatggaatactatgcaatcataaaaagaaatgaggtcatgtcccttgcaaggacatggatgatcgagatggaagccattagcctcagcggactaacacaggaacagacaaccaaacaccacatgttctcacttataagtgggagctgaacaatgagaacatatggtcacagggaggggaacaatacacgctggggcctaccagagggcaggaggagggagagcatcaggataaatagctaatgcatgtgggacttaatacctagtgatgggttgataggtgcagcaaaccaccatgataaatgtttcactgtgtaacaaagctgcacatcctgcacaggtatcctggaacttaaaataaatagaagaaaagatctatatgttactcatttttttctttacaaaggtgagaaaattatactatgtaactatcctataagaggaaccaattaagtaaattgtgatatatatcacaattgatttttattcaggtattaaaattataatttttaatgatacagaaaatacttatatagcattaagtgaaaacagtatacaaagttgtatgtttagtataatcttaattttttacaaaaatttatagaagaagtttgcaacgaaatatgtcaaatgtgaacattattattgttttttttaaagatttatttttttttatactttaagttctggggtacatgtgcagaatgtgcagttttgttacataggtatacacgtgccatggtggtttgctccacccatcaacctgtcacctacattaggtatttctcctaatggtatccctgccctagccctccaccccctgacaggccctggtgtgtgatgttcccctccctatgtccatgtgttctcattgttcaactcccacttgtgagtgataatgtgcggtgtttggttttctgttcttgtgatagtttgctgagaatgatggtttccagcttcattcatgtccctgcaaaggacatgaattcatcctttttatggctgcatagtattccatggtatatatatattccacattttctttatccagtctatcactgatgggcatttgggttgattccatgtctttgttattgtgaatagccctgcaataaacatacatgtatatgttataatagaatgacttatattcttttgggtatatacccactaatggaattgctgggtcaaatcgtatttctggttccaggccttcaaagaatcatcacactgtcttccacaatggttgaactaatttacactcccaccaacagtgtaaaagaactcctattcctccacatcctctccagcatctgttgtttcctgactttttaatgatcgccatcctaactggtgtgagatggtatctcattgtggttttgatttgcatttctctaatgaccagtgatgatgagcattttttcatatgtctgttggctgcataaatgtcttcttttaagaagtgtttgttatatcctttgcccactttttgatggggttgtttgtttttttcttgtaaatttgtttaagttctttgtagattctagataagccctttgtcagatggatagatagcaaaaatgttctcccattctgtaggtcaccttttcaaatatgaacattattaatttatgaaaacttatgggtggtttttatccatttctttatacttttcaaatttgcacttcctaaaaatctctaaaattattgtgttatacttttagatcagagaaaaataaatgtttaaaaaagttatattcctcttctgccctcaatcttcagtacacagttcacagtaaggtagtagtatcattttgagacaccctaagtggtggaaaccaaaaatccaccttcatggaggacgaatcatggctgatggctctgtaagtgatactatgagcactatgtatgttcctcttcacaatcaaatgaggcttcttgtttcaatatttaacccctactagaatcttgccatgatatgctcacaattggaggtttttggtttttgggttattttggttttgcctaaacttaagccaagatccaattccattttctagctatcagtaatattgccaagctgcataatggaattattaaccatttgtgtgatttataagtggtaattagcatgttttatgggacatgaagactttgaaagtttgacctactatatctttttgggttgttttgtgctctgtgattaatttttgtgttgatttttattaaaggagagttttttcattttagaaatgtttgagacgtattttcattgatgattagtagttatggaaaaaataattggggctgaatagcttaattagtagaaagtttggggtaccagactgaactcaaataaatcataaactcaaactcattaaaatatatattcaaaaaagtatatgttctcctctaaagtcaacaaaaaatagacatgttttagtaagtctgataagtaactctctaaatctctttactgtctttctacaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggtaaaactactgttaatctttgcgatctaatgccaggatatatcccacatggcttggaatttgggggttgtacattttacccttagttaagataacttttttgttctggaatatttgtcaaccttatattacaaagccagggacagtaggtacccaggcaattagggagaaatagagccctgagatgcagaagaacccagggtttcagtatcgttatttcagcagaaaaaaaaaatgctcaaaagaaatctgtaccataaatctgtagcaaaaatctagtccaaagcaggaccaagggtcccgatctatgtaagaaataggttataggcttgctgtaggtacttagccacatcatgccagaccatcagagaacacagcaggacctccgtttttgttctccttactgggaccattgatgttttaattcatacctttcattctacaccattttttttatgattacttaatcatataatttcaacttgttctattcctaatatagctacttagccaggaaaatggtaactaaacctttatgttttatgtggtcagaggttcagagtgttttgtataggggaatacaatgttgtggtgctgcaggaactacaaagaagaaaactatgtagtatttaccttgatggagctcataggaaagctgaagaaacaacttatctacataacaatacaacgttgtgacccttcaagagattttgagggaacaaaggggcaaaagaacaagaaagagaaaacacatttactgagcatctatgactcatgtgcaaggtgctgtatgaggtgatacatctatatccagatataagtatatctatagatcccctcacacaggttatacgattgatatataatagatatctttcaatatctacatatgtatctctagatatatagatataacatttagaagtgtgtgtgtggcagggcgaagtgtgtatactgtagatgtgaaatggctagtcaagtggttttcaaatgtttttaacagttttggacctctttattcaaaccaccgtattatagctgaaaacccagtgtatcagaagaaagcaaaacagcagagctgctgttgttatagaggaaaagtaggaaattcagagtttcatttgattgggtcttcttttccttttcctttcctttccttccccacccccaatcctgaagtgtctctttggaacccatagggctgtaggcattacagcttgaaaattacttgaaaactcaatgcaagactatttttaatagtatcctacaagatgttctactttaagttcttctagtgtgaaaggtcaatgtttcatgacattgttgtctatcacagaacaactctaaacgtgaagaaattcttactgatattaagcttaaatctgcctcttaataaccttcacttagtgatcctagtaccaccttacatagtaaaaagaacaagtctgttccttatgaaaatgcttcaaatacttgaagtcaactacctttttcatctcagcactctctacattcatactttcattcattcaaaaatcatgtattgaacacctgtcatacacaacacactgtgtaatatactagggctataaaaagacactgtccttgccctcatggatctcacattctaatggaggagatagacatatatacggataagtatcaatcagtttatcaagagcatagagagataactaacccagatcaaagtagggttttagaaaaaatgatggccgatatgagtcttaaaagataaaatatagctatattaaaaaggggaaagaggcagttctggcaaatagcacagtgcaaataaggcatagaagtataaaacatgtaaggagagggccaggaactataagcaggtcattgttgtggaagttcagagattgaggtagacagtattaaaagatgagaccagaaagatagtaagagaacaatgtgaaagagattgaacataatcctttggccaataggggtttcctagtgttgccaaaagaagaaaatgaaagccaaggtggcaggattatgtctcctcttcctgaatacagctggttctatgagtgaaaaaattaatatgtatatagttgtgtttggtttctatggacgattggtttcaggacctcctgcagataccaaaatgcacagatgctcaagtccctgataaaaaatgatgtagtaacgtagtatttgcatgtagcctatgcacatcctcccatatactttaaatcatttctagattacttataatactacaatgcaaatgccatgtaaatagttgttatactgtattgtttagggaataatgacaagaaaagtctgtacagatgtgttttaaaaaaatgttttcaatctgcagttggttgaattcacagatgcagaatccacggatatggagggccaactgtatttagtaaatctaaacatgccaatttacattaaagaaatttagtaaaatatcgaaaagctgcattcaaaccaaggatttcacagtaaaatctaccaactttttaagaaacagagaattctaatgattttaaaattgtttgagagtattgaaaaagaaggaaaactcttccatgttttcaatacagacagcataacattgattccaaaaatgccagtattgcataggaaaagaaaagccaaaccatacatttaaaaatattggtgcaaaccccttttaaaaatattgtcagccagaatacagcagaacattaaatgaataacaaacattatagccaagtgtagtttatcctagaaaggcagggaagattcaatattagtgaattaatagatctaatgtgaaaaatcatgattatttctatagacattgaaaataaatttcacacaattcaatacctattcttaattttgtaactcaataaataggataaatggaaattgcatagtgttatgcttgatggggaaactctggaaacattagcattagtagtaggcagaattctaactaaggtggcctctgtgatccccacaccccagtatccataccttatataatcccctcccatgggtgtaggtaaaacctgtgtcttgcctttaaccagtggaatatggcaagggtaaaggggttttgcagacatgattaatatccctcatcagttgactttgagttaatgaagagagagatcatcctgagaaagtctaacttaatctggcaagtcctttaaaagaggattcaagcggccgggcgcggtggctcacacctgtaatcccagcactttgggaggccaaggcaggcggatcatgaggttaggagatcgagaccatcctggctaacacggtgaaaccccgtctctattaaaaatgcaaaaaaattagccgggcgtggtggtgggtgcctgtagacccagctacttgggaggctgaggcaggagaatggcgtgaacctgggaggtggagcttgcagtgagccgagattgcgccactgtactccagcctgggcaacaaagcaagactccgtctcaaaaaaaaaaaaaaaaaaaaggattcaagctttccctgaaagatttttctgttggtcttaaagaaataagtcaccatgttttgagaggcccacatggcagggaactgcaagaagcttttaggacctgagaacagccccagaccaacagccaacaagaaaacagggacttcattcccacagctgcaaggaactgaattctgccaacaaccacttaggcttagaagaggactctgagcttcagaaataaacacaacctaggcaacaccttcatttcagctttatgaagtcctgagcagaacacccagctaagccgtgcctgggttcctgatacatggaaactgagctaatagatgcacgttgttttaagctgccaagtttgaggtaatttgttagacaggactagaacaccagtgcatcactgaagtaagtaacaagacaaggatgcctaatatcactattatatttttctcaatacagataatgcaatgaaacaagagaaggaaatcaatggtcatttgaaaagaaggaagtaaacttatatttgcagataatattattgaatacctggaaatcccaagaatattaatttagaaatcataaaaagctataagaaaattcagtaatatagcagaagtcaacagcttccatattacagataacaagcagaaagaagatataaggaaaaacctaactcacagtagcaacacagaaagataatgtatcttgtaataacctaataataaatatgcaggatctataaataaacttttcaaacattagtgaagcatacaaaagatttatacaaatggaaaaacatgccatgttttagataagaagaatttcaagcaaactttgtcaattttctttaacttaaaaatttcatataatcccaatgaaaataccaaaaacttttttgttgaggctttttgacaagttgatactatagtacatgtggaaaaataaacataattagctacaaaaactccaaaaaagaacaatgagaagaaggctagcactattagatattaaggcatattataaatacctatcaattaaaacagggtggttgtaaagagatagtctaatgggataaatgatactgaggaaatgggatattcaatcagaaaagcatattgaaccccttctttgcaccatgcaacaaaaaattaactccagaccaaataaaaacccaagtattaaaagcaaaagtttcaagtttttattttaataagaagagaaaatctttatgatcttgattgggttggctatgattttttaacaccatagatgcacaaactataaaggaaaatgttttggtaaattggacagtcattcaaggtgattgtgttttttgtttttgtttttttctatgttgcccagtctgtccctgagctcctgggctcaagaaatcctcctaccttgtccttccaagtagctgaaactacaggcatgcagatttttaaaaacagatagcttcagtgcagtcatgtaagcagagtcttgattaaagtgatatgagcaataattaagctataagaaagtaaagacagggaatgttgactcctgctttgagaaattttaaagaggaaagaaggaatctgaagccccaaaatatttggaaagaaacactaatctaacaatcaggagatgtggatttgagcccctgattctacttctgagtacttgaaagaccttgctgaagtcccttaatcactctctcgactcacagcccagcattccttcacttataccatgctccttacatcttgaaaaatacttaaatcactgcagcacaaagtgctcagtctctcttccatacatcctgagttgttgagaaaattaattgaggtaagttcttcacaaatcaggttaagcagaccctttcattatacatgtcataactctgttgcttggtagttgtccatctattctcctgactcatctaaaaaagatttaagatggacatagaatcagagtgctgaaagggactttaaagaatctaatgctattcttagatgaggaaaactggaaactcagatgagttactgagggtcacgttgaattattgactgagccgcctctagaatggagtcctaattctgaccttggacacgttcacagtatatcatggtgctctctcaagttttcttgaccaccctagtgcaaagggctctctcttttctgaacactgtttgtaatttgctgtctgaacgttttactcagcatgtatctactgttttatgtttttagttgactttttatatgtgcatgccatctcccaactagactgtaagttcttcaaggactagattagagagttttctctatggaagtattaatagaagatgcttaatcctgagcagatctctcaatctctatagaccttgtttcccacttataaaatggagatatggattaaatcctaatacaagtaccattatagttaaaattgctctataacaaaccccactgttgaccttctttttcccaaaccatcttcataacaacaaaattctagtttaatgaaataatgtaaacaatattgtatatagtttatctcatcagaattgaacttgtaaaatacttgctttatgaatcccacagggatattgtgagacaaaaagagatgagtatatgaaagcatttgggaatggaaaaagcattactcaaggagcaacaactccttgacaggtcagggcaagagaggtgtctctaacgtgctttcaatgggatcatcctggacaggcagagtgagtcatcctggcagacacctgatgacttatagggcatattgtaaggagatgcagaatagttggcttggaggagaggagaaatcatgaagtagaaatgctttcaaacacagttactaaattaaggattattatagcagatacaattctatatcaacatgtccctagagaaacagtggaagtaactatagcagaaaattttaaagcactgtaaattatactgtgccagttatgaagaatttattttcaattgtataatacataaatgatttaacaaaatatatcatttaattgttttaatttttgttatccctaaattattataaaaaatcttccaatcttaataatagaattttgtctttttaaattcaaaatcctattttaagcaatttggaaatctgtaaaagaagcattcactaaatatgctctatgctttctacttgtaaatgcattgcttgtaaaatattgctcattttagttgctgatctctagtgactcacacttgtccttctttgtaggagttcctatgtagtccagatttactgagtgcgaaaagggagcagctacattctgttctcatcaacaagctaacttagtataggtggctaatgttcagactatagtatttcagagtgagggaagatcttcagagaagaggccagctggaaccatttgttgcttatcacacatcaaaaatctgtacatacttttaagactggtcaatctatgacctattgttttagtacatgactatatcaaatcagcattttgacctgtgaatggtgattgattgcttagagatgccttatatgtcataagaaaattcttaaaatatgcctctgttaaggaaagttagtgcaggttggacttattgttaacttacattaattaatcaggaatttaaaacatattttattttaaacatcataagcatttgggccaggtgtggtggctcatgcctgtaatcccagctctttgggaggctgaggtgggtggattgcttgagttcaagagtttgagaccagcctaggcaacatggcaaagccacatctttacaaaaaataaaattagctgggtgtggtggtgcacgcctgtggtcacaactgctggagaaggtaaggtgggagggtcgtttgagcctgggaggcagaggttgcagtgagcggagatcatgccactgcactctagcctgggcagcagagtgagaccctgtctccaaaaaataaattaatttaaaaaatcataagcattgggaaacagaagaaaatattaaaaaggaggaaaacatactaatgttctcagaactcagaaacaatctttttttttttttttttttttttgagacggagtctccctctgtcacccaggctggagtgcagtggtgtgatcttggctcactgcaagctccgcctcccaggttcatgccatttcctgcctcagcctctcgagtagctgggactacaggcgcccaccaccacacctggctaattttttttgtgtttttttagtagagacggggcttcaccatgttaaccaggatggtctcgatctccagacctcatgatctgcccacctcagcctcccagagtgctgggattgtaggcgtgagccaagaattcagaaacaatcttaatgagacttcaatatattttcttcaatagtttttatgcattcttttctaactttttaataaaaatttcaaacatacagcaaagttgaaagaattttacaataaacatccatacgtccaaaacctacactcaactattagcatcgtaccatacagtgtacttactttatcacatatctatgtgtctatccatccatcagtctaccttcgtattttttaaattcatctcacagtcattgcagacattagtatgcttctgcctaaataattcagcgtgcatttcattaattgagattcagtattctacagagtatttttctttgtaaatttttccatttagaggtaaaacttatatactgaaatgtaaatcttaggtgtacaattgctgagttttgacaattcatacattcatataacccaaaccctatcaaaaaaaattttatttttttcacataacattatgatttaagcattttttcttattatgaatctttattttattttatttttaaatatttcaccttttagatatggggtacagtgcagatttgttacatgagagtattatgtgatgctggggtttggagtatggatcctgtcactctagtaatgagcacagtaccagacaggtagttgtttagcccacacccctaccaccctctatgttgttcccatatttatgttgttcccatcttccatgtgtgcacagtgcttagctcccacttataagtgagaatatgcagcatttggttttctgtttctgcattaatttgcttaagattatggcctccagttccatctatgttgctgcaaaggacaggatttcactctttgttatggctatgtagttactattccatggtgtatatatactatattttctttatccaatctaccattgatgggcacctgggttggttctatgtctttgctactgtgaatagtgtagcaatgaacatatgagcgcatgtgtctttttggtagaatgatttattttctttggagtatatacccaggaatgggattgttgggccaaatggtagctctgttttaagttatttaagaaattgccagactgctttccacagtggctggactaatttaattatattcccaccagcagtgtatgagagttcctttttctccacagcctcgccagcatctgttgttttttcactttttagtaatagccattctaactggtgtgagatggtatctcactgtggttttgatttgcatttctctgatgattagtgatgctgagcactatttcatatccttgttggccacttgtatgtcttcctttgagaagtatctgttcatgtcctttgcccattttttactggggttatttggtttttgcttggtgatttaagttccctataaattctggatattaagcctttgtcagatacatagtttgcaaatatcttctccaattctgtaggttgtctgtttgctctgttgatagtttcttttgctgtgcaaaagctctttagtttaattaagtcccatttgtctatttttgtttttgttgcaattgcttttggggacttagccaaaaattctttgccaaggccaatatcaagaagagtcttccagaatttttatagtttgaggtcttacctttaaattattaatcccttttgagttaatgtttgtatatggtgaaagataagaaaggtccagcttcaatcttctgcatatggctagccagttatctcagcaccgtttatagaatagggagtcctttccccattgcttgtttttgtcagccctgttgaagatcagatggttttcggtgtgcagctttatttctgagttttctattctgttccattggtcgatgtatctgttttttaccagtaccaaactgttttggttactgtggctttatagtatagtttgaagtcagatagcataatgcctctggctttgttctttttgcttaggattgctttggctattcgggctcttttttggttccatatgaattttagaattttttttctaattctgtgaagagtgacattgggaatttgatatgaatagcattgaactgtaaattactttgggcaatatggccatttttatgatattgattcttccaatccatcagcagggaatgtttttccatttatttgtgtcatctctgatttctttcagcagtattttgtagttctccttgtagaggtctttcaccttcttagctgtattcctacgtatttcattttctttgtggctattgtaagtgggattgtgttcttgatttcactgtcagcctggatgttgttggtgtatagaaacgctactgaattgtgtacattgattttatatcctgaagttttactaaaattgtttcaatttgagagccttttggcagagtctttaggattttctaggtatagaaatcatattgtcagcaaagagagatagtttgacttcttttcctatttagatgctttttaatttctttctcttgcctgaccgttctggctaggacttcctagaaatcttcgtaggtataattttaatgacactatctgtgatttttaggatttcatttgtttgtttgtttgttttgttttgttttttgagacagagtcttgctctgtcgcccaggctggagtgcagtggcacgacctcagctcactgcaacctccacctcctgggttcaagcaattctcctgcctcagcctcccgtgtagctgggactacaggcatgtgccacaaccctggctaatttttatatttttagtagagatggggtttcaccatgctggccaggctagtctcgaactcctgaccgcaagtgatccacccaccttggcctcccaaagtgctgggattacaggtgtgagccactgcaccgggccaaattttttttttttttttttttttttagaaacaaggtctcactctgttactcaggctggagtgcaatggcatgatcatagcttaaactgtagccttgaactcctgggctcaaacgattctcccacctcagcctcccaagtacctggaactacaggcatgtgctattacacctggctaaattttttattcttgtttttctgtagagatggggtctcgctatgttgcccaggctggtcttgagttcttggccttaagcgatcctcctgccttggcctcccaaagtgctgggattacagatgtgagctaccatgcctggcttatgatattttaaatttagctcatttaatttatcttgaaattattttggtgttttgacttgagttggagatttaaatggatcctttttctagtagttaaatgtattgtctcattgacatttattactttccttcttcattgatgtgcattacttcccttgtaattctgattatctgatgtgttacattgattcttccatgtatattatacattccatgattatgccttgatactattcagaagtatcaatagccaaaataaatgttaaattcttgattaaacaaaatcactttgttttagtctctgtgatgaaattggggcacaatattcaaatatcctcagctccaaaattcctctgttgtgtttaggaccaggtttttcattttcacactgccagacccagaagttgagtgggagacctgtttctttagaaggcaacgtcctgggtcccaggtttctatatgtttactcttcctaattgtacacttccccccaactttctccaaatggtcaaggctgcgtaagtcagtgtagtgtaccattttatgctttcccataatagagggtaaattcagagtatacatacttaaagtattacatagatattaactaatatcataccaattgaaattgtcactatctgtatcctgatacatttaccacaggaatctgtgagtctgcattcagctgacttgtgtgagctaaatgacctgaactgagataggagaaatagtagttatgattcaacaattccagtaaagaaacacattttctagcagagctgtccaacagaggtaggagtagactgagaagtactgagacccttgttgttatctttactcaagcagaactctgtcagcagtgactaggaaagaattcctgctctgaggagtagatgggggaggaatagggggtcagaataaattatttcaattttctgtggttcagctaattgttgctttgacttttggattagttatgatttaatacaaaactttctcttttttttaacaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaattcagtcagaattgtcatatttattgtatgttcctctttagttaggtacggttcctgctattcacctatatggaggatgccccattcttctaggaatgcattctcagggaaccacaggaggtcctgggaatcactatgggcagagaatatgcaaatgagtcaaaactgggataggaagaaaatgttttgtcttaggagatcctgaatgactataaaatgctgttacaaagcagtaaatctgcttctctgaaagatgtttccttccattgttagctctcaaatgctcttttaatagacatgcatgtgtacctgtgtctcagaagtattagggatgcatgagtgaagggttctaatttttaaaatttcatttgaagatcaaattcatgctggtgagaagggtagtaggagcctattaccatagctagagatgatgccacttcagaaaaacaatcttagtcaataaataggaatttttcggtttgcttagattttacctagcagctattatgtcagcaggaccaccaggatatgggaaaacaggactagaagatgtacgacagcaaagacatgcagagacatgcagagacacctggaaggaagctaggtaagctgctattgcggttctgagaaagacccacatccttaagatctcttgattactcttctcccaaaaggcgtgcttaactttaacaggttaccatttttctgatcatagccttaaaaggctgtcctggttttttctttttctttttttttttttgagacagagtcttgctctgtcacccaggctggagtgcagtggcgcgatctcggctcactgcaagctccgcttcccaggttcacgccattctcctgcctcagcctcccaagtagctgggtctacaggtgcccgccaccatgcccagctaagtttttgtatttttagtagagacggggtttcaccatgttagccaggatggtctcgatctcctgacctcatgatccgcctgcctcggcctcccaaagtgctgggattacaggtgtgagccaccatgcctgtcctgtcctggttttttcatcttggcacttaggccatcagcttactagtgtgtaacctcagtttcctcctgatagcacacacttcgtaagatagtcatgagaatcaaaagaaacaatgcatgtaaagcatttctcatcatgcctggcacacagcaaacacccaatacgttgagctttaattattactcttttggctgtaggttgaacaatagggttggtgccctaggacagaggagctattagcattgctttctgatcctttagcctctccaaactgaaacatatggaccatttctcatctggctagtaaacacttatctctcctgggcttatatcttgtttggtatagaaatgagatcccagcttgaaggtgatgttgagaggagaaccaagagtatattgtctgtgggattctggcagattggaaagatgtaagaacttgtgactctttgggagtctgggtaactgttcccactctaggctttgcagatgaatggacctagctgtttagtaatctgtccagcttcctgcatgtctgttctcccctaaccctcccatccctgctgctaaagagacttgacactcacatgctttcttggcccagtcaccctgggaatcttaggaacactaagtcagcactcaatgaaatggcagcaagccatcccagccactgctggctctatgcagacctgcttcaggcctggtaatagggtctctctcttgttcctgaaaccaagcctctttattcctcagctttggtctctgcttccttcctacctgagttccctttcgctcctacctgctcccactaccccatactgatttctacttcttgaatccttactttgtcgggtctcaaacgtcgaatggcgatcctcccatctagttctacactccaaactcattttgcgttctgaagttccttggtgaagataatccccagataaaaagacaaggagacctgggtctgctgggttagggatcaagtgagggtcctatgttgtaagtgagtggtgatctagggaacaaattgccatttcttcttggaattttccagggttttcagggaaggggaagagatgcaaatcccatagtctgagactctctaggctagtgtgtgctgaagaattgctttttttcaaaagggatctcacgcagaaacactattgcatttgcctcaaaagcagaaacatttagtacccccatttagggagatactgtacccgatgttctggtacagcagctggatggtgaagtgtgctgctacacctgaggatggttaccaagtgtgcaggtggacctgaggcttgttaactgtgctgctgagtcagaggatggtgctggtatcagctcctcacttcctgagcttcattccactgaaggcctggcatgtaagacagtgcaaccctaccatgctcctgatctattcctgattgggcaaggaatgcactgggattcatattctcttcaatgagtaatcatcataacaacaaagattcattgagcaatgtcttgcactattataagctctttgtatacattctcatttaatctcctaacactgcgatatatatatgatagcaatcccatttgaacactagaaaactgaggcatagagaggatgaaaaaaaacgtaactaagggtatttcaaccaataaatagtagacagtacccacattcactgttagtcttaaggatctggcatctgggaagaattttgatgtccatggtcgttcctaatccactttcatgttttgtcattatgctgaggaatagcaaataaaagatgagaatttctcaactgtgtctacatgtgaagcatatcgtagacattatgtgcggtataaatactaacaaatgtataagtacacatgtacaatattgtgtattatttaaggatatacatattaaagtgtaaaatattggcagctggattcattgcaataatgtgtagagaatcaacttcaggagggggcaataattaaattagggggaccagttgggaaggtactgcattattctaggcaagagataattgtgacttggatcaaggtgatagcggcagaggcgtcagaaagtagttggatcttgggtatattttaaagatgaagcaacaagatttactgacagaactggatatggagtatgagaaacagtagtcaatgatggccacaaggtttttggcttgaactaccgaaaagattgagttgccatcaactgagatgagagcaatctgtgaatggaacatctgctgggaggaaggatcaggaattccgtcttatggaatacacaatgcatctcaacatgtacaatatatacaagatataccacacatctcagcatatgttgagatggttgttaaatatccaagtgcaggtgttaagtaggtgtgaatatgagttgggagttgagaagtatagattgggctagaattatagaatttggagtcattggcgtatagcagtacttgtttatgctatctttatatttaagagaataaacctatcacttgctaaataagattatcatagtgtacttgcggtttttttgtttgtttgtttgtttttttgagacggagtctcactctgtcacccaggctggagtgcagtggcacaatctcagctcactgcaacctctgcttcctgggttcaagcaattcacctgcctcagcctcccgaatagctgggactacaggggcccaccaccacaccctgctaattattttctatttttagtagagacagggtttcaccgtgttagccaggatggtctcaatttcctgacctcatgattcgcctgcctcggcctcccaaagtgctgggattacaggcatgagccaccgcgcccagcctgtacttgcctttttattttgattgttatctgagtttttccttctgtttttctttgtgattttccttctgtttttctcctattgtttttctttgtgatttcatttattgtaattcagaatttactgcttattcagaaagcagttaatgattcacctatattttctcttggtttgattccatgattttctatcattaacagtttgttgacagaccaaaaaacatcctattcatctctttgggcaaacctgggctttattctcccatctcacagtttatttaataaattaaaaaaggaaagaaaagagaaagaagggggacagagaatctggctagttagcctcaaggcaaaatgcaaaatagaataaagagagactactcaggaaaatattttatttaaatcttgaagaacaaaggttagtttttataatctgcttttatgggtcagatggagatggagtggttactgttgccaagaacttcagagccaagtttgaaatttaatcacagcaactgtgttaaccagtattgatggaatgtttagtatatttgatcctgattttctacttatgtttatgttttcatgattcattgtatgtgtcttttgttgcaaaatacctcaaatcctttatggaaagagttaaagtatattcaaagctccaaagaataaattactcctaaagaataaatatactccttggggagtggaatagtttgcagtttctcttcaggagacaatgaaactatttattaattccttttacaagtgcccctaagcctgagtcctcagagagtcgacttcttctctttgtttatcttgaaatgtttcagtgtgcagaaatgcctgtagaatcatatctcaaataaatgccctatatctaccaccaagcataacatcttaatatttttccacactcgcttcagattttataaatcaaacattgcaagtagacatggagcccctatgcaccttctttccctccctccaggtaaccactatcctgaattttatgcttattcattcatgttcttcttttttttttttttttttttttgagacggagtctccctctatcgccaggctggagtacagtggcgcaatcttggctcactgaaatctctgcctcctgggttcaagcgattctcctgcctcagcctcctgagtagctgggattacaggcgtgcaccaccacgcctagctaatttttgtatttttagtagagacggggtttcaccatgttagccaggatggtctcaatctcctaacctcgtgatccgcctgcctctgcctcctaaagtgctgggattacaggcatgagccaccacacctgacctcattcatattttctggctgttcctatttatgcataaatgcatagggagcttattgaattaagtttttatattttctaattttatataaatggggccatgcaatatgtattcttctgcattttttcactcaatattatgttcctgaggattatattcattgatgggagtagttccacttctttcatttttgctgctatttgatattgggttgtacagcccatgagtgatttatgtaactgttttcctgttggtgggcatcaggagttttctagtttaaaactagtacagacaatgctgcattgaatatgcctgttcacatgtgtgctttaggagtacacagtaactgtggaattgctgagtcatatggacacattcaactgcattaaatattgtcaaattgctttctagagtgattcgtatcagtttacactcccacaagtagagaatacaacttccagttgttccatatattcactaacaattaggactttcattttttacaatctaatgtgttagtgaacctgtgtgtgtgtgggggggggggcgtacgtgaaagtggctttttgtgtagagaagagatctttcaaggatttttttaaaagacaaagtttacatatggtgaaatgcacataagtgtataatttgatgaattttgaaaatatcaacatcccaattaagaattccaacattttaatcacttcagaaaagttttcttagtcaatccctggccatcccctacaagcaagtattgctctaatttctttcaccattgattagttttgtctgttctggaactttctgtaaatggaagcatacaataggtattcttttgtgtctgacttgttttacccaacataatgtttttgagaatcattcatattgtttcatgtatcaataattttttatttcttagtataaaggtatcatggttttcttatccattctattgagttgtttccaatttggggctcttgtgaatgaagacatgtttgtacaaatccttttgtgcagtggagctgttgagtcagaatagttgtaagtttaacttcataagaaactgccattaatttttttaaatagtggttgtacaattttacactccttccagcaatgtatatagagttctggtagctccacatatgtgccaacatctgttgttttgaactttttaaattttcagctattccagtgtggccttttcaggttgttgctttaattttattttccttggtgtctaatgatgttgatcacatttttatgcatgttttggtcatttttatatcttcttttatgaagtaaatattcaggtctgttgcctacttttctaacttgaattgtctttttattatttatatgtgtaagttcttgatacatactagatacaacgcttttgttttgaattatgagaaagtccagttcatcaattttctatgtcaagtgccttttataatctctctaaaacagttttcctgccccaagtttgcgaagacattctcttctactttcatctagaagctttatagttattacattcatgaccataattattcttgaattaatttttgtgaaaggtttgaggtagagatacaatttcattttcttttttctctatagaaacccagcattccagcaaaatttggtgcaaaaagtgttcttttgcccattgaattgctttggcaatttatttttggaaaattaattgaccaatatatgtgcaggtctctttctagacttactattctatttcatttatttattttttctatttttacaccaattttactccacagttttgattgctgtagctctatgtaagtcttggagacaggtaatataacccctcaaattttgttgttttacaaaattgctttaattgtttcagtgagtctaggtctttgcatttccatataaattttagaatcagcttggcaatttattttaaaaatgacttttaggatttttagtgggattatatcaaatttatagatgaattggagaggatcttccaatccatgaacatgggataactcttcatttatttagatcatttttaaagcaaaatttagtagatttcagtttaaattttattctgaagtagatttattcctaagcattttatattttttgctattttaaagttattttaaattttcattcccaagttttttttgcaaatacatagtaatacagttgacttttatatatagttgatcctcattatttgcagattttgtataatttgcctactcactaaaattcatttgtagtccccacattcatttgtggatatatacaaagtgatgacaaatttgagcccccaatgcacatgttcccagctgaggttaagcaaggcaatactctcccttcttgtttcagttatcagaaagtaaacaagtatccttttcacagtatatttaatgccatgtttattgcatttttgtgctttttgttgatgactttgctctttacaatgccccccaggggtcggcctgaagtgctctctaatgctcctgagcacaagaaggtggtgatgtgcctgacatcgcagataaatgacatgtgttagataagctttgttgaggcatcagttacagtgctgttggccatgagtttgatgttgataaatcaattatatatatatatatatatatttaacgatgccatttaacagaaacacacatataacagggttaagtattaattgactaaaaatattgtcccagagtctcacaggaacctaaacctgcatttcccattggagcaaatgttcagtagtattcactaatttcatgtttaggacaactttatagaccatattcaccataaataatgagaatttactatattgactttgtattctgtaaacttgcaatattaattgcttaggattttccacacagacaaaatcattttttctgcaaataaaaatggtgttgcatcttccttaccagtctttacacattttgtttctttttcttgcctcattgcacaggctaggactgccagttcaatgtcttaaaaaaaaaagtggtaagagtggtcattattgtcctttctctctttccctaatcttagagtaaacatgttcaatcataagtttacttgtaggttttaatttttcttttctttctttcttttctttctttttttttttttttttttttttttgacagggtctcactctgttgctctagctggagtacagtagtgcaatcatggctcactctaaagcctctgtctcctgggctcaagggatcctcccacctcagcctcccaagtagtagggacaacaggcacaaccaccatgtccagctaatttttgtatttttagtagagatggggtttcaccatgttgcccaggctggtcttgaactcctgggctcaagcagtccactcatctcagcctcccaaagtgctgggattacaggcatgagccaccatactcagccagctgtaggtttttcacagatagcctttatcaggctgagaaagtttcctattattcctactttgctgataattttttatcatgaaagaatactgacttttgtcagatatttttctacatctattgaaataatcatatagtccttctcccttattcttatgttattgattacattgattgattttcaaatgttaaaccaaccttgcattactaggataatgtaattatatattaacctttaacatatttctgagtattatttgctaatatttgtttaaaagtgtttgtgtttatgtttattagtgatattggtctgtaaaaattttctattgtgcctttgtgttgtctcctattctgttttctaaaagaaaagtggaaaagccatattctttgaaatacatcctaaactttcttgtgatttcttccctaactcagaggttatttataggcatattgttcagtttccaagcatttggccccattatgtaagtaataaaccattttgtggcttatttggtgtatgtgtttgtgtggtgtcatcagtattaacatctgaaccaaagtttgactgaggggcctgtctcattcccaaaaggtgaccataacatgtgtatatattaattaggtcaaaattcttaagtatagtgttcaaatcatctgtcttcttttctggttgttcttatcaattattgaaagactaaaatctccactgagactggattcgtctgtttctcctactactctattattttttgctttatgcatttattaagggcatgttattaggtacatacaaatttaaaactgacatatcttcctgttgaactgatgtttttgacattgtgaaatgagtcttctatctctaaaaattctttttgccttaaattctaatttgttcaatattaacataggtataccagctttttaaaattaatatttgaatgagatatttttgcatgatttaatttccacctttctatatgcttatgttgtagttatgtttcttttaaataatatataatttaaatttatagttgtatccagttcaacaatctagccttttaaaagatgaagttagtttttttagaacaaaatcaaccaagtttaaattaaacattttgatatgtgtttttacttgtgccacctattccatgttttgttttacttcttttttcccttcaattactttttttaaattactgggtattttttaaccatgttttccctctatgaatttagaagttatacactcagtttctaattttgtaaatgatttccctagaacttatatcatagatctttaccttctcattgattaacattggtttctaatgttaatatctttatcatccttctggaaaatacaaggaccttggaacactgtaactcaaattacttcccctctttttttttttaatacggcattttttctttttatttttagttgatacataataatcatacatatttatgggctattgagtgaatttctatgcgtgtatacaatgtgtaatgatcaaatcaggataaatagcattccatcacctcaacatttatcatttctttgtgttgtgagcattcaaaattctctcttttagccttttgaaaatatacaataaattatcattaaccatgtttaccctatagtgctgtagaacaccagaacttactccttccatctacctgtaattttgtatttgttaacaaacctctccccatgctccccccactactacccttcctagcctccaatacccacaattctactcgtgacttccatgagctaaaaaaaagtttagctcccacatctgattaagaacatgcagcatttatctttctgtggctaacttattttgcttaacataatgtgctccaggctcatccttgttgctgtgaatgacaggatttcattcttttttatggctgaataatatttcaatgtatatatatatcacattttctttattcatttgtctgttggtggacatttaggttgattccatatcttagctattgtgaatagtgctgcaataaacaaggatacaggtattggtattcctttgatacactgattttctcttttttggataaaaatccagcagtggggtcattggatcatgtggtagatctatctttagttttttgagacatccccacagtgttttccataatggctgtactaatttaaattcccaccaacaatgtataacagttcccttttctctgcatcctcaccagcatttgtgtgtgtgtgtgtgtgtgtgtgtgtgtgtgtttgataatagccattctaattgaggtgagatgatactcattgtggttttgatttgcatttccctgatgactagaggcggttgaacattttaaaatacttttttggacatttgtatgtcttcttttgagaaacatctatttatttcctttgcccactttttaattggattttttttcctgttgagtggtctgagttcctttcatgttctgaatattagtcacttgttggatgaatagtttgcaagtgttttcttcctttctacagttgtctcttccctctgttgtttcctttgttgtatggaagatttttagttcatataatactatttgtcaatttttgctcttgttgtttatgtttttgaggtcttatacataaaattttttccaagatcaatgtcgtgaggcacttctcttatgtttgctcccagtagatttatagttttttgtttcatgtttaagtctttaatccattttatgttgatttttatatttggtgataggtagggagtctaattttattcttctgcatatggctatttagttctcccagcactgttattgaagagggtgtcctttcctcaatgtatgtttttggtgcctttgtcaaaaatcagttggctgtaaatatgtgaatttatttctgggttctctattctgttccattggttaatatgtttgtttttataccagtatcatgctgatttggttactatagctttgtagtataatttgaagtaaagtagtgtaatgcctccagttttgttctttttgatcagtattgctttggctatttggtgtcttttataatgtcatatgaattttaggattttttttctatttatgtaaataatgtcattggtatttcgatagggattgcaatgaatctgtagaatgctttgggcagtgtgatcattttaacaatattaattgttccaatccatgagcatgggatgtctttttatttgtttgtttcctcttcaaatattttcatcagtgttttacacttttccttgtagagttttttcacctctttggttaaatgtattcctaggtattttattttttcatagctatgataaatgggatttttttcacttggtgcatagaaacactagatttctttttcagctagttcattattggtgtatagaaacagtgattttggcatgttgatgttgtatcctgtatcttcactaaatttatttatcagttctaagagtgttttgatggcgtcttcaggttttgctatatataggattatgtcatctggctgggcacaatggctcacacctgtaatcctagtgctttgggaggctgagacaagaggatcacttgaggccaggaattcgagaccagcctaggcaacatagcaagaccccatctcgacaaaaaacaattgttttaattagccaagtgtggtggcatggcatctacagtcccagccacttgggaggattgctcaagcccaggagttcaaggctacagtgagctatgattttgccactacattcggtgagctatgattgtgccactgcacagcctgggcgacagagttaagagcctgcctctaaaaaaattaaaaataaacataaataaataaatattatgataaattgacttcctcttttccaatttggatgcccttatttctttatcttgcttaattgctctgggtagggcttccagcactatgttgaataagagtggtaagagtgggcatctttgtcttgttccaactcttagaggaaaggatttcagcttttccccattcagtatgatgttagctgtgggtttgtcatatatggcctttattgtgtcgagttttgttccttctaagcctagtttgttgaaacgttttatcatgaagcaatgttgaattttatcaaatgctttttctgtgtctattgaggtgatcatatggtttttatgcttcattctattcatatggtgtatcacatttatttgtgtatgttgaacctatgtggcatttttttaagttgctgtccacaagtttattgtctttatctgaaaaatcctcatagaaaattgtttggtttagctctcagcagcccactcctgagctctgaggaagcttgccttcttctgagttacccgatctttcttctgagcaagggacattttgggacagtgccacctcttctttttaactttttttcttgggcttcttttcatagactggattctcttgtatagcagcatgagctttctaacacatctcctccatcatgtctggagttatgctgttctttatgtattgagagaactgtttcttgtaagcatcttcatcttcttgcattaagtagcacgtataatctgcaacattctggcccatgatgtgcttccagtgtacttctgcattaaattccttgctttcagaatcataaccagggaatcgtttggtaccatgagggatagacaagcctccatccacagcccccttcagggcaccaaaaactttattgccactggtagttctggcaaggcctgcatccaaatagcacgtaaaggcacctggctgaccattaatgctttccacattgtattcatcgccagtcacctccacttgggcttcatagatcttgtccatgccaaacatattgaaaagcctgcgggccagcagcaggccagtacaatatgctgcagcataatttgacaagccaaccttcacaccatattttggcagttcgtgtgcatatgctggccagagtatcataccccctctatacaggcgtaagcaatctgacaaatgatatctctgtttgttacatgaactatcatcctatatttgagtgtattgtatttatttttatcctgtatcaccaagcgtttccaaacttagtaatcagttttaccctctcattgtcttctaaatttcacttggtatctcttaaagtaggccttattcttaacaactttaacaaaccacatcctggggaacaaaagacccgcgtccgcggctcaacagagacctgcaggcccagcagtgctagggggcggaaaggctacatggcattattaatgtgtattttaatccaatatatttcaatcccattggatattgttgtttttttaaagtcagtaatcatttagagctcctcatatattcaccacttattttgctcttcattccttcttataactcggaacttccttctggaatcactcttttatagtctaaatattatatagcctttagaaatttttagtgctgtccttgtgatggagaactcactcaggttttttttatttatttattttttttgtgagacaaagtctcactctgttgccaaactggagtgcagtggcgcgatctcagctcactgcaacctccccttcccaggttcaagcgattctcctacctcagcctcctgagtagctgggactacacccatggtgtgcaccatcatgcctggctaaagttttttgtatttttagtagagatgggtttcactatgttagctaggctgatcttggactcctgacctcgtgatctgcccaccttggcctcccaaagtgctgacattacaggcatgagccaccgtgcccagccaggttttttaaatctgaaagtatctttatttcaccttcatttaaaaaaaaagtgtcattaaaatataacaatcatatagtaaagtctactgtggggtaactactagtatgggaccatcttaaacccaagttcagggcttgaaatttaattttatggctgttggattcttatttctgtttccatctctctgtgatattatcaaaacaaaagtcctagttttccaggattggcaagcatcagaggatcaatgtggcttccgtgctcttttacctttctggattcacatttttactttactttgactttataattccttacagtcatgttttgtcttcgatgctttttaaatgttttaatatattttatctagttgtttaaaatttttatccagtgggatagttaattcaaataacatagtcctccattactaagagcagaaagtccccatgttgaatttttaattttttgctattataattttaatttttaagagctggtttttgtttgttttttgttttctgaatgcacttcttaattaatatcctgagcttctttcacagagtttatttgtaatttcccttttacctacatgtctcatcctccagtctgtaagttccctgaccatgtctgtctccttccttcaaggctgtatctccaacacttagaaaaatatctggatgaggccaggcacggtggctcacgcccataatcccagcactttgggaggctgaggtgggcagatcacttgaggccagaagtttgagactagcctggccaaaatagtgaaaccccgtctctactaaaaatacaaaaattagctgggaatggtggtgcgtgcctgtaatcccaactactcagtaggctgaggcacaagaattgcttgaatgtgaaaggtggaggctgcagtgagctgagattgtgccaccgcactccagcatgggtgacagagtgaaattctgtctcccctccccaccccccaaaataaaaatatctggatgagtaataaagctttatcttgggttttgcctagacaaattagtctcattaaagctggattcctatttcagagacggttctcaacttctgacttttaacatcctacatcctgcagttttgagtcctatgcacctcccagatgtgaagttcaggcttttataagccagccatcaaagaacattatgagctaccccatcgtggctctgcatagcagccaactgttcagtcttgtaagcatcatcatgtgtgcacagcacagagagtagaaaaaaagtaaatctgataaaaaataaaactcagttaaaaaaaaagaaaagaagtgaaacttcacaagtactacaatagagtaaaagataggtatcattaagcatcatggaagtgccataaagagcaagaaaagaacaaaatgtaaagaacatgtacaaaatgctggaaatatattatcaaagatggaatccaaaaggcaggacatgttactatggatttttttattttttattttttattttttggctctctgggaatgaaagtcttccataacacataaattttcctcttgaacttttggattcttagcagatatacaggaactcattgtgcagtaaaagataggaccacctatactaaataatgtgtgaggctcatgaagagtctacattagcaatgcaggtgaagtttaatagtgatcaggtgtctgtcttgagaactgatgttgaccatggtgacagtaggacatgtggtctgagaggaaaacttagatgcatctgtacctgtcacaagcgggggatcatacaggtgtttttaaaactcgcaagacaccttgtaagcaaagacctactgtcattatcctgggaaacatttcttaaagaatggcctgagtaatatgctagttacactgtatacatgtttcaatgcatgtattcaaatgtaacactagaccccataaatatgtgcaattattatatgtcaattaaaaataataaaactcatcttttaaaaaagaatggccttgggacacctacctcagaaccacttgtgggaatcttacagtttggttgcctgcctccattccatttcctcagacccaatctctgtgggtgggtcccagcatttttaataggctcccagatgagtcttctgcataccaagttgtgggtccaatgcttaggaagatgctgacactagacccattacccctttgtcctctccctgaaatctggaaaggagtccactttagacttaccaccatgagagtcaagagccccagtgatacaagtctcaattaacaaaattaacaatttgcaacaacagaatcagaagaagaatccaaagaaattttgcaatcagctttgaaaatgctaactttacacatttttaaatgtacaaagcctgtgccgttcttcccaagccaacattggagtagcagatttgggaagtcattcttccaacacttttttgtgaatcgctagtcatgtgtccagctgaacatgaactggtgtatgggaagagaaggtggccagtagccaagcatttcataagactgtgatgcagaccgaaggctttaagtattagtaagattcatgtttctgacttccaccctgtggaatagactgctgacagtgatgaacatggtgacatgataggactcatcaaccatgtgtgcggcaagcaagacctttgactttcagctaatcccagctaatcccagcacgaaatgtaaaaatgcacaggtcattggcaccatggttggtgggaagtgaggtgtagtagctgaacttacaaagcctgttactctacaatgacctatgagatggacttgaagatgctgcagccaaacatgagcctgatgattgatacccagcagagccaagcaaaagagaaaacggaaatatgtccctaatcccacagagctcagaccttaatttgtctatgtcatacataatggatttgagttcagctaaacccattcaaatccagctggttgtttcagtcagtgaatttacagcttgtatttatggtccaaaacagaaactatatgagcatatttctctctttttttatcttctttctgtccacttttcttcctttactctctccacattgttttttcatatcttctcatatcttgctgcaaatcctctctcaacgtcaatcattttctccaaatctgtcatctcttcctttgtcttttgtcccaaatctctctgtagccctcttgctatcttctcttccatcccctcagtgcttgctctcccacacatttctcatcatgaaaacacaactccctccctctcattccattattctctggatgtctttgttttgtccctttgtgtctgggtgtctccagatttcagtctttctttgtgtcctcatcttccaagaccttcatggcctttaaaaaaaatccctgtattaatctcagtctctacaaagttatttccagtggtattatgtggcaaggcatgtgagctattctgacaaggaacagctaaggccctatggcaaggagaagagaggaacgtgctatatccagcttatctcatgctatcctgcagccctcaaggcagagacagtgcttggactgtattagggccatatatgtttattgaactggctgctgttactatggagaaagtcttagtatcaggtaataccatttactgtaagaaaagtagggttcagcaatataacattgatatggctttgtgtccccacccaaatcttgaattgcaatccccgtaattcccacatgtcaagggagagacctagtgggaggtgattggatcatgggggcagtgtcccccatactgttgttgtaatagtgagtgagttctcatgagatctgatggttttataagagtccgacagttcctccacactctctctctcacccactgccatgtaagacgtgcctctttcccttccgccatgattataagtttcccggggcttccccagccacgtggaactaggagtcaattaaacctcttctctttataaattacccagtcttgggcagttctttatagcagtgtgagaatggactaatacatacatctttaaatttgaaaaatctttggaaaccatgatttattttttaaagtcccattttcaagtgcaagtaggtcaacagctttggcaggacttttgcctatctccttttttatgcatccacccataactactattctaatactattgtcaagtaacagaaaccagaactctacagaggacagatgactctttgttcagggaaatttaaaaaaaatcagaatgagcctggaatatcctgttattaccagaaagtaaaaatcttatttttaaaatgttaggagcaacatcaaaaagccaaagatccaatttaaggtttccgcggaccaagctgtgataattttagcgtgaaatattattattatggttatttggaacatgttaagtctataaaaagtccatggattcataattatactcaacaattaacataattagtacaaaaatatggttgtaataaaaaataggtaaccaattatgaatatgtttttgataatggattttaacaagtgaacattgtttatatatggtgattttatttatcctattgaattactttcttataaaagatataaatatatatgcacatatttatttctgaggaaaaaataaaattatggaaccaagtaacctccttcaagaagagggaagactggattggtcggtactgggattaacatataataatttaagtgaacaaaaaatccaatatttaatcaagattaatgatcacacaaaattaccaagtagaagaaagatccaacagggttgtcttagtgcatttgggctgctatagcaaaatgccatagattgtgtggcttataaacaacaaatactgatttctcaaagttccagagactgggaagacgaagatcaaggtgcaagcagatttggtgtctgatgagggcctgtttctcttagatggcaccttcttgctgtgtcctcacatcgtgctggggatgaacaagcctctgggtttgctttcacatgggcactaatcccattcatgagaacagttataatttaatcaccccccaaaggcccctacctcctaatctcatcatattgggattaggatctcagcatatatatctggggggaacacagacattttatccatagccagggtcttccaaacagaggaattagtcaaatgtcccagagagaaagagtatactacacacatgcaacatctcatctcacaggaaatgaaaccactagatggccctgctcattttaataaaacatcaataaggaatatgtaactctttaaaaaggtagccgaccaagtcaatatatcatactgataggaccttgggttttgtaactttggctaagtgagattttaaaagtacatcatttcctgaaagacaccaggttgtaaaaaaaataaaacctaagtgaaggtgtgactttaaaaatcgtgttgtagtaacaccaggagttaactcagcctgatgatgagtcctgaggccagaccaaaaatggatcagccagtactccagatcctgcagccttggctgggccaagcacgtatactttttctttcgggtctagtaatattactccacccctgggaagaaataaaaatatattactgaaaccctaggaagatattaaaataagtatactaatatcccccaggaaggtataaaacaagcacataaattgtcaaagaaatgaataagtccattgttctgagactttagaataggttcaagtgtaagtataatattaataataagctttgtagtcattgcatttgtgaaagttttatgatatttgaagtgttggggaaaaaatcggccatagtgaatttataattgcattttaaatgatttaagataatgcaatcaaattatagtcatcttaaatcatcaagataacttctttttaaaatttgtatttattaggtaaatgggttcaataatttgagcattaaacaaaatataggtttttagttcctgaacaagaaaattaagaaacctgggctataaggtccctttcccaaaattgacccagtagaaattacagacaatgattgaaaacctttgttgcccattagaatcacccaagaagctttgaaatctattgctaatctggggccctccttggaccaattgtatcagaatctccagaagcagaatctggacaatggcattttaaaaatacctttgaagtccttctaataggcagccagggttgagaaactgaaagtgggaaagaagccatggtctgaggaattaacataaaaactctgagaaggccagaggagaccaaagacagttgtgagctggtttagaagctcatagcagtctgggattgggacacagtggggcagtaggtgcaacgtggtgggtaaattttgcttttaactgtcccctacattgctttggcaggatcacttttctggcctcatcacttctgcagaacagaaattagcaagagcagcccagatgccaggggtgtgtgtgtgtgtgtgtgtgtgtgtgtgtgtgtgtgtgtgtgtgtgtgttggaaggtgggacagaaaggttggggaggtggggagaatatcattgcaacctcaagatcctgccaggttgagaatctggtgagaatacatgttatgatgactagttgccctaaggcatttatttcttcattccctttctctccaggccctcaacaaattggattgcaacctaatatttaaggaagagtccctgaaggaggagacgcctggtgcagacactgggaatgaagttggtctgcaggttctgtggtgtgtggtgcttgaactcgtggagactttccccacctttctgcataaatagttctaaagatctacattgtacagactatgttctcttaccacagtgcaattttgttagaaataaattacaaaagaataattgctgggagagaatgctgcatggatttctcatgtttctgtatgtcttttgagcagaggcattgttagcttttgttctggcctgtattttcaaggatgtttatatagcaaacagccttggaaaataaaaatagtatctcccttcatggcagagggcaggtttatttgctgtccagtaaaatgaagataatatctcccactggggcagaagttgggtgggttggctcacagcctccttattggagtttcctaaactcagggttcctcagctgtgacttaaccccacctccagcatcctcctggacccaggtatgtatcactcttgtggggcttgtgaagcaaggggaactaatgagaaatgaagtaattaagttctttgtctctgatccaggagtctcatgtcttctgccagcatttttgaaactgtgactggctggtttgttaacttgcaagtaagatcaaatttaatactcttcacagttcttcgtaataggtttttaaaaattccataaatctggatattaaatagcataaaactaaataatcattagattaaaaagaaactcacaaaaatattaaacagaataaactgaaagcatttaagccaaaatttatgaacatagctaaagtaatagagggaaatttataaatctaaataaatttatcacgaataaataacgattgaaaactaatgagccaaatgtttaattcaagaagaagaagaaaaattagaacaaactaaagatactagaaatagggaaatattaagggcaggaaccaaagtaaagaacatgaaaaacagtaatactgaagtggcgtcatttggggaaatacccgaggttcgttgtcttgggctaaggaaatcgaagatgtggacacacaaggtgtgagtttaaaagcaaaagtttaataggtgaaagaaaggagagagagcttccttttgcagaggaaggggcccgagcgggtttctgggagatgtggttggttttatagacgaacttgaggaggcagtgtctgatttacatagggcgtagtggattggttggaccaggtgtgccatttacatggcctgtgaagagctggcaggcccaccctaattttttattatgcaaatgaggtctttacctggccagcgccatgttacctgaacacgtggttacaaagaaaagggaagaggaaacctccatgttgaatacacttggtgtccaggtattccttttctattggcacaactgctggcatttacctatacaagtttccagcttgcttatctatgcttgcagcttgatttttctggctgctttttgttagaaaagaaattagttttgaaaaggaaaaccttaccgagaacgaaacaacaaaatttaaaattgcttctttaaaaagataaacaagatggtcttctggaaagactcttcaagataaaggaaagatgatataaataaacaaaacagaattataaatggggaaataatagcagatgcataagaatttttttaaaataaaagaatattgtgaataactatattttaatatattttaaatcttagattgattttgttctacaagtatttaaattactcaacaacaggtaaagcttgggcactgactaatcaagatggacacctgacccaccagaaaggatgccatactagtatgtacaagctctgtatttctgggatcaaaattaaattcccaattggcccaagaagaaatacaaacatcaactagaacagcaagcattcaaaaagtgaaatggtaatcaaagctctcctgttcccaaaacctgtaacccagaaagttttccatgtggaagttttccaggtgaaagctttacaaactcaatgggattaaaatcaattagttttagagaaaggtgtaaaaaaaaatcttacatattaaaatagtctctgccctttaaagggtcatggtacacagatatagtatgtctgtggtattaaattttatggtggaagattagaaaaaaatatgtctaaaaaggccctgggggagggagagagtataatgaaaaaagaatggttaagaaacatttcctaatcttattcaagaaaatggaaaaagagaaaaaacttcccagctcattttagcattttaagaattttctaatctaaaactggataagaacacacacacacatacacgtatcatatacttatatacacatatgtatgtatttatattcaaaagtaaaatgtgctcctctacatatataagtcatggtcagttataaaaatgaattgaaaaatcccccttattaactcaaggagttcaataaagtattaaaactatatcatggaaccagatttactctcttgccttaatgagaaaaactggaaaaacatgtggaacaactgttttaaaatattggacaatagggatattaggactgtaatgcaagaaagaaaggaagcaaatgaggtaagtccaatattctctgtgcctttctaccccgaggtacactctgtaaagcagagtgagtaggatgatcccaagcaaaacacagtggtctctctgcattgaggagcagagatttgagttcaaagagtctgaggtagctagaagctgtaaagcagaatttcagagaagagagaattacgtaaaaaacagctccagactttttttaatactaagatatataggcatagagtgaaactcttcaagaaatacatgcacacacacaaacacacacattttagtgtatacatgtgtatatacataatattatttaaatgtagattgtgataattagagctttttgcaattaaccctaagacaactattaaatatgaaacagagttataactagtagtcccccaaaggaggaaaaaaagattttaaaatatttaattaattcaaaagaagtcaataaaatggaaaaagctttacatataatagattgaataagtagaaatcaaacagtaaagtataaacatagaaccaattgcattaaaggtaaatggtataaacgccaaattaaaaggcagagatggtcagactggataataaaacaacatctaactatatcctgcatacaaacaatccgctttaaatgtaaagacataatagatcaatagcaaaagaatgaaaaaatacatcaagataattctgatcaaaacaaagttggagtatctatactaataccagacaaagtagatttcaggacaaataatattagcagagataaagagggccatttcaaaatgatgaaggggtcatttatgtctcaaaggacataacaattcttaattttttgcaccaagtaacagaagatcaaaatatatgaagtaaaaactgattgaacttgaaagaagaaataggcaaatttacaattagagtcagagatttcagaatcttctttcagcaattgatagcacaagtagaatatcagtaaggacatagaagacttgaaagacacaataaatatcataaaccaaacaatctttctgtttatattcatagagtattccactcaacaaccacataatacacattcttttcaggtgcgtaagaaatatgtattaaggtagacaatattctatgatacaaaacaagccttaataaattgaaaacaattcaactcaaagtatgttttctgactataatgaaattaaattaaaaaaccacacacacacacacacacacacacaataagatagctgagcatagtggtgcatgcctgtaatcctagcactttgggaggccaaggcaggtggatcacttaagcccaggagtttgaaaccagcctggacaacgtgacaaaactccgtgtctacaaagaatacaaaaattagctgggcatggtggtgcacacctgtggtctcagctactcgagaggctgaggtggaaggatctcttgagctcaggaggtcgaggttgcagtgagctgaaattgcgccactgcactccagcccgggcaagagagtgagaccatgtctcaaacaaagcaacaacaacaacaacaaaacagtaagataaagatacctggaaaatccccaaatatttggaaagtaacacacataaaattagaatgcattttgaaattaaacatattataccaaataacagtctcaaattaataacctctgcttccaccttaagtagaaaaagaagagcaagttaaatctcaaaaccagagagaaaaccaatgaaaccaaacactagttttttaaaaaattaataaaattgataaatctctagtcagattgattaaaacaaaaggagataaaacataatttaccaatatcaagaaataggaggtgacatgattagtttctacaggcactaaaaggataagggaatactataaataattatacacatatgaatttaacaacctagacaaaatataccaattgcttgaaagatactactaaagttcattcaagaagaaatatataatccaagtagccctatagccattagaggaactgaatttttacttagaacccttcccacaaagaggctgagtatggtggctcatgcctgtaatcccagcactttgggaggccaatgtgagaggattgcttgagtccaggagtttcagacaaacctaagcaaaatagcaagaccctgtctctacaaaaataaaaataaaaattagccaggcatggtggtgtgtgcctataatcccagctactgggagggctgaggtgagaggatcacttgagcccaagaggtcaagcctttggtgagctatgattgcaccactacactccagcctgggtgacagagcaagactctatcttaaaattaaaaaaacaaaaaatccttcccagaaagaaaactccaggctcagatggcatcactagtaaattctatcaaatatttcagaaagaaataatattaattctacacaaactcttccagaaaattgaagaggagaaaatacttcctaactcatgctttaagttcaatgctagtctaataccaataccaaacatgttataagaaagaaaatttcagtccaaaatctctcatgaacattgctacagtttgaatgtgtcccccaaaagttcatgtgttagaaacttaatccccagtgcaacggtgttgggaggtggggcttattaagaggggattggatcatgagggtgaagccctcatgaatggattaatgtagttattatgggtaagttatcacaagagtgggcagatataaaagtgggtccagcacctggtgcctctgtctgtctcacatgctctcttgcccttctgccaagttatgatgcagcaagaaggccctcaccagatgtgggtagcatgctatagaacttcccagcctccagaactgtgagcgaaataagcctcttttctttataaattatccagtctatgatattctgttatagcaacacaaaacagaccaagacaaatgctccgcagtgagcaggtataagtaaacctgcccgcaaaggctgagggagatgagaggctgaataaaacagctgaaaaatccagtttcttaaaaagaaatatttaataggagcttatgaacaggagagatgtcttgggtggccattaggcagtggatctctgcactcaccttttagaaaatatctgttatattacaagttttttggtaaaatatgtggtagctagtcacatctgtgtttcttgttaaactcaagactactggggaggttagataagcatctttatgaggggttatctaagctatgagcattgtttaaagaccttgctgcagaccaccttggcatgcaagagtcaaacaacagtcatcatgggagtttcaattcaagatggcgccactcttgccatgtaattggctattttcctacgacaagcatagacacaaaacttcttagcagtattttagtgaatcaaatccaatgatacataagaagacaataggtcacgaccaagtggatttcatcccaggaatgtaaagttggcctaacatttgaaagatcaatcaatgtaactcaccatggtaagaactagaaaataaacattaaattatctgaataaatacagaaaagatacttgtgccacccttcccagcttcccctgtgtcccacacacatgggaagaatatcagggaacagaatctataagagccttgggagggacaagaatcattcctccatgtagacacccaggttgcttctgggcttgtgcttctggactggctctaccatcactgcgtggacagggagggcttcctattgccttgataggaacatcccaggcctgctctgtgtgatgggccacttgcagcctggtccatcagttttatcccccatttaaggctactggtttcctcaactgagctgagacaataggatttccggtggccagatacttcagccaaccctcactgccctggttaatgagactgacaccacccccgccccccgaccaccagtatcaaagagctgcctctcaccctgatggtggttaagtgttcattttagggctctgcactggcaggtgaagagtgttgaccattcaaccatgcacccttgtcaatccattcaatccatgccatcctggattgattacaaaagtgagtttatgttttattttctatgtattctgcctaatgccaatagcttcttgcttttactctcaaatcacccataatttttcacagaataatctccatattttaccatttccacagcaccctctagccaaagtttattgttaacatggctcttccgtgagaagaaggagcctgctggtaagattacctgaaaaggactgccgtgttgcatcagtggaagcacttttcgactttatacaggtaattcttggctaaaataaaatgatattaaaaaaaaagaaaaatacatagtacacttgttgctctcccctgcttagccctaatgcaggcattcctaatccatagccctgtacctttcctctgactcacggcttcacaacccttctcagtaccgtaccccagacaggtaccaccaatcagagttgatgtgaaacctgtttgcctttcctgatcttacccattggctctgcaaacgggttttgattttgcttttctagctctgaactttgtgccttttccaaagtgattctagggatcagccttccagtttcctacacaacagcctaaggcatctacaactcccaaaccagtccatgcctcattgccatggagcctgcttcggccacatgcagtgcctgctcaacagaggcagggatgtgcatagctgttgtgtgcaggagctgatttattaagaagtccaactggccagagcccccaagagaaactctctttgggaacagtgggtgctgttgactgcttgcacgtgtcattgcttcagaggtctttagtcttttctgtctgaacaccctcaaagtggggaagtgacctctgatcattggatactttcctaaggggagtagcaacagtctacaggtattcctcctgtggttattctgacagtggtaggcttaaacccggtagagaggtcttgcattctatctggtggagtgtgtggcacagaaacagttacgaaaacaaaagcttttaccctactctcccacccatcagaaagagcactgacttttaaaaaatatttccccttgcaaatcctcagtctcagaagcagggcattcgattatgttgtcaacacaaatagatctcataaaattcaaagttaaagtcacttctgacagtttcttagcctataaaatgagggggttagatcagataatctctaaaggtctttccgtctttcacagcttgtgactttatggctttagtcaacagtataaaacaagggcaaacggcaaaaaaaaaaaaaaaaaaacaagaagccttaaaacttagcacaggctctggagaatctacaggtatttcaaaaagacagttgacttgaaatgtaggaagcccaaatgaattctgaaatagagtagaaccgtgagaacgtgcttgtaaaatgtgtcaccacccactgccttccaactggctctggggcctttccagcactgggtggtatctgactgataagtatcattctttgttaatgtaaccatggtttgtcatgtttgccaaaggctggaagaaaattgagccaagagctggaagccagaagttccccatgcctgccctacacatccaggctctgagtttttactttttctactatattgccatgcaagtaactttaactttgcttctctgttctctgtcactgagaaataccatgtctccatggcaataggaatgcatttaccttcaccaaacctgctcaaatccttgctgaacaggacgtagcaggagttgactttccaatggtggaggttcagagtacagcctgtagccacagagaaaagttgcttgttcctgaaatgcagacacacctccaatccagagagcaagtcatctcgtggaggaagtggtagctgtaaaaattcaaatggaaaaggcataggtaagagacaaattttctgaaaagtttgccttaagtttggcacagaatttgggaccattgctttggcaatcaatgacactcagaggggaacagaagcctccaggatgggtgaggtggctcatggaaaacaagtgtgtgcagggcggagaggagaggaccaggacagaaggcaaggggttgagggggttgccgttctgggtctgttcctaacaggcatgctttttccagtcttttcatgccctcataaaccttcacttgggctggtggagtgttgcatttcttcatttagtcattgagtcatccattcctcacttacttaccagctcattcattcagaaagcctttattccacacctaccatgtgccaaataattgtattcagcaccagttcactcggatgaatagggcatggtccctgcccaccaggctcacagcctgggttgaagaggtagatgactaaacaggcgcatgcaattcaacatagtacgtgcctctttggagtaagcacggatgtggtgggagcacagtagaggggcagcgaagcccacctcggggaggaggtacagtggggttttgaaaggagggcctcccttaaggctgctgaaagatgtggtgttattttttattttttacttttttgtaagagacaggatctcattgtattgcccaggctggagtgcagtgactattcacaggcatgatcacggctcactgcagcctcaaactcctggcctcaagtgatcctcttgcctcagccccacaagtggctgggactctggcaagtgtagtgctatttagtgggtaaagagggggataggaaagagtcaaagggtattctaagttcaggggcagctttcacaatgactcagagacaaggaagaacatgtagggcttggaagtctgtaagtggttcagacagctcagctgatgaactaaccccacacacatcatggtgggcgtcactgaagcatttactgggcagctcctgtgaagaaatcagcttgcttgagctaaacatgtgaaatgagttcatttggcttgaccatatttaactccatgtggctgggttaaatgaaatgtttcatcctttggaaggaatgcaaagtttttggggttttgtttgtttttgagaagggttttgctctgtcgtcaggctagagtacagtggagtaatcatagctaagtgcagcctccaacttctggctcaagccatactcctgcctcagcctcctgagtagctgggactacaggtatgtgccaccataaccacctaatttttttaaattattttttgtagagacgaagtcttgctttgttgcccatgctggtctcaaattcctgggctcaagtgatccttctacttagggatcccaaagagctgggatcacaggcgtgagccaccgcacctgaccacacaaagagttttgaaccaggaaggaacctggagaaattatgcagcagtggacaaggtgggtggcctactgaaaagactgaagagaccctcaagagaatctggtagccatcagagtcagagacatttagaatggcacaaacacagcaggaagggaagcagtgattctatcaggcaccaggagaaatatgatacacaggttaccccatgtcattctcacaataacctaatggaagttggcattattaaacccactttacagatgaggcaccagaggtttggagtttgttgaagccacttgctctgaagcattttgaaaactttgtcctggttcttgtgacttgagcagagactgagctgcctcatcacaccaccgggttcctcaggaggaagatccgtggcagaggagatggcatctggttagaggctagtggcacaggaggagcatgggccagaacagctcccatgagctggaagatgtgacaagtactagtatcaatatcaagagcagggaggttgggagtggttgtggattttagcagatacatccactccttcattcattctatttatttaataaaaggttctgctggagactcatcagcaaaaacaaacaagcaaacaaaaaagagacaagtatttgtaccctcatggaacttacattctagtgaaggaggggagcaggaaataagcaagacagtcaatttcctctataataggttagatggggaaaagtagcaaggtgagaaataaaggaaggaagggaattttttttttaatttcaagatggttgcagttttagatggagcgaccaagaaagtggcattcaagtaaagacctgaagcaagtgagggagtgagctgtgaagacatctggttgggagagtatttttggaggagagaatcacatgtcccagggcctggagatgagagaactagcatggagcccatgtggctgtagcggagcttaacagggctctctaggaagagaagaggccagagttaacacagagttaacacagggctagaccacttgaggccttgaaggccatcgtaaggacttggggttcccttctaggtaagactggaagtcttttgaaggctttgagcagagattgccctctgactttcatgttaacaatatgggtctgatgactgtgttgagaatccatggtccaagggggcaagggcagagcaggaaggtgaagcaggaagcccgtggaataagccaggtgagagatgacgagggtttggaccaggcgggaacaggggagggggtgagaaatggtcaggtcccgatgtatttggagggtggagcagcaggatctgctgacagattggatgtgtggtgtgagagagagaagtcaaggatgacttcaaggttttggcctgaggaactggaaatgcctttcactgagggggaaataaagaaataagcaggtgtgggaggaaaatgaggacctcaggttttattctgttaagcttgaggcagaaatgtaggaggagcatgaagaaaggacagttccacagaggccaacggcaggaggaatggatcagatgccacggaagggtcagggagacgtgcgtggagggaaggtcattggacttggcaggcaaaatggtcatgagctcacagaagaggcacatggtgtgctttgtgaatttctccctagtcctacactctccttcattaagcacaggattctttcggccagtttcttctttctattcccctccccagctctttttagaccagggctggcctgtacccatccactcctctaatgctggcttcaaagcctgtttaatttaatggtcactccagggatctcttggaaaccgatgggagggtaccctgtccctcgtatggtatttttatgttcatttttattgggcatttatttttcctgctaaaaatatctcatgcctttctgggggcaggggaggggggaagtggagcggaaaaattatttcagcatctcgcttacaaatctgcttggtggagctggagtctgtgggttgagcactggttttccatgcccatttctggatgtgctcactaagatattccagcccaggcccttcctgttttagtgaaaggaaagcagtgaggtcccacccactcgtcttagaagctccctccggatggcctggccagtttccattccagtagatggcacgaaactgagttcatgaagtacagaaagtctgaacatctgtttctatgggtctacatgatgtcatttgtcctgaaacacccccagcccctcacacacagacagtccagatcctacacttggaaaaaaaaaacaaacagaaggggaattcctactgaggtaatgatctgagtgtggaggggctcccaatttggcctttatgaatggactgattgagctaggtagacagaaaggggtaatctccccctcgccgcttctctaacgccgtcctttgaaaaaagaaaataaactgggcaaagtcatcactgtgtgaaatggggctgaggattaggatttccacaggtccaagagcaatcaagtcattaccattgagtagattcgaggttgacttcagggtggttcaatttgtatatcacagaatatttgaacaactgtctaaagaaaaggtcactgtgccccagcctgagctgggttgacaatttgcttctgaagggcaaaagtaagacaataatgtctcaactgtagaaggaggtgggggagcaaggacagaagatggagcagagtagagatgcctttaaataactcagagggaagggctcttttctgagcttcactgtgctcagcctccaggggagtcctctgaagcacttcttcagagctgtgacctcctctgggtctgggaaccaggggtgaggccatgctgatcaattctggcttggggaaaggtgagaaagagacagtttgtgaataacatttagcaccccaaatcaggtggatggcttgaaagctcgaactaaggatacaaggaagtggtagaaaggaggggtgggattgaggtgggttttgccaacttggaacactagaatatttatttatttatttatttatttatttatttatttatttatttatttatttttagacacagggtcttgctctgtcacccaggctggagtttagtggtgcaatcatagctcactgcagcctcgaactccaaggcttaagtgatcctccagcctcagcctcctgagtaactaggaatacaggcatgcaccaccacacttggctaattggagcactagaatcttgttggcagtagcacatgggctcctcttggtggaaaaaaaaatatatccacatcaatatttggaggaaggctttgtcttgggactttaagaagatagcaaaggatttgttcatgcttgaacctatgcttgtgagtgagaactttatagtgttactatatggataacatgagtttaattgtatacacctgtgcaggaaacagtcaccatggctgcctgagactgctctccttagaaaggtctgcttggaaagttggcccctggtgggcatctgggagcttggccagtgaataattccccacattgatagaaaacttctatcagtgataagcgtggctcattggacttacaccatttgtacaaacaaaatggtttgtgctgaatgcctgccttccttctgagagcctggagttttgttacatgctaggcagcaggtgcctacatgacaaaaccccagtataaaatcttaagcactgagtctctaatgagctgtcctgacagacaatacttcacatgtgtagttagaatttgttgctagaggaactaagtgtgtcctgtgtgaatttactaggagcagactcttgagagcttgcacctggctttctctggacttctccccatgtgcctgttccctttgctcatgaaacaattgctttgtatccttttgctgtaatcaatcttagctgtgagcatggctatatgtggaatcctgtgagtcctcctagcaaatcactgagcctggtggtggtcttggggacccttgatacaactaaatcacccatattctagggcagagttctaaaattaatgacctgattcctgtttactaaagaatttgtaaaaaggctttaaccaggtggggtgaaaagggggtgttgacttcagtctggatagttctgttaaccttgtgcttggtgctcttgtcccatgccccatctcatgaagcaattgcaggaccctcgctcctgggtgcacaccgttctcagtctcaacctacctatcatggaagcagaggcagagcagagacaagagaagagtgttttgatctatctgtggtagaggctggggactccacgggtgttttcatttcccctcctaagccagtgggagggcgattgaacagctggcctctgctacagttcaggattgactcccttagcaaggctttcctaagtgtgcctttctgcttgagttctttctagattccaagcagacatagttctacctggtttccacagagtctttctttagatatgctaatgtaatcaattaactaacgcagagccttgctgtgtcctgtgagcctccatttctgtaaggtctgtaacctgctgtgttaattgtgctctcaaggcaacttgatccacgtcctgggggcactcctcacttgtggtcccttccccaagctgcaattaccaccttgtatgcagaattgctttgaagcatggtattctttctggaccatcccacagagaaaagcaagattttagcttgtatgtgctgcccggggtctcagaaatcaacttgctatgtacccagttctgggttcccagacagccactgtgatgtgaaggcttcctggcagggtgggtctatttcttcaccctcacccccttctgcagacatagcagacatcaatggggagatgagaagaaggcagaggagttgtgctaagaggaggacattcttgaaaatctgaaagatttcattatcttatagaactttggcttttagagctgcttttctaaatttcctcctctaccttcctgtgtctgcagcccccatttactcatctttaaatgaaagcaggacatggttctgacagcccccatagaaggccaaagagatgtgagactcctgagtggggagctaaggggagtgagggagcaggagtatccaggtgagcacaggaagtggtgagggtaggaaagaaagagtgtccatgggtgacacagctcccaggggacaagggaagggtatgtgaaattcccaagggcttttcagaacaaagtcttatcatcctactgtgcggtggagttagatcaagggactccttatgctttttggcccaatgtgggcctttgtgggttgttataggtgggttgttataagtagcttcaggtccaaagtgagaaactagtcaacatactctcctgcctctgtgtgactgataggcagagagtaagactcttgagtaatgtactgaccattcttccaacattacaagcatagcaggaaaatcccacaattcccactgcaggaagtgctagatcaccaggggaatatactaaaactccagacttccaagatggaagcctccactcattgttaacttcaaaagtctttttatcaaattctttgaaatgaatgaaaacaatcttccaaaatctctgggacgaggcaaaagcagttgttaagagggaagtttatagcactgaatgcctacatcaagaaaatagaaagatctcaaattaatgatctaacattacattacacataaatgaactagaaaaacaaagaacaagctaatctcaaaactagcagaagaaaagaaataactaaaatagaacagaactaaacaaaattaagacccatcctaaaacatacaaaggatccacaaaatgaagagttggttttttgaaaagaaagaaagaaagagagagagaaagacagaaagaaagaaagaaagaaagaaagaaagaaagaaagaaagaaagaaagaaagaaagaaagcaaaaagaaagacccaaatgagcacaatcagaaatgacaaaggtgacattacaaatgatcccacagaaatactaaagatcctgagagactattaggaacgcctatatgcacacaaactagaaaacctagagaaaatggataaattcctggaagcacacaacctgccaagattgaatcaggaagaaaatgaaactctgaacagaccattaatatgttctgaaattgaatcagtaataaaaaacctaccaacccataaaagtactgggctagacagattcatagccaaattctaccagacatacaaagaagaactggtaccagtcctactgaaactatcctgaaagactgaggaggaaggattctaccctaactcattctaggaaaccagtattatcctgataccaaaatctgacaaagacacagtgaaaaaagaaaactacaggccaatatccctgacgaacatagacatgaaaatcctcaacaaaatcctagaaaaccaaacccagcagcatatcaaaaactatttcaccacaatcagtaagctttattcctgggatacaaggttggttcagcatacggaaatcaataaatggattcaccacctaagcagaattaacaaaaaccatgtgaccatttcagtagatgtagaaaaagctttaggcgaaatccaatatcccttcgtgataaaaaccctcaacaaactaggaattgaaggaacatatctaaaaataataagagtcatttatgataaacccacagccaacatcatactgaatgtacaaaagctggaaacattccccttgagaaatgaaaaaaagacaaggatgcccattcttacttctatacaacatagtagtggaagtcctggccagagcaatcaggcaagagaaagaaataaaaggcattcagataggaatagaggaagtcaaactgtcttcattcacaggcaatataattttatacctggaaaaccccatagactccaccagaaggtctagaactaataaacaacttcagtaaactttcaggttgcaaaatcaatatgcaaataccagcagcatttctatacaccagtaacattaaaattgagagcccaatcaagaatataatcccatttataatagccacccaccaaaataaaataactagaaatacatctaaccaaggaagtgaaggttgtctatgatgggaatcacaaaacactgctgaaagaaaccataaacaacacaaacaaatgaaaaatatcccatgctcatggattagaagaatcaatattgttaaaatggccatagtgcccaaagcaatctacaaattcaatgctatttatatcaaattaccaatgtcatttttttaacagaattacaaaaaactatttcaaaattcatatggaaccaaaaaagagcctgaaaagtcaaagcaatcctaaacaaaaagaacaaagccagagacatcacattacctgacttcaaactatactacaaggctacagtagccaaaacagcatggtacaggtacagaaacagacacatagatcaatgaaacaaaatacagaacccagaaacaaagccacacacctacaacaaactgatctttgacagttgacaaaaataagcaatggggaaaagggaacagggaaataggagaaagaggataagcaatagcgaaaactacctattcaataaatggtgctgggatagctagctagccatacgcagaagaatgaaactggacccctacctatcaccatatacgcaaattaactcagggtggattaaagctttaaatgtaagacctcaagctttgaaatcctagaagaaaacctaggaaatacccttccatagacactggggactccaaaaggaggagagagggaggagaacaagggctgaaaatcttcctgttaggtactctgttcactatctgggtgataggatcaatacaaaccgaaaccccagcatcacgcaacagacccttgtaacaaacctgcacatgtaccccctgattctaaaatttaaattttaaaaaatctttttattagcagtatttgggggttcaggcctcagacttcaggaagaagccaatgagagaacatgatgtgaagagggtctccttttctctctgggagatctgctctccatctttaacaactgtgagctgcaggccctgttgttctttgtgctgccactccttgactgagcttctggagtggtgggggaagccactgaatattgactaagacacgaccacttccttcagggaacttgccgcctaagaaatggtcatgtcattgaacagacacagagtcaatggacccgtcccagttctcagtagtgaagcatcccatcaggacagggttcccgccttcagaccgatcttcttaggacagtcccaatactgtctgtggaggttgtaattccttcctcaggataatggttttctgcaccatctgtaaatatcttttaagcagatcttcaacaaatgattttagtttctcataattccagtcaatccaacgtttattgaaggcatgcacagatggaagagaatgtgttctctgacctcctgtccctgcttttactcccctgggattggctgtgaaccccaaatcattgcttggcaggcagcacaaaaccttcagctccagaagagccatttaataggtgcttaagatgaatttttggaaatttttaagaggaaagcaatttccctaagcattcaggaatgtttcttgtggctgtatttttatcctctgcatttcttcctgctgcaagggatggcctgccacagccttggtccagggcatctgccacctgtacacagggccctagccctctttcctattcaaggacttgacatctttctctcgtatcattgattttcctatttcttgtggttcatcccattggcatactaacatgcgataacatcctatattaaattaaacaactaacagatcaataaatctcttttcaacctccaattcctctttcatctattactgtattttgtactctttatagcaagtactcataaaccactttatttatgagaataaagtattctcattgcatggctttcatatttcctgcacccacttcctagaatgctgtccccaggatcctcgcgtcctcacttctttagatctctgctcaaacacttattattagctgtgtttgtcttctttttcattgcaataaagaaatacctgaggctgggtaatttattaagaaaagaggtttaattggctctcagttctgcaggctggacaggaagcatggtgctgggatctgctcctggtgagggcctcaggaagcgtccaatcatggtggaaggcacagggagagcaggtgcgtcacatggtgagatgtgggggcaagaagagagaagagggaggtcccagactcttaaacaagcagatctcacgtgaactaactgagggagaactcactcgtcactagggggattcttagacagtcatgagaaatctgcctccatgatccagtcacctcccaacaggtcccacctccaacatgggggattacatttcaacatgagattcacaggggacacacatccaaaccgtattattacctgaaatgataatggttagttatcaacttattttcttgtttattgtctgtctttaagacaatagaatctaaattttatgacaaattagattgaatctatctcaattcattggtgtatcactggtgcctgaaacagggcctggcacacagaaaatactcaataaatatttgtagaatgagtgagaatattagccagaatttatttagtgttcatgctgtgtcagatactgtgatacaagaattatctcattgaactctcacagcagttctataacacgtttaatattatttcacccagttttacagatgaggaaaattcagcataaaaagatgaagtaatgaccaggtgtaggggctctcacctgtaattcctgcactttgggaggccaaggcaggaggatggctagaggtcaggactttgaggccagcctgggcaacataaggaaactctgcctctataaaaaaaaaaaaaaaaattaattagctgggcacagcagtctgtgcatgtagtcccagctacttgggaggctgaactgggaggattacttgagcccaggacttcaagactgcaatgagctatggttgcaccactgcactctagcctgggtgacagagtgagatcctgtctctaaaaataaatagataaatacatagatggtgaagtaatttgcctaagtttatatggttaacaaggtatggaactagaccttgaccccagtttggtctcactccaaaactcctgctcataatcacaggattataccgcccccaatgacagcagcctaccagtgaaagtcccagtgacatcagtttaagattccctgctaatgaatgctgcatgaggcaccataagtgctcctttcactgtgtaacagcactgaactagccttcaattctcccacactctactccataaatgggtacctattgcaagtggagtggttggacaggagggtgctggagtatgagtggaaggggggagaagcactctatcctagaagcccaaatttctaatcttccaggtttcagctttgatgtagggcagacgccacatgttttccagatgtcttaattctccaccttcactttcctctgccttctccctctccttttctggaagttgggggaactctcttttgaaggcattttggtcccccaacctcatgccctgggcatgccctagaggttgcccgcaaacagttcctcaggccaggggtgcaggtaagttaaggctgtcggagtgagcctctaccgcgagggacaggagttggtgaataaaaccccctgctccacccctctcagcggcgccactctgagggtggttgcacagtttcctagagggtccttagggggactgaggccctgttgcccacgaaagtaaccctcccaagaacacactgtgtatggagtctccttccttcccagcctcacccccttgctgtttcccatgcttcctgagctcacctcccaagtaagtgataggtcctggattcctcatctcaggatctgcctttggggaaacctgacctgaggtggacttcttctcctaaatctgcatcacctgtggaaacaaaccatatccaggagtcacatcccaagaaccagaccatcttcccccaaacataggttaaattacatctcagtaagctggaagggcacagcttcggccataatttcattcagtgtcctcaatcattctgcaatagatactagttaggtagggtcagctcacttcacacacacaaaaactgaggctcagggaggtgaattaagtacctggctatcaagactccaggtgagcggccattcatcctcaagggtttgcgtaagaattcaataagctcttttctgtaatgcacctagcagagagctaagcatgcagtgggtgttcaatccatgtaagttctctttcctcttttgacttttattattccactaaatggtctaaaaattatgttgtcgctggagttgggcccatatttcataaacagaaagatagatgcaactccagccattccttctcctaggtgaataggtgcacatggttcaggaatgtcccactggagtcatccctcttcttttcacaggtgctgtttataaaccagcccagctttggctcaggacaagccacccatctccaggggctggcgtgtgtgcctctgctgaccgcagctgctgacctgtctcctgtacactctggatgctgtgatgcccagacagcaaaacttcttttcaggctccccaagaaggcagggaccccagttctctcaagagctaacattagagcaaatcagtctcaagagggagtcccagaatcaagaggaaatatgggcttgctccttgatcctggagtagagcacatcttccctgcctgcatggccatgctgtgaatctgcagctcagaagttggtctccctaatgccacactctggaaccatgtcagccacatgattgtggcttcccgaggccacggcgtgtgcactctgcctgttcatgttgtgttttcctggtgactccttcctttgctattcagtaataaggctgatctgccatagcaacgcccacagccaatggcacctgcacagtgcgttccttctctactccacaatatttccttaaagaaacacacacctggaaattgaatttctggaatgattcccagatgctttccagaggaagcctggcgacgtgggcaaatagccctttattttccaccacgggaacaaatatttctgatctttctttagtgttggggctgcatgcaataaatactcaggtgacacttttctgggtggcagtggtgagtgatgggaatgaggctaaataaatacttgtcagtttgtgtcatttccaccagcactgagagggtgactgtttcagtatccaagcggaaattgtggactcagggcaaaaagacagagatgaaaattcagtagttatcttcagagggaaagaattttaagctgtggggatggataaaatctctatggaagggaaaaaaagagagacagacagatgaaaggagatggggcctttgatcatataattcattgcccaaactggaacaactttgagagtgaaaggaggtcactattaatagtgacactggggcctcagatgtaaactaggattgtcttgggcacacagggacttatggttgccctaatgctagggtcagtctattgaaggggccaatgatgatagcctgacccttgccacagccctgacacttgccacataacagtagggagtggtaatgaggcagtcactcaatatagctcagaacataagaccttctggtagggtcttcactgggggtgggggatggtgcttcatgaactcctgaaacttgtcttcccttggctgccaaaggcctccctcccttctctcatcttcctctttccatggggatgagggaggtaccgtgaggccgggacacagatgtccatgtgctctccaaatgtcttgggggaggggagaaaactataactcttggaaatttgatagaattgtcaaaagaatataatcagctacatacattgtttaaccaaagttgtagttctatgataaaagataaaaattttcttttatgagaataaaatacctaggaatccaacttacaagggatgtgaaggacctcttcaaggagaactacaaaccactgctcaaggaaataaaagaggatacaaacaaatggaagaacattccatgctcatgggtagaaagaatcaatattgtgaaaatggccatactgctcaaggtaatttatagattcaatgccatccccatcaagctaccaatgactttcttcacagaattggaaaaaactactttaaagttcatatggaaccaaaaaagagcccacatcgccaagtcaatcctaagccagaagaacaaagctggaggcatcacactacctgacttcaaactatactacaaggctacagtcaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaggacttaaacgttagacctaacatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatcggacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctggaactggaaataccatttgacccagccatcccattaatgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggtcacaggaaggggaatatcacgctctggggactgttgtggggtggagggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaatggcaaaaaaaaaaattttcttttatattagcactaaccattaccatttcaatataatcccctaaggtaattacaatatacatttgatcctgcttggtttccaacccagtccctctagtctgtgccctcctacctctctggggacttttctccatatttaaaaacaaaccaacaaaaaatcatctcttgaccctgagtttctctctcaacctgtatctagatgagtataaatgcaatacctttcattttctcccacctcctttatactctaaccctgttgtaatctggccttctagcatttccacatttttgtgtttcagactagatggaagagctgctgtaacctcactcagtgtggttcacaataggctcagatgagctaagccattccgaacatcatatttctaaggaaagccaactggttttttaagaagcaaactgattccaagttggttaaaacctgcttacattgattctaatcaggtcaagccaaccttcctgggtcatattgggtaaagccagctcaaacaggataaaacagtcccaaactgacacatcagattccaagcagttcctgctgatcgagaccagataagcctgcatctaacttgtccttactggatcagaccaacgtgaattgaatcacagcagttcagaaagaggaaactggattcaggcaagtgatattgctttatattaggggaaaacagtgtaaagtgattcttagtagagcaaacagatcctaatgaaattaaaatggtttaaagtcacatttgtcaaaataggctgattcaaactggatcaaatcagctctgatttcaatagcttttcctttgtttgggaaaagttattgaaactattcaaccagctttgaatagtttaaaccagatcaacctggcagcattgctaaatagcttcaaaaatatgttattaactatttattgaggtgaaaggctgggcacggtggttgacgcctgtaataccagcactttgggaggctgagacgggtggattgcttgagcacaggagttcgcaaccagcctgagcaacatggtgaaaccccgtctctacaaaaaatacaaaaattagccagacagtggtggcgtatgcctgtggtcccagctactccggaggctaaggttagtggattgcttgagcctacgaggtcaaggttgccgtcagccaagatagcacctctgcactccagcctgagtgacaaagcaagactctgtctcgaaaaaaaaaaacaacaacaaccaaatgagacaacaaagaagcctctttattgagggggaaaaaagagacagataggttacagatgttgttatacgttatatcttataatttacattttgctttcataggtcacagaaagatgtatatatatatatatatatatttttttttttaagtccaaagcaaactctttcctgattcatcacacaatctgtaatgttcattgctctatagattactcttgacactaaaattatttcttacactgatcactgtcgtgtgttttaatgaaactgaggcaagttttttgccaaaaaaattttcccccaattatctaggtatgagcgtccctctgtgggaataaacttcatgcccagtgctgaccttctcgcagtgatgtttttggggaaacatcttttttcacagggacaatacacttgcattacttcataggagccagacccacaataggacacattttcaaagagaaattgtttctccagatctgtgagcacactgtgtcccaaggcagtgctgcttttatagtaaatatgttgactatgtgagctgcggaacagttcttctataacctgaatataactttccaataaaaattctttcacttttttttttttttttttttttttggggggagagaaggtcccgctctgtcacccaggctagagtgccatgatcatggctcactgcaacctcatcttcctgggctcaggtgatcttcccacctcagcctctcgagtagctgggactataggcccgtgccaccaccacccagctaggttttttgtatttttgtagagatgggattttgtaatttttgtatttttgtagagacatgatttcataatttgtgtatttttgtagagacaggattttgccatattgtccaggctggtcttaaattgctgggctcaagcgattggcctgccttggcctcccagagtgctatgattacaggtttgagccactgcacctggccccacattttttatttaaaaaatttatgaactagatcatcattgggtatagggacattcatcatttttacttagttgcaacttcctggctgatgggcagtgcgaaaatgaatgcagaattatgttgactgcctgggagacacctggactgatatataatatactcatccaaatggtaaactagtgcagaagtggaagaaaacatgtagagactcaataagaatacaagttaagttacaatgcaattaatagtcaaactgaagtagaaaggtaatttatattaactacattaaaaatatatatatttcccaggcagaaaatattggattttgtgtttcaaaatcagacacctgcaagcctaaaatccaggtctgatccaatcaaacttgcttgaatacttgtatgcaaataaaatttgttctcaattgtttaaactggttgcaattggattacaatgagaactaccttttcatttcagtttgcactcaccaaggtctcacagcgacctttaagagagtcagggatgggttagagggtgaagtaagaaaatgcctcctactccaccccatgaccaccacttttatatttctctggccacagaccttgcctcctggtggtctggggaagagttgtattgtgcatcagatgcccaaaatgttccatgtacacttgaaagaaatgtgtattctgccactgggtggacctgtaaatgtccattagaatcaattagttggtggtgttgctcagttcttcaatgtctttgctgattttctgtctacttatactatcagttactgaggggagagctttgatgtcttcaactttatgggcttgtcatttctccattcagttctatcagtttttggattttgtattctgaaattctattgttaggtatacatacatttaggattgctatgttttcacagtgaattggctcttttgattattatgcaatgtgtcctctttatccttggtaattttccttgttctaaagttgattttaataataaaattatattccaggtttcttttgattagtgattatatggtttagctttctttccatattttaatttttattctgatcataaatatattattatatttaaagtggattttgctgggcatggtggctcacacctgcaaccccagcactttgggaggccaaggggggcagatcgcttgaacccagggatttgagaccagcctggacaacatggtgaaaccccttccctacaaaaaatacaaaaattagccggtcgtggtggcacacacctgtggttccattgggaggcagaggtggaagaatcacctgagcccaggaagtcagggttgcagtgagctgtgattgtgccacatacagtcatccggcctgggtgacagttttctttgtttgtttgttttgaattgagatactgtctcaaaaaattaaaacataataaagtgagtttctcttaggcagtatgtagttgtttcttagttttctttgtttgtttgctttgaattcattcagtctctgtcttttaactggtaggtctgttggacagactccaaaatggcctctattgagtcctacctcttggatttatattgttgtttaatctccactccttaagtatgaacaggtttggagaggtcctgtgagttgtttccaaccaatagaatatggtaaggtgatggaatgtcacttttgtgattgtgctatctaagattgtaacttctgtcttgctagcagtttttctccatagactcactctcttcctggctttgatgaagtaagttgccatgttggggaggctcacatggcaagaaactgaggccttcaatccaacagcccaaaagaaatgaaattgtctgaacaactgtgcttgcaagcttagaatcagatttttccccagtaaagccttcaaatgtgacctcagccctggccaacaccttggttgtaggtacatgaaagaccctggggcagaggacctagtttagccatgcctgcattcctgacccacagaaactgagataataaacatatgttcttttgagctaagtttgtgataatttgttacatagaaacagatatctaatatttatatcatttatgtgtttataccatttaaatttaatgtaagaattgagggctgggtgcagtggctcatgactgtaattccagcactttgggaggctaaggtagatggatcacttgagcccaggagtttgagaccagcctgggccacatggcaaaaccctgtctctacaaaaaaatacaaaaatagccaggcatggtggcctgcacacctgtggtctcagctactctggaggctgaggttggagaatcaccggagcctgggaggttaaggttgcagtgagccatgatcacaccactgcccttcatcctgggtgacacagtgagacgctgtcacacaaaaaaataaataaaaataaaaagtaaaataaaaaataaaataaaataaaataaaattgatatgtttgtacttagatcaccattttatcacatattttatgtttgtttcttctgattttcattttccctttcctactttcttctgaaatatttgaatatctttgtcttctattttaattttctattgatatttttactatatctctgggaaaaaaattttagtagctgttctagagattacagtatatggtctgctattatattactattatattttataatttcaagaggagtactcaattcttgcattaaatttaaatggtataaacacataaatgatataaatattagatcttctcaccatataggtacctttggcatcccctgtttacgtagtcatcatagtattatgtattatgatgactacatacattgaaaattccatcagtcaatgttacaatttgtgctttcacatatttcaaagaacttaaaatctattatatttttccaggtatctaccatttcagttgctcttatttcattactattgttaaagtttccctcgatttaatttccttgtagtctgaagaattctccttagcatttcttatggaacaagtctggtatcaaggaattttcttactttatctgagaatgtccttatttcattgtcattcatgaacgatatttccactggatataagattctggattggtagttttcttttcttttttattttttttttttgagacagagtctcactctgtagcccagactagagtgcagtggcatgatctcagctcactgcaacctccatctcccaggctcaagcgattctcgtgcctcagcctcctgagtagctgggactacgggtgcatgccaccacgactggctaattttttgtattttcgtagagacggggtttcaccatgttgcccagggtggtcttgaactcctgagctcaggtgatccgcccccttggccgcccaaagtgctgggattacaggcatgagccactgtggagggccgataattcttttctttctgtatgttaaaaatgttattctacttccctccagcttccatggtttctgatgagaaatgcacagtcatttaaataattgtttctctacctgaaatgagtcatttatctttgattgctttcaggatattttctttattttaatagttttcataagtttgattataatgtgtggatgtctttgattttatcctgtttgggattcactgagtttcttcaatttccatgttcatgtcttttgtgaaatgtgatgtttttccaccattatttcttaaaatatttttttcccattcaacatcctttttcttttccttctaggagtgtaatgacacaaatattaaactttttggtattttttcccacaggcccctaaggttctgctgggtttctttttcaattttctttcctttgttgttcagattagataatttctattgatctatctttaagttaatttttcatccagttaatctgaaatttaagttagtgtccttctctttttctgttctaatatttccatttggtttgtttttatatcttccttttttttaaattttgagacagttttgcttttgttgcccaggctggagtacaatggtgtgatcttggctcactgcaacctccacctcccggatttaagagattcttctgcctcagcctcctgaatagctgggattacagatgcctgccaccatgcccagctaattttttgtatttttagtggaaacagggtttcactatgttgccaaggctgatctcgaactcctgatctcaggtgatccacttgccttggcctcccaaagtgctgggattacaggtgtgagccactccactaggcctgtttttatatcttcttttttcccccctgagaatttcggtatttccatttgtttcaggagcactttcccttactttatggaacatggttataattgctgctttaaaaaatgtttggtaattctaacatctgtatcttctcagggttagtgtctgttgattgtctcgttccttgtcagttgagactttcatggttcttcatatgctgagtaatttgggattatatcctagacattttgaatattacaggaccccaggtctgacttaaatcctaaaaagaaggcttttttttttttttgaagcaggaaatgaaacagattatattatttttgcgagtccaaacctgcctcttgggctgtggtttcaatatcatttctgatttcagagtgcagtgctattcagatcagtcctgtgtgtgtgccacccagtggccaatcatgggcctggactggggtctaccttgcagtttcagttctccaaacatgtggtatggtgtttaggatcagatccatacatgtgtagcctggaggtgagcccaggagctaaaacataagtttgtgggatttctgacttaagctccctactctccgtgatctccccaacaccctctggctccttggggcctcccttttcagccctccagtgagcaagcttgggcttcagtttctctgctctgccacacttaccatgactgtttctgtgtttggagtcaagtggcaggaggagaaaggtgaaaaaaaaaggaagaaagatttgccacacactcttgtgaacactgctcctccagtcaaacagaataattcccctctcttggaatcttagatgactgcctagctccactcccaccccctcagcctctgccaccaccactgctgctacaatattgcctgtgggctgaggctggaaagaaggaaaaaaaaaaacaccaggagttcccctgcaccccactctctctctgactcttcagaatctcctttcttgtgttttagagaggacttctcttgcagctctttctgtcttcctctggtgcacacttccagctttatggctgccttttagtctaggctggctgatactgggagggaaaaaaattcactactgatttagtgggactttgaattctggtcttcttcccaaagccacctgctatgatttatgtttcagaactctcagatagctcctccatccattctgtccaggatttatagttacatttagtgtgtccttacttattccatcttttctggaataaggctctctttttgctttttaaatcatcaatcatttgctatgtgggaaatgatatctttgtttatatgtatggcatttattgtctcccccacccccggcccctgcaaagtttcataaaaaacaaaacttattgaccagcaataactctttattatatggccggaaagaattaggcaatccatctggagaaaacagactgtttctcttcgctcacacaatacttctgacagcaaatgtgtggggctttttctccatcccaagaagttctccaattctgctcccatcagctgcatgccctacgatttaattcgattttgacactgtctacctggagctaagcatcagatcccacagggttagttctcagtctcacaagattgccctgttaatggaaaaaccaaactctgaaaatattttaaagaggtttcttctgagccaatatgagtgaccatggcctagagaacacagtctcaataggtcctgagaaagtgtgtctgtggcagtcagattacagtttggttgtataaattttagggaggcaggagttataggcaaagacataaattcacacatggaaggtatacactggttcggcccgaaaaggtgtgatatcttgaagtgggagtttacaggttataggcggattcagagattctttaatttgcaattggttaaaggagtagagctttgtgtaaaaatttggagtcaacagaaaagaaagttttaagttaagataaggaagtatgtgaaccaatattcgaggtcagagtgacccgtagggctgagtgacttagcccttgtccggcacggccttatgtcctctttataatttgatatcttattgtcacaaggagtctgttttgttagtcttatggtctgtattttaatattaatggtggtcagttgtgcctaaactccaaaagggtggggatatatcacctccctttgtgtcatgctgggaattccatttttaaggattttctagggtccccttagccaagagggggtctgttcagctgttgaggggcttaggattttatttttagttttcagcctctacttcagatgtcaatcaccaggccaggtctctagtacttttgaccaaccagctgcaaattggggtttcccctacccaccttctcagcaatactttgctgggatagctcacagaactcaggccatttactcgtttattataaaggatacagatgaagacttaggtgaggtctagaagggtccaaagcataggagcttttgtccctgtagaattggggtacccctctctcccagagttttcatagaatttaatttcctcccatcccattcctggaggtcagtgggtagggctgaaagtttcaaccttctaatcccttagtttttctggtgttgagtcccatcctgaggctatctggggtcctaccctaaattacctcattagcataaactcaggtgtgctccaaagaggctccttaagaataagaaaggacacctcatgactgaggaaattccaagggttttagattctctgtgccaggaccacggacaaagaccaaatatacttcttatcacactacactatcctattttcttttcctctacatttcatcctattttctgagtccacaattagaggcattccacccaaagacgaattctcaaaggaacaaattcacaccaagattgaaccacaacctcacctggcctgcacaatgccttcaattgtttttctggcttgcattttcccctcttatattaatagagaaaaaaagagcattccagggccatgagccctcttgagatgttgagcttgaatgattgggaagatgatagctcctcatccagatatggagtatggaataggaaagagggtttggggggtgggacaggaagtgatatgttctatccataacacattgcacttgaagcacctgccaaaatatccgggaaatgggagcctggaggtgagggtcaaaggccagacttaggtggcataaagaatgacttggaataaattattgtggaaggtctacaggagaaaattattatgggaggacagggtgtgtatcatggtgagagaagagggccagggatctcgtgcacagtgtgcttaaccttcaaattgcaaggacttcccactgtgacgcaggcctcagttctacacagctgctcttcaagaccactcccactactgtgcctccccaccattcctgagtattctccactcccagagcctgatgactttccctaagctcccaccttcagtacacagattggcctttatctcaaaggcagaactggtatttgggtaccatggcagatctgttgggggagttttttcagattttcctgattctggcccctggtggagaaaaatgatctggggtaaagttgcagcctgcctgacccatgcaggaatttatcccttaacttgggcctactaatcagcacaattacctctgaacactaaaataacaaggctttctgatcactttaccattgccaagttgtatttacaaatgtcatcatactttattgtatcaaccattatatcagtcatggtatgctaggttttgctgcagtaacaaactcaaatctcagtgggagatttgatgctgtacattcaaagaatggtgggggtgcttacagatcacagtcctctgagacccaggctaaccaaggattccacaaccctagcaccagtgggaaggaacacgatgatttgtacattgagtcttaaagcagctaccagctttaaaaaaaaaaaaaatttaaaaagagaagtcacattccatttgccacagcaagtcacctggccacatttaacttcaaagggaggggaagtgaaatctcgtccctgaaggcgaattggtgaacttgagtcatgattaccacaaccatgccctctaaaatcattatagccacatgacagttgaaaaactcagactagtaagtcacttttccaagtcacacagtcaggaagttagcacagcaaggctccaagtgcacatttgtttaactctaaaaccaatgtgcctttcacaacctgatgtgctgtcttcatgaaaccgttatccagaagaaagttcttattagcttcaaggaaacttcagatgctgacaagtaaaaagtttgacatgtgcaattaacttaatcaatcaaaaagaaacaatgtgttcctgttttctttccttttgcaattacctgtttttagaaggaaggaaagaaggaaagaaaagaaagaaagaaggaaagagagaaggaaggaaggagaaaaagaaaagaaagaaagaaagcaaaagaaaagaaagaaagcaaaagaaaaaaagaagagaagaaaaggaaaaagaaaagaaaggaaagaaaaagaaaccaagccttttggcccaccctttgacctacaccacaatatctgattgcatgtcagggtgatttggtttctttcccattgtgtggtattttccactcacaggactgggtcaggagaagtttgtatcttaatctacacgcttgttcttgctcatgtttgcctctgcttgatcccatacccttcattcatcctttggaatgttcccgtgacaacggaagaatggcaatatagctagccagaaaaaagggacggaccaagaacagaccaacttctctcagactgaggatgctaatggggaaggcacaggacatgagagtgttttctccccattttcccccttgagagaattcagcagttagtgagtgtcaagcctgctctgcagatgaggaaactgaggctcagcagggttaagccactgctcaaggtcataaggctagtacccagatgaaaaccagctgctattattttttcctgaatcactgcttcgttttctgtccattccactctgcaaccttccatctctcctcctaggaaacctgcgcccaaagcatgcagccaatgcagggctcctctgcctcctctgatgtcttccacctccatgtggcctgcttgctggcagatacaaggataggtgcagctctttacaatggagacattgagatgaggtggccactgtagggctcaggctgctggggcctggaggtgggagctgtcccagtgctatggaagaaatgcttctcaggcctcaaaactgttcctgaacaaacccaaggttcatagaagatgaattctggcaagaggctgagttctggaaagcggcatgaatagtagcagagactggggtccacattgctgggctaagctttgggacaagcccatgagggaaaacccacaaggcttcttcttaactccaaagaagaaaaataataacctgattagattaaatatgctttgagccgggaagatccttagctttaacatgtatgatatttggaattcaagatgtcctaagtagtttccatggctatttctgacagcctgaagcccctggttttctccacccatggacttccaagggacaggacaatggggagggggctcactggaatagctcaaggcccaccagatgggttcctatttctgattgaccacattctcacggtgtgaatgtctgcaactcattttttcccctgggcctctgttttttaatctgaataagagaaaatagggccgggcgtggtagctcacgcctgtaatcccagcactttgggaggctgaggcaggcagatcatgaggtcaagcgatggagaccatcctggccagcatggtgaaaccccatctctactaaaaaaatacaaaaattagctgggtgtggtggcatgtgcctgtagtcccagctactcaggaggctgaggcaggagaatttcttgaatgtgagaggcggaggttgcagtgagccaagatcgcaccactgcactccagcctgggcaacagagtgagactccgtctcaaacaaacaaacaaacaaacaaaaaaacaaacaaaaaaacaaaaagagaaaatactctcttccacctctagaattctgagatttttaaataaagaaagatgaacttaggaagaagctggtcctgaacactgatcctgtagcttctggatgaacacctaataccagaggaatagaggagccatttcagggtcacccactcaggtgttctctcatcctacccaagtcaacaaacagcagctctatcaatgtcttcatgactcaagacacatcgtggggagttttgtctgtaagccatgatgtggcactagagctgcatggtaattctctgcattacagggaataaaagaagctattccaaatgcagcttgaaatttttaaaaaagaagtcacatacttctctgagtatgtcatcttttcccagatggatccaaaacgagccacataatttccctgttgcagagtttctgagagattcgtggatctgagaactggaaggggctatacaagttggtgtgagcccgtcccattctctcccaacaggtataattaggttcttgccattccataggggaggcgactgcagtttggaggttggtgacttctacgatgggatggccagagagcaatggcggtgtagtgtttgggggactgactgctttcttttatgacaccaaactgctgctcataagcaaaagtgtccaccatcacacacagagtggtgaaaggaaacactaaaagagaaaaaaaaaaaaaaggaacgtgggacccaggaacactctggcagcactgtctggtgagccgctacaactagcacatagtaggtggtctgtgtgctgaagagaggcaggatgaaggtgagtgaggcaaggcaaagccatgaacttggagaccgtgtgactttgtcgtttgtagtgccctggttttatacataagccatatctggccagtgttcattggatatgccctatctctgagattttataaaaattaattcattcaacaagaaagccggtttgctgaagagggaaaattgccaacaaggccaaggtgacagcaatttcaagcacaatgtaagctgattagcctcaaacagagaagctgcttcctggctgagctctcccaccctgctccagttgtcttggagatttgcagtcctggtcacaaggggtaccaggcggcagtgtgagcaatgggtgaaggacaggacctcattatgagagtctcccaggaaggaaaaggcagacgcaggatattctttcagaatgatggatttgcttaagtttgcatttatttttttcattacaagagaattgtggaatgatgcttttgcattaccttttttgaaaaataagaaatgttctttttctccctctccctttggaaaaacacagatctgattacgtcagtccctgcttaaacccccttagaggcttcctcttgctcatttgaaaatgacagaactcataaaaacggccataagcatcactggcattgaatggaattgcacagcactcctttctcaattgttaataaaatgacatacttccatatcagctgatcaacagccactacgtcaagctgtcccctacttcttccaccctgggaacactgggcctccccaaggcctccaggacagcagcgggctccagggcctgctctagccagtgtcctgtatctgctctcttttgtggactctgaagccacacagcccttctgctcctggagagtcccctgccttcctcagggtctttgcaaaggtgtttccttctgtctagaacagtctcccacgctgtcccctttgactttgggtgacttttctcatccttcctttagtcgttcatagttggcttcaataaatgaaggatagacgggaaagtgactgatcagccatgcttgagaagaggaggccctgggcgtatgccgtagatctccattgtctaggcctagttaatcatcgccggaagaagaaagggaggctgtggactggaggctgccagccccgccttctccttctgtctgcatgtcctaaggagaagcagcctcggatccgggtgatgcctcttggctgtgagtattatcatttgcaaagaggaaaaggggaaataatctgaatatctgggattccaaaagttgtcttgtaccaggtaacaagaaccttcctatctcctctgaccagatgtggggtgagaaagaggatgagagcaagtgtgaagcagaaaagggaaagagaaggagataacctgaagtgtggcctgaagactccctgacacttcatgggaatccttgacattccgtctggaaaccattttgctcatgtcctcagagctgtggctgcagaattttctcttgcccagttgtgggttacaggtcaagtagagagtcagccccaggcaagggcacaggaactcagactgtaggtcagcattccagagttcctggaggaggaagaaaaaggactgggttaaggaggcaagcaggggagggaatctaccctgagatttttagaaacagctcaaaataacagcaagttgaccaactctcaaagtgttttgttttgtttaccatgcctcccttattttcttattatttgctgggcacaggcttgccttgactttacagtctgcataagtttacaaccaggaaaatgaaaggaacaattttacaagcatcgtgatggatcctggtacctccttcagagcttgaaattaggggtttgaatgtaggtccattttcatcccacttccaaatgctagcaacgtagggaattatacgggggtttcctttcctgctgggacacaattctctgaagcacagttaggatgaaaacacgaggtttgtaagagctgagagcagtgtttttcaaagtgcaattttcagaactctaggcccaagagatgtttcgctggtaaaaggattccacgtcaaatacatttgggacactctgcatcatctctcccctctcaggcaatctcagtgcttataagtaagaaaactgtgttccccataagtttccccccaaagggtccagctgtcctgcattgccttcctgtaatctgttcacacgttgctcttattccagttccacatgccctgaactcccagaaggttgctctcagcagtgagccattcattcctcagagatttgggagccctcaccacgtgcagacgctgtgctgcaggctgggaaccacaggagaaatggctgaatgttctgtgggtgtggctgtaggcagagggctgatcagtgaggtggggtggtgacagtcttctataggatgtcgtatgcatcatttatcaacttaactaggacaagagaatgaaggggggtactattaataattaattaataattataataggacaacaggtgtaagctagagctgtcttacatagacagaactgacacatgacagaagagttatgtttcttgtctgtccctttaggagctgcctctagggccagtggataataattacagggcaaaaggtttcaagtcaaaattaaaagggaatttctaacaaagagcctctaagaacaatgtggctattttatgaggtagtgagtagctcaccacatcagatatgcaaaggggtgacccaccctccaagatgctgtgtatagctgacactgacatgccaggcaggcccccagcctaggtaagcacaggctagcctttgactgtgatctgaagcacatattcttggctctctctttcggtgagggtcagtaagctattttatatgcaaggaccacattctgctcttctgattcatacgtgacagacacatttggataaaagcagaaatataacaggactgaaagattaaaacttgctgtcttagcatacttaatattcactgatgcttacacataatgtaaatatctctttgtttaaaatgagtataggctggtctctgtggctcacgcctgtaatctcagcactttgggaggccaagaacggaggatcacttgagctcaggagtttgagaccagcctgggcaacacagcaatacctcctttctactaaaaataaaaaatgaaaaaaaaattagtcaaatgtggtggcgcacgcctgtagtctcagctacctgggaggccgcagtgagaggattgcttgagcccaggaggtggagcctgcagtgagctgcaatcatgccactgcaccccagcctgggtgacagagcaagacactctctcaaaataaataaacaaataaaacaagtattatcttgactttaaagaaagagactttcttgtgacatataagcaaaatatggtcaaaacaatttgaccaaggttgaaaatggactggaatcacttctaaggagccagcctaggtctgtcgaatcaagtttgctcactaataatcatactttggttatgtcggatgttaacattagaggaagagggtgggggatataaggggattctttgtactatttgtgaaacttgtctaaaattatttcaaaattaaaaaataacaaacaaaaccacatcctttgctcctgagccctgttcgccccagacattatgtgatgaactcactccgttctttaagatccagctctgcagagcatctcagattccctgtcctgaggcaggtactcctgtatgagctcttaaatacttctgcatttacctaccacctactggtatggttttctgactatatttcatcttcttcgcctcacgtggagtttcttttagaatggaaagttttcttcctttcctctttgaatcctagcaccaaggccacactcggcactgaatacctgtctcgaatgaatgaataaatcaatcttgtttgaacaaatcttattagttttgcttttttaaaattatggtaaaatgtacataacataaaaatttccattttaaccatttttaagtgtataattcagtgacattaagtacattctaaagttgcgcaggtttttttttttaaatcagttctaaatggtttaaactggccagtatttactagagctgttagatcgacttaatttggacccatgagactcgtgacactcagaattaatctaatcccatttacaccaggtgcctcccatcaaaatctgtttgatcaagtgtggaattatttcatcccattggaaccagctcttgaatcaatcagaactggctctgccaggctccgggccagtagtcggtgctcaaaatggtgtttctttctttggcctaatctcttgagtagcctctttcccttttgttaatttttttttttttctggaggacaatcttccctgggagctcccttctgctcccacgaagcgctctgcacccagccctggtgctgcctggctctggggcagggagcttgcattctgccacctccttcattgtcctctcggtatacctgcactttcaaaacaacccctgcaggcaagctttagaggcagcgataaacaaacaggctgactgaaatttagggaaacgcctgtatctggacagcctcttcaaatatttgtcaccccctccctgctctggggaaagaagagacagttcctcacagtcactctatttcctgccttcccagctctgaacaccttggctcgaatgtaaagaatttggctctgaattaggactcaagaaacggggccctagcaattttccctccattaactaaacgcgtcactttggtcatgcccttttgggggcaataatttcccaattcgtaaaatgaagggatcaaagtttgatttttatcattactaatgagaagaattattatttttttgcagcaggcttttttttccccaacaaaatattactctgaataagacaagaaagaatcccgaacggctctggccgtcagggtgtgtgtgtctcctccccatgctgtctaacccccgttggaatttggagggctcttgtcctttccccttggcctcagaaggagcccagcgcgtcctaccttgcgtgggagtgtgtgtgtgaccagggctccttcctgcccttagagtcaccgcccccttctcgcacaggtttacagcaccacttgcctcgcccactccccgctttgcctccgccccatcctgatgctgccggaatggctgttccaaatggaaggatgcccgcgtccgtcccctgccccagtccttcaacaggtccccacagacctcaggataagatgaacgcggaattcagggcctggtctcaaccgccctctcccttttcctctcacttagacgaccctggccagctgggccactctccactctcgccccctcccgccctcgtggcctctgtctagaccgtactccctcctactgggtgatgtctcttcccctgggacccagggaccatcccgttgttgacctccggggtcaggggtgcggatgggggccggcccttcccgcggtcgccgccagggggcggcaggagcggctccagatgacagcgggaggccgcaagaggggagggaggaaggaccgagggagcgcggatcccgctctcggatcgcaaactctgagccagagctctccgcgcgcgcctgaaccgctggccgcccgcgcagcccgacgcggaatcggggcacagcgggagcccgtgcagggcgggcgcggggcggctgggcggcggtggcggccgtccatgcggcggcgctcggggctgcccggcgccgggaaccacgcgggggcgaggcgaggcgaggcggccgccggtcgctccgggacgcggaccgccaggtgagcagagccgcgcgccccgcgtcccctgcgcgccgcccgcgcggccccgacccggcttccgctgcccaggctccggctcccgctctctggccggcggggcgggctggcgcgggctacccagtgggtgtgtccggggcgccgcgggctgcgccgctccgggctcggggagccagcgcgcgcctggtccgtgcggacggctgcgcctccttctctggttctcttccttgctgggagtcttgctctgtgctggcgccggcgctcatccctccaccctcgactctagggacagtcttaaactctagggacaatccacctcagtcgtccccgggtcggggccccgtgctccccgggtcgggtcggaggggaccggcgagtgcacacccagcccgtgcgccccccacctcagcctcgcctccctcccgcctggggcccgagagccgggcaagtctcggtcagcgctccttgagtcctggcctggggcctcggatctgtgtgtctgtctgtctcagtttagttgctgcaacccagcgagcgcctggagcccgagtggatgggttgtttccgccaactctggacacttcctcaagtgcagcctaagtacctgcggccccttggcgcacttacagaagtagcttttgcacagcgagctcaccttggagctctacagatctggaagttaagttttctttttatttgaaataacatcagccctcacttgggaaggggattttagggcgttctcgggcccacctaagtatctggaatttgtggtctagtaagttttttaagcagtccgcacccagcaccgtacctcccagcctcctttgccgtcttactaaaagtgcatgcttgcttctcttcctgtctcctttgcgatctctaccacgctgcgcttcgcccttttcgggctatgagtctaaagcttggacgtgggtagcaatcattggatgcctgttggaatttggaattagagaaatagatacccgagagagatctaaggaatcgccttgtccaaccctcctttcacagttggaggcacccaggacccctgacagtctgaagatttttcaaggatcacacagcttttaaaatccgcgtgtcttctacttgattaatattgttggaggtgatggagtaactgggcttactagggtcttactgggtctcaatatacaaagaagcaaacattttaaaaatgtgacttaaaatacggaactcttcaattcctatagatttttgttggcatcatagttgaattcctttagaaaacaaaatcctagccctgaaattaatgtgaggaagcaagcagatgggcgtcctgggactttcctataaatctctgcagggctggagcagggatttcccagaggtctgggcctgggaaatgagtttgggtgatcaggatactggagccccttctgaataagcaactgggttggtttcttgtggggaggctggccagtggaactcatgtgatctcctctgtgcccagcactgggcggggcaccagcttggcattaccttctttttagtctcctatgccataaagaaatatttcttactggctgttagcgaaagaaaaatacagcccagagtttgggaggaagatcaggggtggggagatttttgacttggagtttgtttttgtttttgcctcgaaaaacttgtggagattgcaatcagttatcctacacagaggctgtgtattgccgtcttctccatcccccacatttctctccatggtaccacttttatcctaattgctgggagtctcaatgtttaaatgttcccaacactcccattctgtcccccacatttatagctcattcatcgcaaaatctcttccacattcttttgtgatatctgaggaattatttacctgtctccattcccactgcccccaccttcaaccatgtccaaattacagtaataatctcccctcttgactcccagccacgagttgctttcttcattttaatccatcttctttcatgctgatagattaatatttctgaaattctgatttcaccacatcatttctctcaagaaatcacaatggctccccagtattcacttctatttaatttatctccaacagatatttctgagcgtctgctatgtgccagggactgttactatgtgccagggactgttactatgtgctggagcttacgctatgaacaagacaatatcattgccttcagggagtccacaggctagcagatgataaataaccacccaggggagaaagggaagtaaagaaataaccgcaatacaagggggatgtgcaaaacatcaaggagatgcgaatgagggagaaattgattctgcatgggaggagctagggcagttaccactgggctttgaagcctaaggaggagttcaaggagatgggaaaggctggtggggagggaggacaggccaagcagaggaaagagctcgaggaaagactgaaagataggaaagtactgtatggacacggttgaatccaggttacttttcatcagggcatttaaaatgtttcctaatcccagtctactttattgatccaagagccatcccaacgccttcctgcttgaaggccatccctccactcacccagtctctatcatggtcttatctgccctccccacacctcccatccccagctcagaaattcagatttcccctcttctgatctaaattttgccaggcagtgtatcccacccagcctttcttgcacacactcctgtgtctcttccctgcattctttgtgcctgctctatgttcagcctggatgagcctcgcctccccagccactctgaggtttcccccgagcagcctccttgggcctctccaggtcatggaacacactgtcctcatgttagtggccccagcacacttgaaagcacatgactatttgcctgggtttgacccctcatctcacttttctcttctctctcctcttctttctggttttcccatctttttctttgcgtgtgtatgcagaatcgtgatgtttacttatgcgcagatataaaggtttcatgtgtatttgttgaatatcctcgctgtgaaaatggattaaaaatgttatgctggaagccaacacatgatgcaggctgacgcaggtgaggagaagattcaggggaagctctggctttaggctgctttgctgcctctggccccctcttgggatcccccaattttactcctcctccgcaggaccgctgtgctgaggctgggacaccccttcatcatctaggcctgttttgctctcttttcctcctcctgtcaaaacttacttctgtgcccacagcctcgctggcttgttagcctcactggggccatgcttagtgagcactggtgtgtgcaatgcttggggctttcagtggtttctcttttaatcctcccagccacctagaagggagacatcagcatctgccttgtacaggaagaaagttgaggcttacttgcctgaggtcagcagctcaggtttggagctgaaatcttaaacccagctctctaaatctggtgttctttccactatatcattatttcctgaaacagttgtcttaggaacatctgaatcaaaattcagatctggtgaaagaaaacacaggctccagggtggaagcagggctcgagaactggcgtttttaagattacctcaggcgattcttccgcacacccaggtttggggaccactgccctgggcttcctttacaatgtggttctagcgacaggtggtgggttaatacgccactttatcccaggcagcatgttcctttttgacagaggccctgactttgactctaaggagtgagcaatggagagttgtggccaaggccaggaagagggtcctctcttttggcccgaggggtctttagttcagtcctgaaggcccagccccctcagcttactcgaaggcatgtaaacccacctgccaccagactcactgtgaatttcttttgggacctgagcgagtgctcagggagaaagaccagggtgggtttgttcaagagccccaagttgcttggtttgggaccccccgaatagggctggacaggcaaagccagccccttcctccctgcaggcacggtgagttgaacctcctttcccagaatgggatctggccgttgacagatctctttcattcaactggccttgctccacttcctacccacccagcctcagtttccccatgtgtaacaagaggatggccaaagtctggagggctggtgggggaccagtgcatgggtatgcagagcttaaggcaaagccctaaggcacatagcaggcgctcagtgttagttctcgccccatttctttactctgtgcctgatcagtgcttgagacaattggagctcaatgtattgctgtaacaaaaatgtatatgtaatctcaggccccctcaaatccagggttttgtgtctgaagggcacagggctgaatgttacaactgtgtattcaaacccagcaaatgaacactcccagctgcgcggtgatagtaataatgaattacccatccaacatccctgctcgccccactccccttccccagcttccctttagattgcccaaagaagaacccatggaacaagaggcagcagttttgtgtattgatgcgttgtcttgggaaagtggtctctttctgttgacctcttttcctgtctaccccgtcacccagctgagtgtactgcctatgttgtcttctcctaccagcctttccgaagctgatcactgaggtgtcatcccaggcattggcgcccattagccctgcttctctagggcgtggtccgagggcagtgagccaggttcacagtgccgctgtgtcttgtcccaggagggtggcactgggcaccccacaaccgggtgggcagcatgtggcctgctccaccctcctggcccttggccagctgcctaaggcctggccagcagtgaggacaaaagcacggagtgattaatgggcaccccatctaatctcctgccaggggaaatgaagggccagccatgggctgggagctcgtcatgacctgctccaggtgggcttggaatgcacccagctcaggatggggattaaggcttgaaagacaagaggaaatgagatgttaaccctttaggccttggccctctgagccccagtagggaaatcacaggggaattatctgcaggcatctgatgaaagggggcatcagctttgatttatggtggggatgcagccatgtgactacaggggtgggaggatgacgagctttgacttaaccatttttcttggaggcacagtcaggagagagaagaagattaatttcccatgaaaaaggataaatggactgctgggaggctgccctacctgcttccttcttggaaaccctccgaccatatcagcaagctacaaatttgtagttgccagacatacttttccccctgaaatgtcgcgtctctgatcacttgtgatgtgaaggaagagggagcccacctcctttccccggccaggcagcagcgtggtggtgctgaggaggagagcactctggagccaggtcctgagtttgagccttggctctaccaagttttgggccttgaacaggttccttggcctcttgggctgtagtttttccacctggaaaatgctcaaaactatctcaggcgtgtagaaaagtgccacttgaatgttagctatcacttttttttttttttccccactttggctgagtcctgagcctgcatctcctttgggaagcacagaagcaacttctcttccagggcgccaaggcttgctttgggtaaattgacaactgactctttgattgatctcccttgtttgacccctgaccctcacatgccttggattctgtctggcttgctcctccctttgctccagctccatggtttccagctgcccctttgatgacattaccctgcccctcgtctcctgccctcatgctaggttgtcagactacttgtgggctgggctgtgacatctgttgggtcctccagtggtactggccaattctgcactggctctgctccttgctagctttgttgtgacctgatagtcccaagccaagtggctgagggtagagaatgcagctgtcttgagaggaaaatcaggagccgtggaggccgtctggcctggatgcaaatccccactctgccctgttttctggtttctctgccctctcattgccttgttcttggtgggggataataatagttatacttacctaatgattgacaggaggatcaaatccaaccgtgcacatgaggccgcttgggaatcatgtaggggagtttattgctggttgtaaggtgagccctgagggtagagctgtgtcttcaagttttgaagtctcattacagggcgtgtagtgacagtatagcctttagttccatttagtttcttttccagagcagacaagtacccaggacctgcttgactttagcgatattttagttgaggcccaggatttcattctgcttgaagttcagaggatcttctggtcagctaagcggggaggagctgccattacagagctccgtgtcaggtactgggatttacctgcgttcttttatttaatcctctcaacaacctgtgtgaactagacactattatttctactctacagctagaaaactgaggctcagagaggctaaggaatgttcacaggctcacacagcaagtagacatcagaatgatgtttcaatttcaagtcatctgactccaaaacaaatactggcggtggggccggagggaggaactctcaggccagttagtgagtatctcagtgaggaaaggtctctccctgctctcagcctcttacaggatgctctgtcttcttggcctctttcacatgagcgcatatacgcataatgccactgctaatattgctctgttttctccttgatatcggcttatgttttaatttagcacatgcagatttgtcttttcaactaacaggattttgtgtcaacatttcccacttgccacctaagcagggttcccattttttaaagcacaatgatgcttttcatcattttgctccatcacggtttccttagccattccccaccctctatcagggatctaggttgtttctagtttctcccactctaaaaattggcactaccaacgtgaatgttcaatttgctgatgtttatttatttctgatctcatgttctgctttggaaatacacttcccagccatgtgattaccaggtcaaaagcaagagctgtaataagagtggtccgtgctgctcatggggtcttcagagaaattgcacttgggaggcccagacaagggggacccagaaacagaacaggtgcttgttttctgcctacccttcctttcctcactagttactgttctttcctgaggctcagattggaggaacttgatacctcactcttagcaaggggtgtgagaggtactgttcgagtggtgactttctgagttccagagagggaagttatttcagtgtccacagaggtctcttggagtggaaggtcttggctgcttctgagattgcgctgctgtgcgttagtggtcctgtgtgggcattgctatgcagtcattcactcaggcatccagtgctttctgagcccctactgtgcatcaggtggcagtgccatgcactgtaaagtgtgtgaattccagacctgactctgcatgtgtggctttgggtagattaatctctttaagcttcagtttcctcatgtatgaaatgggctaacaatctctgtacatgccgtaggaattagaggagagagcataggtaaggtgtctgctcaagcctacaatgcatgaagggccaactgttgtgcaggtgaacactagaacttctttcttcttacagatgaagaaggtgtattcttgcctgggagtgtgagaggcggggagtaatagtatacttacagccttagcagcgggcaggtgagaggaaaatcactgtgataaacatgccgtagagaggctgggggacccagacaggcatcagattcagattggtgggaattcagaaagacctggggtgggatctgcctcccaacaggaggaaacaaggttgggggagagggaagagggagaaaggaagtagaagcctgttgtgttttatgggagggctacattcttgaagacctcgcggtattcagatctctcataattcagacttttccccctacagaataaatgtggagcgtgcatttacttgatatggtctcaaaacacatagctttgctttgctgttgcttctcatatggtcgcactctctctcacattgcacagtgggctcactcataaattacccacttggtatctcgtgatgcttttttggctttctcagttgccaagctggtggtcgtggttgttgctgttatcatcaccatcatcatcatctctgtgtgttttcagtctgacaccagcaccaccatttgacagactgtcaagattgggggtccgcatattttcttggaaagggccaaacattaatattttgactttgcaggctatgtggtctttgttgcaactaatcagctttgccttttgagtgcaaaagaagccatagacaatagataaatgaacaggcaggactgtgttccagtgaaactgacttatgggcactgcaattttaatttcatataatttttatatgccataaaatgttcttttcttgatttttattcaatcatttgaaaatgtggcaaaaacaggcagagggtcaggtttaacctgtgggccagagtttgtggacccctggtctagacgcttacaatatttgaaaattgttttaaattgtaggaagagtgaatgttaaaatatcctgatagtcaacaaaatcattcacggacattccagtgctcataagaaaaatgcttaattcacaagttctgtcaaaagattggggtatttatcagcttgaatggtaccaacataggcggttcctttaatacaattttaaattatttaggtagttattctagtgaattaaaaattttaaatcatattatttcaaaattttggtacccaataaccttattaatattgttattgtcattctatttcgtgacttaaattgtgtaccctggctaggcacggtggctcatgcctgtaatcccggcactttgggaggccgggatgagaagatcgcttgagcccaggagttcgagaccagcctgggcaacaaagtgagactccatctctacaaaacatcaaactattagccaggcatggtggtgtgcacctgtggtcccagctggtggtgtgcacctgtggtcccagctacatatatgggaggctaaagtaggagaattgcttgagcccaggagttttgaggctgcagtgagccatgttcatgcaactgcaatccaacctgggtgacagagtgagacccagccagaaagagaagagaagaggagagaaggtgaagaggaaggggaaagggaaggagaaaggaaggcaaggaaagggaaaggaaaagaaaagagaaaagagaagaaaagaaaaaattttataccctacactggtttattattgtgtactctcctggagtccagcagctctgcctgactcccaacagcctgctggctggagtttggaacttgattctagctggaatttttttattgtaaaaggcaggcgagagcatagacggagcaccaaggcttgtgtctggcacacagtgaatgtggaataaacttttgctccctcttttcccttttctttcctcctcactcaaaagttctgtatatttggtcagatccaaaacatgctgagcctctttgaaattgttactttggttctttccacatgcaataaagtcactaacctttttaaatggaaacaaaaacaaagactgttagaaagcagagtttcccctcccgggtcaccagctttcccttactggagaataagcagggctgtgctgagaccgcggctggccagccagggccagagggaggccccaggtccgaagaaggcgcctccagctgggtgcagacccagctctccagtcaggaggggggcgccaggcctgctggctgctcctgggtgtatcttggtttcagagattccaacagtaggaaagccagaacctctccagatggaagaccaccagccccgaaggtgactgtggtgctgtggttcttggctcgggaacatgtttttgctgtgtatgttggatgggagacccgtcttaagtagacgtgtgtttgtgttgtttagggggtggtggcgcacagccacatgtgctttctggcctggggtctggcaggatgtgaagggaggcagccgctcgctgtcctttggctggtgagatctttcattattctgttgggcagggggctggcattcttcctgtgtgtttggtttagaagcgagtggtcttgcagccaagggcatgggcgttgagccccagctttgtcactaacttgtttgacgtccagcaatccatttccatctccgggacactaattcttcattcctactggcgtggtcagaggaggcctagtggacagtcagggctcttaccaccacccagcagtaacgaagccatgcatccctctgagcctccctgctgtggtaccagcacaggccacaggaggctctcctgcccctccaagccagggacatgtcattggggacctggtggggagctggaactcccacctctacccagaagcaatgacgactcccctttccccctcgggtgttactagaggccaagtggggaacctggccttctgttcccacgtggccatcatgttgggggcccccttccttgctggagcagtgtcagaagaagccagggaatagggaaagtttaaataagatctagcacctcataccataatacctaaaatgtccaggtttcaatggaaaatcactcatcacactgagaaccaggaagatctcacactgaatgaaaaagacaatcagttgatgccagcactgagttgacagagatgtgggaatatctcacaaagactttgaagcggccatcataaaaatgcctcaaggagcaattatgaccatgcctgaggcaaataaagaaaatataaatgagaagtctcagcaaagaaatagaagaatcaaatggaaattttattttcaaaaaattgtaaaacattttattgtagattgacaatttataactgcattatattatggggcacaaagtgatgctatgatttatgaatacaatgtggaataatgaaatcaacctaacatattcctcacctcaaatacttatcattttttgtagtgagaatatctgaaatttactcttaggaagtttgaaatgtacaaaatactgctattaactattttcactgcactatgcaatagatctcaaaaaaggcttattcctcctgtctgagtctctctaccctttaaccataacctcaccattgcccccaccctccagcctctgtagctaccattctactctttgcttctgtgagtttgatgttttagattccacatataagtaaaaacatgtggtatttgtctttctgtgcctggcttatttcatttagcttaatgtcctgcaggttcatccatgttgtagcatgtaggattttcttcctttttaaggttgaataatgtcccatcatatgcataggtataccatgttcatctgttgatggacacatagattgattccatgacttggctattgtgaatagtgctgcattgaacatgggagtgcagatctctcttgacaaactgatttcaaatcttttgggtaaatacccagaagtgggattcctagatcatatggtaattctatttttagttctttgaggaagctctatacaattttccataatggctgtactaatttacattcccaccaatagtatgcaagattttctttttctccacatactcaccaacacttgatttattttatctttttgataatagccattctgacaggtgtgagatgatatctcactgtggttttaatttgcatttccctaaaggttagcaatgttgaggatctttttatatacctgtgggctgtttgtgtatctttgtttgagaaatgtctattcaggtcctctgcccattctttaattgggttttttattttcttactgttgagttgtttgagttccttatatattttggatattaaccccttattggatgtttggctttcagatattttctcccattctgtgggttgtctctttacactattgtttcctttgctgtgcagaagctttttagtttcatgtaatcctatttgtctatttttgcctgcacttctggggttaaatacaaaaaattattccaggccagcgtcttgtagtatttctcctatgttttcttctagtaattttacagtttctagcattacatttaagtctttaatcccaaatggaaattttagaatggaaaaatataataacaaaaataaaacttcactgatgggttaaacagcagaatggagatgacaggaaagaatcagtggattggaagatgtaacgatagaaattacccaacctgagcaacagatataaaaatagactgggaaagaagaaaaaaaaaaagaatagagtctcagggacctgtaagactataacatgtaatcccagcactttgggaggccgaggtgggtagatcacctgaggtcaggagtttgagaccagcctggccaacacggtgaaatccaatctctactaaaaatagaaaaatcagctgggcatagtggcacatgtctgtaatcccagctacttggacggctaaggcaggagaatcacttgaactcgggaggcagaggttgccatgagccaagatcacgccactgcactccagcctgggtgacacagtgagactctgcctcaaaaaaaaaaaaaaaggctataacaaaagatctaacatttttgtctttgaagacaaaggaggaggaaaaagagagtgggatgaaaaactactcagtgaaatactggttgaaaacttcccaaattgagcataagactcaaacttagagattcaagaagctgagcaaaccctaaatagaaagaaagttataccaagacatatcatagtcaaacttttgaaaacaaatttgaaaaagaagaataaaggagggggaatgagtgtttctggttttaacatgtacatagctataacaatgaagagagtgttgtattggtgagggaaaggcacatagattagtggaatactatagacaacctggaagtacacccatctgatttttgacaaaggtgcatagggaaatcagagaacattaattgcaattatctggatgatggtttagatgaggctggtggaggaggctggtggaggatggagaagaaagtacatgagagatagtacaaaggaagaattgagagttggcaagagactgggcccaaggcatacaggagagggtatcccagaggcccaggcaagctttgagagtcatttcctggaaggacggttatgccaccgctgaagaaggagggcttagcatgagctggtgacggctccttttattcaccttgggccatcagcagcaggaggaaactcgaagtacagggaagctgcctgaatgagcgtgcaggtcttgaggtgttgagtttttgagaccttagcatgaaataataaagaggttggagtgtaagagtatttctccagagtacacagtttgatagtgagggttgcttattgttgacatttttctagttctggtttgagtcatagggagagccaacaaggaagacagaagagacaggaagagagcaggtttgtagggcatcgtagccattgatgacaaagttcaagaaaaagggggatagtgacagcctattctttctaaacctaaatgccctttattgtccttcttgacctctgggggacccttgacctccaaggatgtgcctctcttggtttccttgaaaacattttctaatttatgtgatgactgactttttcacattgtcataatcttttaatcacagcacctgattttagccttacctaatactggcccatcacagaattgtgtcaaggaagtcagactaatttgctaggtttctccctccttctgtaaggatagacagagttttttggcatacgttgcacagtggtgattgctacaaatcattgactagatttctatcacttaaaaaaataatgacataactcaaacgtcaatgcgcaagcctcaggagcagggcaggatgaggcagatcctttcccttgatattcagaagcattgagggcagcatgtgtggttggctgatttatggtggccgaggcacactgagttgggatgttttctggatggtcaaatgcgtggaggcactgagaaaatatcctggactcaagggcggagctgttccagagtgaatggggcagagcacaacctcacaccctacatcttgcctggcaggggcccaggctgcagcctgcatgctgtgtaccaggtaaatgtgaacacaggcaactctcctgaaaaggtacatttgatgcagtgtgtcaggagactcaagagacagtttatttttatttttttgagacagagtctttctctgttgaccaggctcgagtgcagtggcatagtctcggttcattgcagccttgagctctccggctcaatcgatcctcccacctcagcctcctgagtagctaagactacaggcatgtgccaccacacccagctatttttttgtattttttgtagagatggagtttcgccatgttgtccaggctgctctcgaactcctgagctcaagtaattctcaaccttggcctcccgaagtgctgggattacaggcatgagccactgcgcccggccctgagaggcagtttaatttagtgctaagacaagccatgactccaacaattaggtgagcttgcattcaaatcgtgctgctgccacttactacttgtgtgactctgagtaggcatactgttttaattcttacagcctcagtttccttctatgtaaaatggggataggaatagcacctgcttcatagggttgtctttagaattagttaatgtttaaaaagcattcagcacaacctgtcacatattatacacctaataaatgttatttatttaatttttttgagacggagtcttgctgtgttgcccaggctggagtgcagtggtgcaatctcagctcgctgcaagctccgcctcccgggttcacgccattctcctgcctcagtctcccgagtagctgggactacaggcgcccgctaccacgcccgtctatttttttgtatttttagtagagacggggtttcaccgtgttagccaggatggtctcaatctcctgacctcgtgatccgcctgccttggcctcccaaagtgctgggattacaggtgtgagccactgtgcccggccaataaatgttaacttttaaaatctttagtcctagctttgcctctaagtagctgtgataccttgtaccagtcacgtggtttctttacctattagtttattcatctttgaatcatgatgacaaaataatgacattggggagttagattagaattgcccagtttttgtgtgtgtaggtttgctttgggatgagatgtccagcagaaaatcacaatggaaataattgatttaaagacactaaataaaaatgtatttatttaataattataaataaaattagaagatgaaaagcaaacgaaaacaaggtcctaacttgacaaaataagggctaacaatgttaatgaagaaagagctcttaaaaatcatttcaaaacatggccgggcacgggtggctcgcggagcgagtctcacagagcgagactccatctgaaaaaaaaaaaaaaatcatttcaaaacattatgagccctatagaaaaatgggcaaataaggttgtaaaaaattcacagaagagacagtatacatgactaataaaaatgaaaatcgattccaactttaccaataatcacaggagtacatgttaaaatgacttttaccattttttttccctattgtgacaaacactggctagtttttcaccagaagatttcctcctgggaacagagatagactgtgtttcccacactcctttgcagacaggtatactgccatatgactaagctgggtaatggaatatgagtggcagtgatttaagctaccttagtgaagctgctagctcagtcctctatgccttctctttccccttgtttgttcatggaatggaaagaacccaggtggaattccacccggacgatggtggaatcactcgatggaaaaagggtccccagatgcctgcatgactgtgtgaagtagaatgttcccgacaacctgcatcagatagtgacttgagcaaaaatccttttactatgttaagccattcacattttgagggggtttgtggcagagtaaccctaccctaactaattacttatcaaattaggagagattgcaatcatagcattattggcaaatgtgtttatttcatccactacatgtgagattctaggttgatacaattgtttttgaaaataattcattgtgaaggaccttagtcataccttttggcttaatgatttcattttttaggaatttatcctaaggaacaaggaagagtagcaaataaggaattttatacaacggtgttcatcatattttccaacaataagggaacattattagatgtgttatcaggcattcatagggtggactattttgcagtgattagaaatgattttgaatattactaatgagatgcttatgaggtaaggtaaaaatagaatacaaagctacatgtgtgattttgttttgtagaaatagtatatgtaaaatatgcagatgatatgtataagcattatgcatagaaaaaataaacaagaacatcaaaaggtttaatggtgttgggttattaggtaatacaattacaattacaatgagtaattttggctttcctctttgtatttttctgtagtttcaaactttccttaataaatagatttccttaataaataaattttatagacagatttatttccagaagaatacctcattgggtgtgttccactcagccctgaatcctcaccttgtgaatgaatgtggtgtttactgtgtttattcttttagtgtcagtgcacttgttacaccttccttccccaacacacgtatgtgtgtgtatgtgtgtacgctcatgcacagatgtacacacgtgctcaccagagtggcaagaggccatttgtaggcagcagaactgaggccttgtattggaaagcaggaaggaaggcctgagcccccagctgccttttcctcccctggccacctgcttttggccaaggcagctggagaatattggtttttggaatgagatgggtcatcatctcggagaaagggcagcacatcagaaaagctgcagctcccatgcagagctcagccgtggtagtctgatgttttttcctttggtagctatgacccagggattataaactgctcttggcagcggatgctgggaagaggttgagtctgagagtggaggaaggctggagtgtgtctaggtgtctttgattcctaggtagggtgacctgcatctcatcacggctgtttatttgtgtgttgtggtctttaggagtagggtggagaatgtcatgttaatttcagaaacagcagaagaatggagtggctgtttggatcctgggctgcgcagtggtgcctcagacaggcagcacaatcctgcatggaaaagaaagcccccacctgagtttgaatggaagacctttctgtcatcgggaacacctgctgcaccccaggtgctattctagacaccagaaatataacaaataagtctttgaggaagaggtcctgtgttgtgagggaggaaagacaagcacaaatcataatgatacgctttgacgatccctagttctgcatctgagacttgcacagaagcagaaatttaaccaggttaatcaagtgctgtaaatcaagcaacgaagtcagtcatatctagggaagaaaagcgctcttactccaaaggtttttccccactttgatctgcagtatcatgtcatctgaaattgaaaaagcaactttatacagaagcaggaacaaatggctcatttattttaagtatcttacccgcctgatatttctgcccttgaatattttctttagttacctgggaaacgtttttttaggactgaaaacagatataaaccacaccactgttaatgaccatgaaaatgatgcaatttgcattgaaatccttaactaatctgtgctgattacctaatttctccaggtgaggacggagaagcacggtgttttccttaatgagtaacaaaacccactgtaatgtgtttgcttgaaagctgccagggagttttaatagatcttctcaaggtttagtcctaatccagattctgtgggttttcacgctgctctgggcaagccagccagtctgcagtgtgggggttccatgggaagaaatgagttctgcagctgagtttggatatgacaggaacaaaaaggacagcctctgtgaggtggtaggagaaaggactgtgagccaaggacatgttgggggaacattcctctggctgtcctcataggcagggagcagctggaaatgtgaccgggcctggggctccaaggtcagcgtccctgaatacttctggcctggggcaggatttcctgaaagggctgtgacgattgatgaccgccaccagagagctcaggagggtgggacctccacagaggcagcgtgcatctgcagtggcttagcgccttcagcgccttcattctcttcctagggcagtctagacattggctgaacattggcaaaagcagggagagagaaatcacatggaggccctgctttctaagagggaaaagtctgtaagaaactcgtgccgttcattcttcacccattcacccattcattcgttcatccattcatttgtccaactgtgattgcatgcccgccctgtgtcggcagcatgtctaatggaagggcatttgtaaagaggactgaaagagtctacctttaagaagcttccctgaggaatcgccacactgacttccacaatggttgaactagtttacagtcccaccaacagtgtaaaagtgttcctatttctccacatcctctccagcacctgttgtttcctgactttttaatgattgccattctaagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaaccaaacaccgcatattctcactcataggtgggaattgaacaatgagatcacatggtcacaggaaggggaatatcacactctggggactgtggtggggtgggggtaggggggaggggtagcattgggagatatacctaatgctagatgacgagttggtgcagcgcaccagcatggcacatgtatacatatgtaactaacctgcacaatgtgcacatgtaccctaaaacttaaagtataataaaaaaaaaaaagaaacttactaaatgacaaaaaaaaaaaaaaaagaagaagcttcccatgcagtgaggggcaagtgtaaacaggtatgtctagtatctattaagggagatgatctcctctctttcaacttctagactctcctgtgcctgccattgtcagctagcaagtctgcccaccatattgtttatgaggatgatttaaagcctatgccttcctccgtttttcccacttgctgtggataatagccatttattcagggggtaccttgaagaaataagagcatccctttttctgcctcttgcttttgggccattcttcttggcagccttctccagccaaagctctttctccaatgtactgagttttctcagatgggggtggaggggacactccgcacatcttgtcctgggcctgcccccacctccatgcattatggggcagcctcctcccaataacttccttggcttccacctccatgcttgccccttctcctcctcccctgttggctctgagggccttattggatccccggtcctgtcctctgtcattcacactgggctctttctccagtatggggtttgttcattccccaaacacacaagtcctttggttttttgtttagtttagttttttttttttttttttttttttttaagactccagaagctttcctgtccactcaaccaatcatctttccccaaaccccgttacttatccaggtgctggttccctgtgtctgagctaccctagacccgctgtgtggccttggtttgttgtgagggttgtatagcatgacttacgtcccatctcaggtgggacgatccagtaaaagccaattcccgactcttttctcatcatgcaagaaaaaagtggtttggaactgccctgatgtcgggagccaacgtcctgatgcttttatccaccaccacctagaatgtcagactggggacggtaggggcactgcgaacagatggtcaaggttgcataaggagagtttgcgtaaatgtcagcaggacaggagagcatattggtgatgttggtacagacaggacaaggctgcagtggtggaggctcctgtcttgccctgttgggaccctcagaggcagctttcctaggcaggttctgagaacgtgtcctcaccacatgtgactgggtgctggatttggggtctggagctacttccttctagcatctctggtcctcattccttgccagtgagtcacttcccctccccagggatgagtgcttttgtttgggtagttgctttaggctgcgggagttccagaggacagcgtgtgtaggagggagggagggagggaggtggaactggcgcctgcagtggggccttcctgaaccccgacttgagagactgagcagatccttgtcttctgaggcatgggttcctccaggagggggtcctccaggagttctggtcaggccctgaggagaaggggcaggaaggatactcagaggtgggcctgtgtgtaaggggcggcagaatggtgtcatagttcaggcagcatggcatcccttcggctcagggaatccttttccacccttagtttgatgatcctgaccctctgtctgaccccaccgtcctgagccttgggcctgctgctgcctcctcctggtgtgtggggatggccactttggcctgaaccaaatcaggtgactcattcaaccttcctgtaggatctttgtggaagggagagaaggtggggcctccatctcccaaggagcatatgttctaacagaaactagattgttagattttttgttcactgtgaagaaaggttataaatcaacaggagcaaacctcaaaaggcggacagagctccgcagacagcacgtgtgctcagccctctcggtgcacccttgccagacggatatttgggaaccctcactctttccaggtccctccctgctctacaacctacaatggctctttcttgcccatcttgtcaacattggcctggcgccacctttcagggcctgagataatgtttggctttgccttggcttctaggtttaattccccacaatcacagttctaggcctccgctgccctctggtcttccagaatgaggacttttaaacttttctggctgggatccacagtaagaaatacccttattatgcgtgatgaatgcaggtatttttttctcttatctttcattcttttttacttattaaaaaatgctgttcgtgacccaagaaattaatttcatggcagactcatgagtggtgacccccagtttgaaaagcagggctgatttaacacaatactaatcacggaagctcaagtaacagccaagaagaatggcagagctggaaactgccagtgcaagctcatcagccgtatcctgagggagaagtgaccaatcaaatctgataagaagttggtccaaaaacatactagagcagtggcctccaataattttttttgattgcactgattgtaacaatttttacatcagtaaaaaaataagcatacaacttcaatatatgtctggttatttattttgttactatcagcagtaaggttgcaaatctgttttcaaaggttttgataatttcagatgtttttccggttgacatcttatcagatctgttcaggcagtctcctcactctggggacaactgctctcccccaaaccttcttcctttcatattgcccttcctttcctgacacaaccactgtatcagtctgttctcatactgctataaagatctacccaagactgggtcatttataaataaaggagatttaattgactcatagttctgcatggctggggaggcctcaggaaacttacaatcatggtggaaggggaagcaggcacatcttacatggcggcaggtgagagagaacaagcaagagcagggaaagctaccttatgaaaccatcagatcttgtgggcactcgctccctatcacaagaacagcatgggggaaattgcccccatgatccagtcacttcccacctggtccctcccttgacacgtggggattatggggattacaattcgagatgagatttgggtggagacacagaaccaaacattgtcaaccacaaaatctccatttgctccttctgtcccccagaaatctggagggagttgtctttgacacctctctttctcttgtcacctcaaccattcacttactgtgttctggggacttgactgcccagtagacagtcagctcttcccaccttctcctgccacattgcttcctttttcctcccactcctcacaagagcctccctctccctgggatgcttccctcccccctccacaaggccaactcctactcacccctcaagccaccacgtataggccactgcctcagagggatcttctctgatcactgcccagggcactttctgaggcaccttggactttcatggctcttaatgcaattttatttttatacttatttatgatttagtttgtttaaagagtgtagttctccagcatcgaggctgtaatttcttggtgtgtgtgtgtgtgagtgtgtgtgtgtgtgtttgtgttcagcactcaggccatacagtctagataaatatttaatataacaaccctatgaggtagttacaaacagtatccctcccccccccattttacagatgaagaaaggttaattgccaaaggtcagctagttaataaatgtgaatgctagcctcacacccatttctttccaattacagtgtgcacacttaccaacaattctagatagttgatttactatctcattaggctaaggcttgaatttaagtcccatctaccttgcttatgccagaccatccctctacagcgattctgctagtttgagttgtacttagggtctgaatgaacagtttaccctgtgttgttctggataataacaccatcattttccccatggttcatctcccagaccattcccacagcactggagaggacctgagcctaccacctattgagtaaataattactgattagttgatggttatcagggacttggcaaagacttcatttgacttccaagttaaatcccctgacttggtgcagacctgttctgcagccaagagcaagaagaccacacctctgattcaaaggcattttaactgttccaatttgcacttgttggccttcttcctggtggatctcagtgtaatttctgactgagagccaagaatttaagggtcttcaataccaggagtaatttcatgagttgctgatggctaattagggatgattacagttaagaggctttactttcttaataacccgcagaaagggcctgtggtaacttaaaatcttgattctttttccctgagaatggaattgtctggttctcatgactatctttttgtaaatccttgtcctttattttcccacccacattttctggtgaaaaggaagtctgaagtctctggaagaaacaagaaaataatgatcttagagaactccacctttattagaaaggatccctggcccaccttggaaccttgcttcatttgtctttcccttcaaggagttgcagcaggagaggagactgggccatgttctgttttattctctaagttttactacgttgcaaccaacccgcccatcctgggctttctgttgctattcataacttgcctttgaaactattggctcacttgacaatttttagaaattttgtttagtgagggcttctgaatgaagtagtatttatgggcgagagattttacctccatgttttcactgtgacaacgtattttaagtgttgtttgacctcttcttgcatcaccatattagttcattttgcattgctataaaggaatgcttaagactgggtaatttatagaaaggtttatttggctcccagttctgcaggctgtacaagaagcatggtgctggctggcatctgcttctggtgaggacctcaggaagctttcaatcatggtggagaaggaagggcagccagtgtgtcacacggcaagagagggagtgagagagaagggaggaggtgccagactccttttaggctctttttaacaatcagatctcaccctaactaatagagtgagaactcactcattaccacaaggagggcatcagggcattcatgagggacccacccgcatgaccagacacctccaatggaccccacctccaatactgggaatcagttttcggcatgagattggaagaggacaagtatccaaactctcagtatcatcagagcaaccatttactgagggtgacgctgccccagccacagtctaagcatgtcacatgcgttccctcatttaatctttataacaacctgcaggagttctttagacagtattttctaaataagttttattgagatataatttatttcccatacgtttcacaatttcgtgtacaattcagtagtttttggtatattcgcagggttgtacaaccatcaccacaatctaattttagaacacatttattactccaggaagaaacactgtaccctcccatgaactcctcccaacccccaatccctggcaaccaacgaatctactttctgtctctatagatttgcctattctaggcattacctataaatggaatcatataatgcatgctatttttgtatctgactcttttcacttaatataatgttttcaaggttcatccccattgtagcgtgtatgagtactttatttctttttgttgttagacaatatttttactcaacttgcactgttagggaaaccaagacacatgaatgtgacatgacatctatggtcaaatagcctgtaatagatggggctggatttccagcacaagtgtgcctagcaccagctcccctgttagctcagagtctgaggtgatcgttctgatagtaatttactgaacatcttctgtgggtcaggcactgtgctggttgtcttgtaaacttgttacctcatgttcataaataatcagatttcagttgggaaatcctgggaaccataactgggcacttttgttttagtatcttccatttgctcatttctggttttgttgaccgagttacgcttctagaatcttcctaagtaaatgttgctaaaaataacattgttcatttccataggacttgaacgcaactcccaattgcagaaaattggcaacgtctctgaagagcccttgcttttgcctggacccccagcatcatggtttcccatttcatggggtctctcaggtaagtgaagaaactttttttaaaaaaacaggagaataagaaatttgatatttgcattttactctgtcatttcttaaagtaagtgatcttaagggtctgcagctgactgatatttttgatataatacgtccacttgtgtaaaagtttgctattcagaagggcctccaaggccttgggagctgtgtgctgtgctgagtggcttggggtcgaagtcaatctactatcttctgggagaccttctgtaggcttcaagaaaatttttttaggccggatgcagtggcttacacctgtaatcccagcattttgggaggctgaggcaggcagatcacctgaggtcaggagttcaagaccactctggccaacgtggtgaaaccccatctctattaaaaatacaaaattagctgggcatggcggcaggcacctgtaataccagctattggagaggctgaggcgggagaatcacttgaaccctggaggtggggtcagatcaatgtatatttaccgtggttgcataatacaattttctaaagaacttaaaaaaattgttctctggttgcaacgccatagattttgactgaatctggtattttaaaatggtgctctctcttgtcccttatgtacaaaacatttttgactttcacctgcgttttaaaattcaatctttatatcaaccatgcgtggcaagttgagtaagtactattatcccttttgtgtagatcagaaaaccaatgctcagagagcttacatcatggctgtcaccttcctttatgtgcagagttagaataagggctctgagcattgcaactgtagtccatgttatcgaagttgttttcaaactttttaaaaaggctgacagagccttttaaaaattcttcaatcaaaatcctatgcaaaatctcaatatataaaatagacaatgacagtattttattaatataaatttactttataagtttaaatttataatatttatacattatgagatcaatgcattaattttgataaataccgacatttgaaatcaggatttatggttggcagcttaaatatctgcccaagcatctagtttattttgcagctgttttagctgtgtagcattaagaaaatcctaacccattacaggtaagtacttgcaattggtaacaattctgtgatgaagctcatcttactattttaggatactatttaaataaattgactgagaatctggaatgaggggaaggaagaacgttttgtttccaagttgaatcattatgatatcttgtagtcttttttccatacctgtacattagtcccacatgcctagaacttataacagaaagtaaaatggtctgtaatatatagcatattacatatgatggtgccacaggtggttggccaaccagggctagagcatttgccaagcagatgcccttgggctaatgcctggcatttaactgagtgcagtgcatgtgtgtgagctttagtatgtagttgcttgtataattttacatgggcagacgtgtgcaggcctgcaatccaaatacccgcagagaactacaaacctctttatcaatgacatattcacatgcatgtcagatatggtcagaaaagaaagaaaaagcttcattctgaaggctgtatgatattgagccacgaggaggacagcccaaattaacgtttggtgatctcttcaggatagaagttggcatctagtacaaattagcatgtgtgcttttttaaaactatagtttaaaaaagagtttaaaagatatttcaagacatgaaatatgcatctagtttgtggaagttccaaaatactgttataaaactatagggtagtgagaaatgcagttggcccacagggtcattgtaggaccatggcattttaagcacccaggaccccatgtaggacaaagaagtggaggtcacagtcggttattgaacttattcgaaaagggcaagcagattatgaaaggtaggttcgccatgtgctaagcttgtgtaagtctggctgtcgtcaaaaaggcccctaaaagtgcttgaggaccctcaaaaatgtggccacccaggctgcacaggcagggagtttcttgggaggaaatcccttttgcaaagttttttcttaatgtcttggatttttttctttcttttttttttctttctttttttttttttttttttcaaaagagacaggattttgcttatcacccaggctggagtacagtggcgcaatcatagctcactgtaaccttgaacttctgggctcaagcgatcctccacctctgcctcccaagtacgaatagccatgtcctggaattttaattaatgcccctgcaaacagtctcctgtaatgatctgagcagggtgtgtggtatggagatcatctccctttgcgggaggcctggggaactcacctctaaactgtgcattatttcaaggaaattgcccacagaagggaaattagcaggatgggagtagttgaaagctagatgctacccttgtggtggagctctggaagccttgacaggcctccagcacgagagtcctgctgcagggattgtttgaacagagctgctcagcgggacattttgccaagaattctgctgtcaatactagaggaagaaaatgtgaattatgaggacagctgattctttaggagatctcagcttgagattcccatcaaactcccttcttcataaaccaggtgcacatcaaccattttgcatccctgtttttagggccatgtaaatatatttttaagagaaaaagaagcaaaagtagagtgtcttctgtttaaatgcttttcagaatgttatggggaaaagggctgtgggttacttgaagcgtgagaggtctttgacaaaagtggtagatgagaagcacacacagacgcacacacatgtgaagggatttttaatatttatcaaggcaactaaatacataaagatcaattggagaagctggagaatttctctaccttaagagaaaacaggttaaaattaggaattagctgccaagaaaatccctgaaagaacatttaaggggaatcacaactctgatacacagagatttcatttaaaaacccctccccattttttgccaagccacagagaaacagaaaaccagcttccttctcattgaaggagacagagaagccttgggcattaacatcgcaagagtatctctgccttgctcagagtgtgtagtaataaaaagaatcacagttaaacctagtagcagaggaggcactaagattctaactctcgatggatctggttgggaattatcattgaatcttggacaagctctggatgccatgtaaaattcagggcaatgaaagtccatgtggaccaaagtgtaggctaatccttaatgaggaatgtttgtcacctgttaaaaattagaaaggaaatggcactaaatgatacagaattatttatgtttcttaaagacttgctccaaattatgcacttttttttttttggatgcacaattacatctttatttgtttgttcagtgagtgataggaaggaaacataattttgtccctagaacagtacaataaatgctgatggctacctgacctggccagccaacaaaatctctggagccagtctgcttgaccaggtgcttcttcctttacttcaaggagtgcttttgtatggttgacgtattttatatttcaagtgaaagcaaagagaaaaacagaactatcaaatgccaaacaagtagtgaaactggcaggaaataaaattgattttggtgatttttattttgaacagtagtttttgaagaattacagatgtaatgagagtgattacagagttagaaggtgatttttatagatcttatgagggagacttctggattattttaagggttttataggttgatggccctag

SEQ ID NO: 379 - DNA, 4951 bp, Homo sapiens
gaccacgaccgtggactttattcatgtccagcagtgaagtctgtggccccggccccggccccggccccggccccagccccaaccccaaccccaaccccggccccggccccggccccggccccagccccagccccagccccagccccagccctccgcagggcccgggcagcgtcttccgtggcccgcctgggcctgtggttgtgcgggaggcaccttcttagggcctggtcctcagtccagctcccagggcctggaggcggggatgggtgggacggtctaggaggtggggcttgggtaggttggcctggcctagagctggcccgtcagcccaagtgggcgtccagctgaatctaacacctctgtttttcctgcacctgacccctgtgaacccagccaccctgaggcaacgctgtccacagaaaccaggatgcaagtcccccagtgcagcaggcacaggaggctgcaaggcagggccatcgccaggggcaggtaccccaggggggcccacaggctgcctgtagatggaacagggaggccaccatcagtcccaccagacgctacccccatatccaccccctagagccagacaggcctgggcagtccctccctctggctggggagggtggggacagccagcgaggacacccacctgcggctgctctcctgggacccaacaaaggtctcaaagtttcccctgctcccactttctgctggtcagtgggttttaggagaggcagctgtatctctaactcagtggtcaatgaagggtgaagcagggttggccagcctcatcccaggaggcaatggacaaagctggtggacaggcctgtgggagtggccacgaggcggggacgggtctgagagggccctgggcagagggggccaagccggaggggtgcgggggccatacctgaggtggaggcctgggcatcgttcgtgggcaggcccgaggtgtggaccagatggagcacttggtgggtggtgctggggggccccctggtgccgtgggctgggccagtggggctggtggggctggcgtccaggccgagctggcccagggtggagctgttgaggctgcgcagccaggccctgacggtggggtggctgcgggccttctgaaggtctcccacgttgtggcccagcagcgcagtcacgttgccaacatccaggctctgcggagaggggtggggcagaggggccgtggggccaacttctgggccaggggaagacccacagggtagggccagacccaggatggggcagatggcgggagtgaggcccagaaacggcctggaggagggaagtgggggtatgctggctgtgacctgtgacctaggggctcccctgcctgggacagccctgcacccccacccccacccccacccccacccccacggggtagcccagccccacctgcagctcgagggggttcaggctggtgaaggtgtcgatgtccatggagatgttggcgtgggccaggtgccgcagctcctccaccggggcgccgcctggggggacgggtgaggggggctgggctccaccaggggagccgcctggggggacggggtgaggggggctgggctccaccatgggagccgcctggggggatggggtgaggggggctgggctccaccagggaagctgcctggggggacggggtgaggggggtggggcttctgggggaggggtgcccacccatggacagggctcaccgaggtaggggcgcatgaggcggtagtaggcagctagggtcccgctgctgccgaaggtctcatgggccttggtgtagagcacgtccttccggctctgggggcaggaggagaggtccagggccccggccagcctgtgggaggcgggaggctgaggagttggtcgccagccccccacccttccaacgctgggcatggccctcccttcccaagccacagctttcctctcaccctctgtcctgggggaacagggtcccccaaattcacatccacccagaacctcagaatgtgaccttgttgggaaacagggtcattgcagatgggtaagatgaggtcagactggatcaggtgggccctaaaccaatgactggaggccttctaagaacagggaaagctgagggctgggtgcggtgctctcacctgtcatcccagcactctgggaggcctgggcaggtggatcacgaggtcaggagatcgagaccagcctggccaacatggtgaagccccgtctctactaaaaatacagaaattagctgggcgtggtgggcgcctgtagtcccagctacttgggacgctgaggcaggagaattgcttgaatccaggagacaagagagaggttgcagtgagccgagatcacgccacttaactccagcctaggtggcagagtgagactccatctcaaaaataagcaaacaaacaaaaaagggaaatctgaggctgggcgtggaggctcacgcctgtaaatcccagcactttgggaggctgaggcaagaggattgctctgaatccaggagtttgagaccagcctgggcaacatagtgagaccctgtctcttaaaaaaaaagaatacgaaatgtggacacagacgggggagagcgcagcgtgaggatggaggcagagctggggttgatgtatccataagcccaggggcgccaaaccttgtcagcaatgccagaagctggaggaggcaggaagggtcctccctgcagggttcagagggggcggggactgccagcaccctgatttcagacctctggcctccagaactgagagaatatatttatctttaaaattacccaatttggccaggtgcagtggctcacacctgttatcccagtgctttgggagaccgaggagggtgaatcgcttgaggtcaggagttccagaccagcctggccaacatggtgaaaactcatctttactaaaaatacaaaaattagccagacatggtggtgggtgcctataatcccagttactcgggaggctgaggtgggaggattgcttaagcccagggggcagaggtggcagtgagctgagatcgcgccactgcactccagcctgggtgacatagtgagactgcctcaaaaaataaataaataggccaggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcgtggtggcgggcgcctgtagccccagctactcgggaggctgaggcaggagaatggcgtgaacccgggaggcggagcttgcagtgagccgagatcatgccactgcactccagcctgggtgacagagcgagactccgtctcaaaaaatgaataaagtcacccagtttgtgtactttgctcaaagctagagtccagccagggcagccctgggactaatgcacccctgatggcctggctgagctgcactccctggcctcagtttcccctcgcggtcctccttggctgaggcgggagctgcctccgaggcagtggggggttggggttgggtttggctcaccggagctcctggggatggatggtctggatctggtgaggactcatccagcacaggcgggtgcccccgatggccagcagcagggcaccggagactgtgccattgtgctccagaaacttctgcagcacagcctgggggcagagcccgggtcagtggggcaggctggggcctggggccacccacctgcccgcccacccaggtgccctcacctctgtctggttctccagggccacgtcggaggccagcagagccatgaccgtgtcctgggaggtgatgctccactggccgatctcggtgcgggagtagaggtagaccagcgaggtgatgagccgcagctgatcctccgggaggccttgtgggtagatctgagcaggtgggcagggctaggcagggtcagcagaggtgccgcgcccaccggcctccctgtccccacagcccagccgtgcacctgtgcgagcttggccttgaccacatgctggcactcagtgggcagcaggtgctgcaacagggtgtccaggttggttctgaggatgcagccatccaggcaggactcaagctctgcacagtcgtagtgcaccaggaagaggtcgtcccgcagcgtggcggccgtgatgttgcctcagacacagggtccccctggggggtgtgtggggtccaggctggtaaccggggcctgggccaaccaccactgctggctctgggcgccttttttttttttttttttttttttgtgagagagtcttgctctgttgcctagcagcagggtgccaaaggctggagagcagtggcattgatctcagctcactgcaacctctgcctcccgggttcaagtgattctcctgcctcagcctcccgagtagctgggattacaggtatgcgccaccatgccagctaatttttgtatttctagtagagacggggtttcaccgtgtcggccaggctggtcttgaactcctgaccttaaatgaatcatcccgcctcggcctcccaaagtgctgggattacaggcctgagccactgtgcccagccccctttttttttttttttttttttaaggcagagtctcgctctgtcgcccaggctggaatgcagtggcacaatcttggctcattgcaacctccacctcccaggttcaagcgattctcactcctcagcctcccgagtagctggcattacaggcatgaggcaccacgcccggctaatttttgtgttttcagtagagatggggtttccccatgttggccaggctggtctcgaactatggacctcaagtgatgtgcctgccttggcctcccaaagtgctgggattacaggtgtgagccaccgtgcccggcccaggccccctctttgaccccttcccctccacttctgaccttggtcagaccttgg

SEQ ID NO: 380 - DNA, 64829 bp, Homo sapiens
gaccacgaccgtggactttattcatgtccagcagtgaagtctgtggccccggccccggccccggccccggccccagccccaaccccaaccccaaccccggccccggccccggccccggccccagccccagccccagccccagccccagccctccgcagggcccgggcagcgtcttccgtggcccgcctgggcctgtggttgtgcgggaggcaccttcttagggcctggtcctcagtccagctcccagggcctggaggcggggatgggtgggacggtctaggaggtggggcttgggtaggttggcctggcctagagctggcccgtcagcccaagtgggcgtccagctgaatctaacacctctgtttttcctgcacctgacccctgtgaacccagccaccctgaggcaacgctgtccacagaaaccaggatgcaagtcccccagtgcagcaggcacaggaggctgcaaggcagggccatcgccaggggcaggtaccccaggggggcccacaggctgcctgtagatggaacagggaggccaccatcagtcccaccagacgctacccccatatccaccccctagagccagacaggcctgggcagtccctccctctggctggggagggtggggacagccagcgaggacacccacctgcggctgctctcctgggacccaacaaaggtctcaaagtttcccctgctcccactttctgctggtcagtgggttttaggagaggcagctgtatctctaactcagtggtcaatgaagggtgaagcagggttggccagcctcatcccaggaggcaatggacaaagctggtggacaggcctgtgggagtggccacgaggcggggacgggtctgagagggccctgggcagagggggccaagccggaggggtgcgggggccatacctgaggtggaggcctgggcatcgttcgtgggcaggcccgaggtgtggaccagatggagcacttggtgggtggtgctggggggccccctggtgccgtgggctgggccagtggggctggtggggctggcgtccaggccgagctggcccagggtggagctgttgaggctgcgcagccaggccctgacggtggggtggctgcgggccttctgaaggtctcccacgttgtggcccagcagcgcagtcacgttgccaacatccaggctctgcggagaggggtggggcagaggggccgtggggccaacttctgggccaggggaagacccacagggtagggccagacccaggatggggcagatggcgggagtgaggcccagaaacggcctggaggagggaagtgggggtatgctggctgtgacctgtgacctaggggctcccctgcctgggacagccctgcacccccacccccacccccacccccacccccacggggtagcccagccccacctgcagctcgagggggttcaggctggtgaaggtgtcgatgtccatggagatgttggcgtgggccaggtgccgcagctcctccaccggggcgccgcctggggggacgggtgaggggggctgggctccaccaggggagccgcctggggggacggggtgaggggggctgggctccaccatgggagccgcctggggggatggggtgaggggggctgggctccaccagggaagctgcctggggggacggggtgaggggggtggggcttctgggggaggggtgcccacccatggacagggctcaccgaggtaggggcgcatgaggcggtagtaggcagctagggtcccgctgctgccgaaggtctcatgggccttggtgtagagcacgtccttccggctctgggggcaggaggagaggtccagggccccggccagcctgtgggaggcgggaggctgaggagttggtcgccagccccccacccttccaacgctgggcatggccctcccttcccaagccacagctttcctctcaccctctgtcctgggggaacagggtcccccaaattcacatccacccagaacctcagaatgtgaccttgttgggaaacagggtcattgcagatgggtaagatgaggtcagactggatcaggtgggccctaaaccaatgactggaggccttctaagaacagggaaagctgagggctgggtgcggtgctctcacctgtcatcccagcactctgggaggcctgggcaggtggatcacgaggtcaggagatcgagaccagcctggccaacatggtgaagccccgtctctactaaaaatacagaaattagctgggcgtggtgggcgcctgtagtcccagctacttgggacgctgaggcaggagaattgcttgaatccaggagacaagagagaggttgcagtgagccgagatcacgccacttaactccagcctaggtggcagagtgagactccatctcaaaaataagcaaacaaacaaaaaagggaaatctgaggctgggcgtggaggctcacgcctgtaaatcccagcactttgggaggctgaggcaagaggattgctctgaatccaggagtttgagaccagcctgggcaacatagtgagaccctgtctcttaaaaaaaaagaatacgaaatgtggacacagacgggggagagcgcagcgtgaggatggaggcagagctggggttgatgtatccataagcccaggggcgccaaaccttgtcagcaatgccagaagctggaggaggcaggaagggtcctccctgcagggttcagagggggcggggactgccagcaccctgatttcagacctctggcctccagaactgagagaatatatttatctttaaaattacccaatttggccaggtgcagtggctcacacctgttatcccagtgctttgggagaccgaggagggtgaatcgcttgaggtcaggagttccagaccagcctggccaacatggtgaaaactcatctttactaaaaatacaaaaattagccagacatggtggtgggtgcctataatcccagttactcgggaggctgaggtgggaggattgcttaagcccagggggcagaggtggcagtgagctgagatcgcgccactgcactccagcctgggtgacatagtgagactgcctcaaaaaataaataaataggccaggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcgtggtggcgggcgcctgtagccccagctactcgggaggctgaggcaggagaatggcgtgaacccgggaggcggagcttgcagtgagccgagatcatgccactgcactccagcctgggtgacagagcgagactccgtctcaaaaaatgaataaagtcacccagtttgtgtactttgctcaaagctagagtccagccagggcagccctgggactaatgcacccctgatggcctggctgagctgcactccctggcctcagtttcccctcgcggtcctccttggctgaggcgggagctgcctccgaggcagtggggggttggggttgggtttggctcaccggagctcctggggatggatggtctggatctggtgaggactcatccagcacaggcgggtgcccccgatggccagcagcagggcaccggagactgtgccattgtgctccagaaacttctgcagcacagcctgggggcagagcccgggtcagtggggcaggctggggcctggggccacccacctgcccgcccacccaggtgccctcacctctgtctggttctccagggccacgtcggaggccagcagagccatgaccgtgtcctgggaggtgatgctccactggccgatctcggtgcgggagtagaggtagaccagcgaggtgatgagccgcagctgatcctccgggaggccttgtgggtagatctgagcaggtgggcagggctaggcagggtcagcagaggtgccgcgcccaccggcctccctgtccccacagcccagccgtgcacctgtgcgagcttggccttgaccacatgctggcactcagtgggcagcaggtgctgcaacagggtgtccaggttggttctgaggatgcagccatccaggcaggactcaagctctgcacagtcgtagtgcaccaggaagaggtcgtcccgcagcgtggcggccgtgatgttgcctcagacacagggtccccctggggggtgtgtggggtccaggctggtaaccggggcctgggccaaccaccactgctggctctgggcgccttttttttttttttttttttttttgtgagagagtcttgctctgttgcctagcagcagggtgccaaaggctggagagcagtggcattgatctcagctcactgcaacctctgcctcccgggttcaagtgattctcctgcctcagcctcccgagtagctgggattacaggtatgcgccaccatgccagctaatttttgtatttctagtagagacggggtttcaccgtgtcggccaggctggtcttgaactcctgaccttaaatgaatcatcccgcctcggcctcccaaagtgctgggattacaggcctgagccactgtgcccagccccctttttttttttttttttttttaaggcagagtctcgctctgtcgcccaggctggaatgcagtggcacaatcttggctcattgcaacctccacctcccaggttcaagcgattctcactcctcagcctcccgagtagctggcattacaggcatgaggcaccacgcccggctaatttttgtgttttcagtagagatggggtttccccatgttggccaggctggtctcgaactatggacctcaagtgatgtgcctgccttggcctcccaaagtgctgggattacaggtgtgagccaccgtgcccggcccaggccccctctttgaccccttcccctccacttctgaccttggtcagaccttggctttccctgagttctaaccaagaacttgtccaaactacttctctgaagtcagccaggcccgagggaaaagctggaccggtgaggtgcagggtcgcaggcctcagtggccatcctgacctgtgctgagcctgggcctggaggacactggtttggtcttggactccaggaagctggtgacgaagcacctggcctcgcgctggccgagccttcccacctggcacgaagccaccacgctgcggaagaagcccaggcccacggcctggcggggcaggtgtgggctgaggttggtggcccaggtccccgtgccacggcccgcttgtgcccaccccggggccccctcctacctcctgcacctgcgcccacaggtgagggctgatgtatgtggccaggggccccagggcctgtagcccctccagtgtccaggagccagggggccttgtgcacagaatggggcgcagtgttgggtccagggcaggccccccgccctgggagcccctgcccctctgtggacacccagcaggccggaggagcacccagtaggtgcttgaccacccagcccccgactggcacccacgagagggatgcccccaccacagccagcgggacagcaccccaaccctctgccccctcggccgcaggacccagtgaggctgaggccagaggtcagatgtcagtgggctgcggacatcggtgacctcttgggccgaccccgggctgcctcccgtctcgtccccgcctccttgcccagccctgtgaccccacccacccgagcgaggtcttcccaccggccagcagtgagttaagggcaatgcgctgggcagcggtcagccgggggcagcgccgcaggttctccagcatgtgggggtctgcggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctcagcagctccacgtccccctgggcggcacggcggatgaaggcccggcagtcggcttcccgcacctggctcaggctacaggtgagtgtgaggctgtcaggccgactgggggtggggccggacctcccagcagccctgagatgcccctggggctttgagggcccccaggactcctgtggccgggtggccgggcagggaggggcactcacttgtagaagagcagcaggttgggtgggtggagcgtgaagtcgtcctggaggccgcaccgtgacgccaggttggccaagcagctgagctgggcagaacggcgctccctcgtgactctggactcgccgtggcagcccgtgggcgcccttcccctctgcggaggcctcaggccccagtccccacccacttctcggccccgtttcccacatgtcgggtcatccccacggccacccgtgcctgcccctctgcctggaggggaaccccgcacagcagaacaggcctccaaacggccgcccccagccccaaagccgcctcctcactgacggggtgttaaagcacacgtccggatgctgggcgggtgtagacgattgcctgtctccaccaaggaggccccacgacgctggggttgggggtctcctccagcacagccccttggcagcttcccaagtggactctgggtggtgcccctcggctccacctgacagcctcctcctggcatcggggctctgccaggcccggcctccaccccccaccccatgctccctgaggctctgcttgcccctctcagcctatgcagcacgctgcccagcctcagcgccccctgcctaggcttgtctagcctggcctttggggtcatttcaagggtttttagccctttgctcagagggccctttgcctgattttatgtcaagcaagcccttgggacgtacggtgcataaggcgaggggctccgaggcagacaaggacagccccagagttttgtgcggccctcaccagggtctcatccctgaggaggagcccacccagggtgggggctcggggaccctcctgcagcctgaaaggagccccggggaatggagcaggggctgccagcctcctgcagcgcaaggtcctcctggctgagagggaggggaagaaaaactcttacccacaaacacccagaacgcctgtgagctggaacagaatgttcagcctgtttgattatcaaaagaaaggccaaaagcaggccaggtgtggtggcccatgcctgtaatcccagcactttgggaggctgaggagggctgatcactggagctcaggagttcgagaccagcctggccaacatagtgagacccctgtttctaaaaagaatcacaaagttaggccggacgccgtggctcatgcctgtaatcccagcagtttgggaggccgaggcgggcggatcacctgaggccagtctgagaccagcctgcccaatatggtgaaacctcgtctctagtaaaaatacaaaaatattagctgggcgtggtggcggccgcctgtagtctcagctacttggaaagctgaggcaggagaaccacttgaacccggaagacagaggttgcagtgagctgagatcgtgccactgcactccagcctgggtgacagagagagactccatctcaaaaaacaaaaacaaaaacaactgtcccagctactggggaggctgaggtgggaggatggcttgaatctgggagttgaggttgcaatgagctgagatggtgccactgctctccagtctggacaatagagtgcgatcttatctcaaaaaataagtaccataataaaattttatatgttttaaagaagagaaaggccaggtgcggtggctcatggctgtaatcccagtactttgtgaggccgagacgggcgggtcacttgaggccaggagtttgagaccagcctgggcaacatggtgaaacctcgtctgtattaaaaattcaaaaattagctgggcgtggtatcacgcgcctgcaatcccagctatctgggaggaggctgaggcaggagaattgtttgaatccgggaggcagaggttgcagtgagccgagatcgtgccactgcactccagcctgggtgacagagtgagactctgtctcaaaaataaataaataggctgggcatggtggctcaagcctgtaatcccagcactttgggaggccgaggtgggcgaatcacgaggtcagaagatcgagaccatcctggctaacgtcgtgaaaccttgtctctactaaaaatagaaaaaattagccgagcgtggtggcgggcgcctgtagttccagctactcaggaagctgaggcaggagaatggcatgaacctgggaggcagagtttgcagtaagccgagatcgcagcactgaactccagcctgggcgacagagcgagactttgtctcaaagaaaaaaaaaaataaataaataaataaataaaagagaaaaaaagactgtggcaataagataccaaattataaatgagacctacggccgtgccaggcagaggggaggtggtgcctgctggctgtccctctgtccctcctgtggcctccttgtctgagttgaaagcattccctattgctgagtccatgttttacacagggctttattcctttaaccggttacaaacgaaagagtctctgaatccacctatgacttataagcccccaatttgagatatcctgccttttcagggagaacgggctgatatctgcctaccccgtgttccctgcctctttgcctgtaactcctgcttcctggatgcctagaaaaccagcctgcaacccgccggcctcagggcgctcacacctcttgagtctgtttcctcgggccgggatcactcataccgctcagataactctaaactatgtcactgtgtggttttcccgtgaaggggtggaggtctttctgcctttcccttttcctggacggccccgcacaggccaggatcctgcagcccgtgcagggagaagcctgtgggctgtaaaatccgctctgggggccccgagtatgcaccccaagttgggcaccattccccgcggaggtgggtggggaggggagggtgaaccctcgtcctcactggggacacagtggggagcatctgcaggcaaattggctacaacgtcctggaattagataagcctgggctgcacccgaaagtcaccctgcctcctggtggacctcccgtcctggggggccgcagagacacactccaggtggctctgaagttggtgggttggcttccacacagccctcctgctctagggggccacacaccctgtcccgaccgtggtcacactgggttgtgccccagctctcgcttagccgtccttcgcctctcacacctgagcccatgtgcccttccctatccgggcccatccctcagagcctggcctcggtcacccgcccacccactcacactccttcccgctcacctgccaggcctggagggggacctgcagcaaggccagcctctggattagggctgagagctggtcccggggcagctggctggccggctggcaccagaagccttgcagcagggagcagttggcactgggcagagaggaggagacaggggcagggagggtccaggaggggtggaagcagctgaggggggctgcctagcagaagggcatgggccgcacgcagcctgcaggaccaaggtctgactccaccgctccccagcactgaaggagggagagtgggaggtggtgccccggacacaggcaaggtcctgcttcactcactcactcattcactcattgactcattcattcattcactcattcattcactcactcactcattcactcactcactcattcactcactcattcactcattcattcacacactcatttttactcattcactcattttcactcactcattcactcattcattcactcattcactcatttttactcattttcactcattcactcattttcactcattcactcactctttactcattttactcattcattcactcactcattttcacttattcattcatttacccactcactcattcactcattttcactcactcgttcactcatttttcactcattcattcactcattcattcggtcactcattcactcattcactcactcactcattcattcattctgtctttcattcattctctccagaacaccctgtggggccaggctctgggctgcacacagagccttatgtgtggcccctgcctagaccctgggacagcacttcctcctgaggctgggtcccagccggccgggagctcaggtggctccctgaacatccccgctggctgctgaggcacctgaggaggagacacccccacccagggctttggcacctgctgggcagccccggggaagccgtctccccagccttccttgtggtgtgagtctaatccagtccaacacagagcgggccttgtgccactcaggaccccagccctgcctcacagacgccctggttagtcaactgaccagcctgtcactgtcactaactctgaaggatggggaggagggccgagcccagcatgaggttccaggcagtgcggggaaccagagtgtcctctggggtgggcagaggcggcagggcctgacggttgaggcctcggcagtggctgaaggacccacacccggctatgtagatccaaagctggacactggacgctgagtcatctcagggccccccaaggtggagcaagagatgacagcctcagcgtgcagactgctggcggccagccccagacccctccccatcccctcgtctgacccctcccctggcctgaccaagaagcagacccctactgcaggagggctgcactcacctggcccacaggttggccccgctggcatccagccctcctggggaaagaaccttggcctggggcccagagcagtgggcagcaagggacagcaggagggtgaggcctgagctctgcagggcacctggaataaggtgggctgtgagggtcccggcgggagcaggggccggggcatccgggtcccagggtggacctgtgacccccaccatgggggtctgcttgaggccagaggacatggaggaacttctggagccccacagcactggccacctgtgcacagcctgggcccaagcgcaggacgtgtctggtggagcatgcacaggcgtgatgctgtgggtgcatgcaggcacgcacatgtaggtgacagtgtgcacgtgtaagtgacagtgtgcacgggtaggtgacagtatgcacaggtatacagcacaggcatgaggctgtggatgcgtgcgggcacgcatgtgtaggtgacagtgtgcacatgtaggtgacagtgtgcacgggtaggtgacagtgtgcacgggtatacagcacaggcatgagactgtggatgcgtgcaggcacgcatgtgtaggtgacagtgtgcacgtgtaggtgacagtgtgcacaggtaggtgacagctgtgtgcacgtgtaggtgatggtgtgcacgggtaggttacagtgtgcatgggtaggtgacagctgtgtgcacgggtaggtgacagctgtgtgcacgggtaggtgacggtgtgcacgggtaggtgacggtgtgcacgggtaggtgacagctgtgtgcacgggtaggtgaaagctgtgtgcacgggtaggtgaaagctgtgtgcacagggaggtgacagttgtgtgcacagggaggtgacagctgtgtgcacgggtaggtgacagttatgtgcacggggaggtgacagctgtgtgcatggggaggtgacggtgtgcagaggtaggtgacagctgtgtgcacggggaggtgacagctgtgtgcacgggtaggtgaaagctgtgtgcacgggtaggtgaaagctgtgtgcatgggtaggtgacagtgtgcacgggtaggtgacagttgtgtgcatgactctggcagcgtgtgcgcatgtccacctgtgttgcacatgtgtgagatggcaggtgcatgtgtgtgagctccttctacctccctccagacgccccatggctctgtgttctcacagtggagccctgagacccctaaggcagcagagctgtgggggcagaagccaccttcaagggccccggctgctcagctctgcagtgggggtcacggcagggcctcccagcaggaactgggagcccagcccatgttcctgctttggaaacccagcccaggaagggggtttgggtgcaggggagcccccttatcttgctggccctggggagaccacgtggtgaagtctcttctccggcaggcgtcaagcaggggttgccacagcccacacagaaatctgaccacggcctcctgggctgctggggcccggcccacccctctcagggagggtgaggcattgggcaaccctggcctcagagcccagccctgcctgtggccggactgcccgagagaacgctgtctccactcacccccacaccgtttccccagaagccatgtccagctgcctgggccaggagtggccccctctagccaaacttgcctgccctgcctcaccctcccaggacccccatgcctgctggggagggctgggctcacagtgccctggcagcccgacccccgtcctgctgctgctgggcagggcccaccttctccttccttggcttgggacagaccctcgctcaggagaatggggtggccagggccctgggcactcccatgtctacgggatggctttgccatgagggcctggcactctggaggccccctttctgcatggaggtctcgtctcacccactctggggcccacgtctgtgcggcggcgtgcactggtcatcctggctgagacgtcccagggcaggaaggtgctggggccaagggcagtgggtccaggactagctggagaggcgtgacagaggcgagacacaggtgagacacacaggttggccccgcactgcctcccaccccctggggtgtggagagggagggtgcagtctaggttcacccagggcagcggggccagagctgcgcctctcccaccttcgaggggaaaggatcccataaacagtaaaaggcaggagcagggagcgggagccgggtgaaaccctggggcctttcttattgcaggtcggggcctaggggacccatgggctgctgggtctccaatgaacagatttccaacaaacagcgagtcccccaggcagcctcgtgcagccctggcttcatccccacacccggcagccctggcagctccctttccctctttgagccccagctgttgggctctttcgctgacatccagcccccagtggcagctggggtagcctcaaccatgctggaaatggaagctgcaaggccagggaccctagaggagtccggtactgctgtgggtcactgcctcctcctggagccagcctgatggcttttgggcacctctgggcctcctgactgtggcccaggagggagacagggaggctgccccatgcagaggcaaatgcagaggttcaggcccagccacaggtccgggaccggccctgcgggtgggctggtggtggctcccgccagcgtttctcacctgagcagaaaccctgggtgtggtggagggaggtgctgcccaggctgtggggtggctgctcctggcagggagttgtggaccaggtgatccagacgcaatcccagcccgccaagtgcgtcagccgctaccactgagcgcccgggtgcagaggcggtgcagggcggggatgccggggtccccgctcacctccatgcctggcctggcaggcggcatgagactgcctcgccccgcccagtcccactcccacggtgacgcccgccaggcagtcctgtgggggaggcccgggctgtgccaggcgatgcaccgcgtcagcccctggggacctcaggcacaatgggcacctactcccttcccctagagcaaaggctgagctcacggctggcagctgcccagctcacacccctccccacccactggggccctgctctgcagcgtctgtgccccaggggtcatgtcgtgcgcctgcacctgagtctgccgtgtttgctggtgcctgcgtgtgcacaggtgcctctcgggcctcctggtctgtgtgcccgggagcacggacacagatccaccatgtgtgcctctgcggggacatcaggcagacgagtacccaatgcgggggccaggaatggtgacggctgcggccattccgtgggtgccgcagctcagaggtgggcaggcaagagcacccaagtatgcactgtcgggctccaccaggcaggccagggcaggagaagacacaggagggacttcccagcccacctgccaggcttctcccctcactgggacagggtgctgggtgacccaggctgagccctggcctggcccacctaccccagctctcatcttgggagagactcagcccctgcttggcaggacctgcagctcaggttcagctgtggaaccaccaccccctgcaccacagctatgctatgggtgcccaacaagccagctccatggccaagctgagacttgacccccgatctgggtcttctggaggctgacggcaggggaactggtaggtgactgctccccaggcctgcacaagcccacaggaacccaggtgcccctttgagagctctaggctgacaacgaggcacgggcaccatgagggacggcgctcaggcctggcttgttgatgagggtccggctcaggtcaggccttgaaggccccttggccggctgtcagctgggccagcccagctggacacagcggctccaacagctgctgttggggcagtgaggtcggcagcccccagtctagaggggtggggccccgtggggcagggtggggagactgtcccagccagagaggggaggcgtgcctggccctgacttgggctgattcagacaaggaccaggaggaggcctggagataagccagccctgggggaggggaggccggggccaggtgcccgagggtggacacgtcccggggctggccagggaggagcctcgagagtgatgggcgtgctggccgggagggctttgctgccgcactctgttggggtggccgactggtgctacttgagggttatgcggtcccttcggatctgcaccagccccttcctttacagatgaggaaactgagtcatgggagcagcagcagtgagtccagggcctgtggcctcacctcagggactctggggctggaacccacgtctcggctgagggcacggtggcagctgcctccagtcgggccccggtggggactccgggtctggaacccgcgtctcggctgaggacacggtggcagctgcctccggtctgggccccggtggggactccgggtctggaacccgcatctcggctgagggcacggtggcagctgcctctggtccaggccctgctgctgtcaccgctggggtcgtaaccagggtttcagggctggccccggagctggacagtggcaggcaggggccaggcggacctgagaccaagtgctggcccatgagatgccccttccacagagctctgagacttgggctctacgaagatccctggctggaccagctgggtattcccatggctctggttgtgggggctgggggttgtccggggccggcccagggtctgtgcccaggccaaagctgcacggtgcttgctgtctgcaggagaggccgataggagcctggaccactgcgtctgtcctgggtcctgctggggcctcagggcagggaagagagctaggaaaggtctgggtggccagacctgtcccttggaagccccacttcggacacgttcacggtcatccttggagccagtcactgaacatttatttggagtccctggagccctgctgtagccaggagcccaggttgtggcatgggggacagaggaggtgggacctggcagacccacagctcccaagctggggtcccggaggcagagtgacaatgcatggctgtgtgggagccaggcaggcggtgacgtggcagagctgccagcaggggcccaagagactgcagcaggttggtgctcacagtggatctgagggatgggcgtgcgtggcagggccttggccatggcccctgaccaacccctgtgcaccaaacaccacactgagctcagaatccgggcagagagggaaccactggtacagtgaggccaaggcacacgcagccgggcctgcagactcgagcccagcagggaccattaggtctcgggaggaggcagctgagggcgacaggatctgcacagagcagtgaggggcagaggacgcagggaccagatgggtctcccaggccaggtgagcccagaacggcccttcccagcccctctagagggtaggttgggggcagtagctcaccaggcccaggagcagcccatcctggaggcaaagcctatcccaaaacctggccctgcctcttcctgaggtgaccttgagtccgtaaaactgacgcccctggggtgacgcttgagagccggaagctgttccaggaggagggaggggcctcggtttctcccggggcatgtgggcaggaaggccctcgggatcccgcatcagtcccacggccgcggtgcggtcgtcacctgtgatcacggctgcctggcgccccctgccggccccacctcagcccttcctcgcaggcctggccggggcaacccagtgggcctgatgctgcctggcacctcgaggccccagagccagtgagcagacgctcgctcgcccatctccctagagtcccgctgtgcagctgacaccccctgccccagccccacggctctcagctgtccggttccagcgtccactccgacagccactgcaggcaggggccccgctgtgcctcagtctcagggggcttggttgggggtggaggaggccggccgggcccaggcaggagtgcggaggggctgcctggcctggggcccctatcctcggggtcagggtcgggggtggcccgtaaggcctgcacgagctggtccagcgactgcagcagtgtgtgggggctccagcaggcatccagggagggcaggaaggggtcaggcgtgcagacctccacacactcggtgtccgtggggatgcgcaggtagaaagcgtgcagcatcattctgaacggccggtcctcccggcccgagacttctccgtaggtcaggtcgcccaccacggggtggcccagggcactgcagtgcacgcgcagctggtgtgtccggcctgcgggatgagggcggtgccggatcaagctgggagcggggccgatccacacctatctccctgaccaggacccacctcccgtcatgaccccgctgcagtcttgaagcagcctcttggggtggaactctccctgtcccctgccatgagtgaggatgacagtatttaggacagaagattgtgttcaggtcaccactggtgaggacagggccagggtggtgctcggtcctggagaatctaggccagccagacccccaaggaatcagtcaggagccagcagggaccctgtgtcaggtgagaagctgagaggctgcagggcgtggagttaagaacgcaggagtgcttgttgccagctctgccctgatgctcagggtggcccaacataagcttcgtggccctgtgcctcagtttcccttctgtcaccaccaggacaccgcccaccccagacacacccgtgagcggcttcagcagcactttggagacaggatcgcctgcgtacagcccgtgttccagaaccacgagatctgtgaggcttggctttgggttctcacaacctggggcgcagaaggcaggtgtgaggttagtgggactgacccggggcccaggcccaccccaacgcacgatgcccgcccggtgggtccctgcctgcccaggcccaccccaacccacgatgcccgcccggtgggtccctgcctgccacaccctgcgagccctcgatgcacatggtgtgggcccggccctccgtgctgttcctgccaatggcatggctgatggttacccggctctcctggatgtgcccccgcagctgcaggagagggagaatcgcacgcagttcacggggcagcccagtgctgccggggagcccacctaacaccaagcaaccacgtagagcgtggtgggaggctctgagccagggctgcccaagtggggtgggaatcctgagtccccacgccccaccccaggactgaccaggtcttaccaatgccaggtaagccttggtcacgcgccgctccttgaagcacctgtacgcgctgccggcggctgccttgtttagggccacgcacagcgccccgctggtggagaaatccagctggtggcagaacctggagtgggacagagtccagagtctgagccactttcctccacagacgccaccgtggggctccggccgccccccctacctgaacccgtagcaggtgtcagggtcggccagctcgggaaagcggtaccgcagctgcttctgcagggtcagagtctcccgccacgccttgctgtcaatgcgaacgtcccagtgcttgttgaccaccaggaagtcgcggctccggtacacgatggacaggttctccacgctgcctggctccatggccggcctgccgagccacgcgtgggtgcgtgtgctgtgagcacgtggtgcgcccccagcccagcatacagaggtacccgcaccgccccacccgggctccggtgcgaagccaccgagccgggtccgcagccctactgtgcacctgcatcctcagtccccgagatcagtccccagggcgtcagctggggagtcaaggagtcagcctgctccgggctgacctgaagggccctgcctgacctaagcctggagaaagagcccgttccaaacctgccccacagatcctccccacagaccctcccctccaggggatgcacgtgaatgcctctgcccgacggtgggggcggggaggggctgcagcactaccaggcccggcagccaggtctgcccgcagcgcgggttagggctggggcctcctcgctccccgcagtccgcgcagacccgcgccccgcacaggcccggtgggcaggccgaccctggctccgagcccctcccgcgcccacgcccacgccaagaccaacctgctgccgggccgtgcagtccaggcccccgatgccgtgcccggcgccggctccagccgcgcgcccgcgcgctggcgacccagagaccctggaagctccgctccggacgcctggcagcgcttccgccctgcaccgctgcgcgcgcagccccgcccccccccccggcccgcccccggcccgcccccgccgcggaagggcggctgcggcggccaatggcgagctccccaggacaggacgcgggggctgcggagcaggaactcgccccgcccacccctcgcgcagccccgcctccgccacgccaaccaatggcgcgcgccgccgggcacgccggctgctgattggcggcgcccggcacgctcggggcgggcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggtggggcgcggcccccggccgttggggaggagctgcgaaagccgggacagtggcgacctcggggagggcgtgccgggggccgaaggggcctccacgtcgccgctggcgggatctgctgtctcggggcggccgctgacaatctcctctcccagcaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggtgtgtggcttggacatgggcgtcccatcccatctgtccagtgggactcagatggagcccatcccgtgccctggatgaggcctggggggtggggagggttccatggctgagagcagtctcggacacccatatccaagggtgaccccacgcttgagtttctgccactgagccccggtctctctccagagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcaggtgcgtggctgtggccttcctgcacggtgggtgggccagtgctgctcaggaaagggtccttggagcccctcacccctgccatttgcttaaagcgggtcctgtgcagagccccaggggtgcagagggggaggctgcgtcatggggcgtagacttagaggacacagcctccccacagcaggttgctgtccagcctgtttgtatggcctcgggtggagagggcctccttgcttcccctcctgcttttgccctttcctcctttctcctaaagctgcccccaatttccctttgcagctgacccatctggatggcttcattcctttggcacccctgtccagtctcccacccctcactggccagcttactggggttgtcccacccgggtccctgagcactgatgggggctgacgtgaatcctgtgacctaggaggggcccagaggcaattgtcctcccttccccacagggctctctcctccacgtcccatggcgaggcggtggccagctggacctgctgggtgtgtccttagcctccctgaagaagcaggtcgacggcgaggtaggggctgcgggtttgctggggggcggtggcggggccgcctgagccctcctgattccagcctgttgtttgcacagcggcgggagcggctgcttcaggaggcccagaagctttcagacaccctgcacaggtgacttggttggcccttccgccctggggacccttgttggctcttgcaccaactcctagctcctagcgtgtgggttggcatggtccctgcgagttgtttgtggctcaggacgtggtcctctccagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggtaggtgggtgggcgggcaggcaggcgggcagcagggcctggactcaccgtgtcctctgacctcccccaaggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagtgagtgcatgggcgggcgccacagtcaggagaggctctggtgcctggagggagggttccggcccgtccctgtgtcctgggctgtggtgccaaccctggggtccctggccctgccgcctctcctcaggttcgcaccgtccctgcggcagctgaagcagcaggccttcctgctccacttcccgccgactctgccctcgaggctggtgcagcggctccaggaggtcggtggagccccaggagccgtgtggctgatggcggggttgggggcgtggcctcgttctggcccctgtttccctgcccctccccatggaaccctggtaacccctgaaaggatggggcataccatcgggccctccagcagcccttctccaccaggtctccctgcggcagggcatgagggccgacccaggggtgctggccgccctctgtgagaaaactgacaatgacatccgggcctgcatcaacaccctgcaggtgggcggccggcaggcaccgggtggggtggggtggggtcaggagttggccgcttctcatgcccccgccctatgtctagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggtaggcggtggccacagcctcggcccagatgctcacggtgcccggacctcaggacgctagccctgtgtgcaggccagcactaccttcgaggcggggactcagtgtcctgagcccgcggttgcctggtccagcctccagggccctcctcagccttttcctggcttgttctcgcccctacagccttggggggtcagctagagaagcctccagggccccctgtgggaaggacacccccagtgtggtggggcctccagggcgtccctctccagggcgccccttgactcagctgctgtcccagttgcaccctcatttttgccacatttggcctgggctgtggtctctgagcccctgcctgcccacactgcttggcctcccgtgggcaggagcagccagcatgtctctgtcctgacgtgccatgggaccccaggggatgctggcctggtcgtgctgcaggatatgggagacgctggcctgggcctgtgggatgtgctgctcctggcctggacccggagggggactttccctggggtcccctaaccccagagggtcagggcagggctcctctcagagtggggctcctcggcttaagggaatgtttcagggggttgaggtccgggcgtgtctttggctgtctccacctgagcgaggcagcaagggccctgctgagaagaatgaagtgggtggcagctctgatggggcctctgagtgtcccggggagacgggtggggctgcctgtgcttttaacacgggtccatctagcttcagcaccccacctgcaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccaggtacctgtcttccaccaaaatgcctgcctggggccgcctggctaggacctgggctgtgcccctgcccctgccggtcctcccgtatggacggggaggcgctttgggggtgctgagagaggcaggttcgggaaatggggtgccaggaagtctctgaggtggggagcaggagccaggagggtgggaggggctgcagggcacgggccggcaggcaaggaggtaggggcggccgtctgacgggggaggtcgctctggtggctgcttgggactctcagcgggttggggtggagcccctgccggacagcctggcctggggctgcgaggggctggattctggacttaagatgcacatggggtggagagcagtgcggtgagggcttcctgccgccctgcccgcgggagtccccgcctaagctgtctgctgactctaagcggctttggattagcagctggggatccacaaccaatccccaaatcccaaaagccgcgatgtggaggggcagcgtggagcagcggcggggatagactcccccacggaacaggggtggggacgccacggcctggactctggtgggcggaacttcctcaggcagtctaaggaggggctgagtgaggctggatccctttggttcctggaggcctcctggtgggtcaccccctcgtgtcagtctctgtcaagtcagtctctgtcaagctgtagcgaggatgctcagggtggaccctcccccgaccccttgggcccagtgaccccttgctggtgtgtgctgctgcctcagacgcccagcgtcgtggggacccttgtggagggtctgcgaagcctcgtggggcaggcggcaggcaggagtggagggtctgtggcgggaggtggagggtccgtggtggtgcaccttccctggggtgggcaggagctcaggggttgccggccgcctgcagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggtgtgctcgtccctgcaccacgcctgcccccggccccgtgcccgcccccctgtgctgcccgtgtggctgcccccggccccgtgcccgcccccccaaacacactgcccgtgtggctgcccccggccccgtgcccgcccccccaaacacactgcccgtgtggctgcccccggccccgtgcccgcccccccaaacacactgcccgtgtggctgcccccggccccgtgcccgcccccctgtgctgcccgtgtggctgccctggccccacccaccattcccccctcgcccgggaggcccaggtgaccaggccttggctcaccccctgccccaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagtgccgtccccggggtgggggattccccgcctgctgccctcctgtcctaggtgagcacacatttgtacagcctgctcagctccctgtctgctgcctcccatcccctaggtgagcacacagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatcatcatcccacgtacacttgcagttggggaaactgaggctcggggcagttaaacctggctgccgcagggttggggtgcggtggcaccaggactcagccccacattcctgctctggccttgtggcttttggggtttgcggttggagtgcccggcggctctctggccctgagcctggccccgctgacctgccctggtgtccccctgtgctgagcaggaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtgagcccacccaggctctggagcaggttgcagtctgggcgtgcaccatccccactgtatccctgtgtggccagatctcacaatgcctgctccctacaggtggatgggagccccccagggctcgagggtctgctggggggcattggggagaaaggggtgcaccgacctgccccacgcaaccatgagcagcggctggagcacatcatgaggcgagcggcccgggaggaacaggtgtggaatgggcagctgtgggggtgggaccagggtacatacctttgggggtgtggctagggcagtcatgaggcggggccaaggcacccatggggtggggccagggtacctttgtgggtgtggctagggcccctcatgaggcagggccagggtaccttcagggctgtggctagggcagtcatgaggcggggccagggtatctttaggggtggggccaaggcacccatggggtggggccagggtacctttgggggtggggctgagccacaggaggagtctggctgagggtggggctggctcagtgccctaaggggggctctgaaggaccagctccttaccctcagcatgaccagggttctacccaggcctcagtttcccatctgggcagaagagtggctgtattggctcttcttgattggcacctggtggggagcagatggcagtgaggggtgaggggcagctggcctgggccaggttccgaaaggtgtctcagaggtgttctggtccctcctccctgggaaggctctcggtcctcctgtcttgggtaggggctggatggggcatctgtcctatacgactgactagtccttcctcccatcagcctgagaaggacttctttggacgtgtggtcgtcaggagcacagcagtcccgagtgcaggtgtgtgtgggggtgttgtggggttgtggggggcctgggggttgtgggggggccttacagctgaggagcaaccctgtggccccgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaatcacgtgcgagtggagtggggttcacaggatggtgggagtggggccgggcgtgggctcataggatggtgtgagtggggccaggagtggggctcacaggatggtgggagtggggccaggcgtggtctcacaggatagagtgagtggggccgggcgtggtctcacaggatggagtgaatggggccgggcacagtcttacaagatgttgtgagtggggccgggagtggggctcacaggttggtgtgagtggggctgggagtggggctcacaggatggagtgagtggggccgggagtggggctcacaggatggtgggagtggggctgggagtggggctcacaggatggtgggagtggggctggaagtggggctcacaggatggtgggagtggggctgggagtgggactcacaggatggagtgaatggggctgggcatagtcttacaagatggagtgagtggggccgggagtggggctcacaggttggtgtgagtggggccgggcatgggctcacaggatggtgggagtggggctgggagtgggactcacaggatggagtgagtggggctgggcacagtcttacaagatggtgggagtggggccgggcgtggtctcacaggatggtgtgagaggggccgggtgcggggctcacaggatggtgcatttgcccttttccacccatgggttgttcttcatcaggtcggggttcaggaaggggtccttggggatcccgtcctcgatccacttcagcagcctgcgggtgggcgggtggcaggtgagtggtggcacctgacccccgagggcctcctgctgcacctgcctgtcggcggcggtggtcgtggctatggaaatgagcagccagcgcagggcagacaaatgagaggcaaatcaggcaggtggggcactcactcggggatggtcttggacgccatctcccgctggaaggccagctggtacttgaggctctccacctctttcttcatctgtggcacgtcccactcctccatggggtcaggggcttctgaagcagccagcctggggctggagggcacaggaggaagccacagggccgaggccaccagcctgtagtccccacccccgctgctccccgcaggcctgagctgaaccccgcaggatgaagcggggagagtccacaccactgcctgggccagtcccctaggcgttgctagggtgcagggcacagagcgagttcccacaaggccccagctcccgcctcctgcactgggactaattaactgcaagaaactttacatcctcagctactcccccataggcccccacaccttacgaagatcccttgcaggcaggagaaagggtgctcagcacggcaggcccccagctcctaccctcccactgaggcccacgcaggctgacccagaccacggtgtgaggtgtggggcgaggtcctcaggaggtggcccctgccccgccccgctgtgtgcccctttgctttgcatggcagagcccagtccagagccaggactcctggacaggaatgttctgctgcagtttgcttctctggcaggtggggtgtgtgctcaggatcttgggggctcaggctatactacccgagtctgggatatgggctgtgggtggcccctgggtccccagtgtgtctgggaaccacacacgttacctgcgtgctttctgcttgtggccagcctgggaaagccacaggttgacacccctcagaactgccacaagttcgaggcaagtgggggtgggttgccccctgcctctccccctacccactccaggggcccagggagtccctcactccgtcccaactctggcccccgtccccaaggttgggagacagggctgaaccttgggagggtgggtgggggttggcgtcaagtttcggggagcctgcctctggctgtgaagggggctcctggcccaacagtctccccatcctttggtcgtgcagctgcaccggccacctagggaggggcccagggcctgaggctggtggggtcccggtggtgaattgggcagactcccagcagccagcagagggtctgcccgtagtggggtgggaggccggggagcgagcgggggcaggtttctgggggagtgatcagggtcatgcagaggattccctcccggagactctggagttccagcacccctacccgcccccatccccggtgcaggccttttctcggagaccctacactcagccccgtgggcgcaggactagctgcgtgcgggtcctcccaggcccggggtgttggcgccccgcccacagcccagtccttgctgcccagccctaccttcgcgcagctgccgccaagcctggccacccaccccgtgcaccccgtggacgcccccagccacgggactcggtgggcactgcaggcggcgcacggcgctcagatggacacagctcccccgcaccgcgagagccgcctccctgcctgcagcaccggctcgggttgggttttgctgcctgcggggcagctgccctcgccccgggagttagggtgagcccaggggactgacctgggccagctgagagtcgaggggcctccgggccctccctagccccgggcgcctgttcatcggacctaccttgaaaaggtgacagcggagggacaatgacaacggccaggcgaccgcgagtgagagcgagggccaagtgatgttccgggagtccgccaggcagagccctggctgtgccccgcccctcccgccacctgggccctggcgccgcccccacaccctcctcagggctgggctgaccccagagatagcctgtgctgccccctcccctgggctcacccagcggatggacatgcagccaggggccagtgtggggctggtccattttccctgaggggccagcttgggccctggtggagaggtctccttccacttgagggggtgggttccccctccagtgtcctgggccagccgggaggagtggggatggggctgggaccctttgccctctgaagcctctgcagcctgcagggttcaggtgacactcagctgtgcccccctgacagaggcatcctgtgtgggccatgtggctcaccctgggatgtgagcctcttactgctaggggccccggggctctgtggagctccctgctccagcccgatcccctgttcccagaccagtggccggcacggggcagctcccgagggcaggagagtgccgtgcttttcagtctgatctgagctgagagtggcggcctgaggcgtccccaacaccggtccactgtgggtgctctggggcacgctgcctcgggagaggtgcccccagctgcagcacttgggctcgggttgtgtgacctcaaggctctggggagagggcttccctttggggctccgcacctgtcagcctgcagagctgagactggccccttttcctctgacacgtttccccgtgtctcctcccaccctgcccttgggtgtaccccttgggctcctgtgggagctgtgccctatgtaccagcaggtgacgtacataccaggctgcatcctaggtgggggcgcccaggcagcaacagcagcctctgggggcacagggccaagctccccaaacagtccctgcagaagctgggccacccccggggaagcgtgggccaggccctcggtgggtgctggcagggccaggggcctgtgagcaggtcactctgccttccccagtgtcacagggaaccgcccggcctgcctggggtggcccagacctctgcaggggttgtcggggagaggtgggccctgtccctctcaggcgctcaggtccctgaagtcactcagcaggactccctgccagtgtgactccgtgaatcggggccacctgcacctcccgccctgatgtgtgtcggctggatcagaggcgcctctggaactggggcacattagggaagggattatttttattatggatttgggggtggggtggggcagcttaaagcccagggcacgaggcctcctcctcagggcagatggttgcccctcttggcatggtgggggctagacgtctccctgatcccagtgcccgccctgccctgcctgtgccccctggtgctgtgacttcggatgcaccttagtttctgggctgctgagggctctccctgtggctgggggcaccactttgggcgccagagagtggaatggctgttaggggaggggtgtgtgccaccccaggatgcaggcaaggcgggggggaccccagggcatgtcccccacgttccctgggacagcaggtggcttggagccagggccaggcgggggaacaccctgaggtccgcagctgagttgtgagagctgggggttctgtggccactctcaggaccccaagcggcctttgcatctgctcatctggaaggacctaggaggtctcctaatggggtcgccaaggctccaggttctggcttttggtcaattcactggacccagtaaggtccctgagggtgcctgagctctgtccaacacggccagtgcccccagtgaatcaggacacaggttggagtgtggtgtgggccaccaggacaggtgagacgggccgtggggtcacgtcctggagtgagcactgccctgtggtccgggcaggtcctgccagtcctcagcatctcagcagagaagtggctgtgtgtacctgcatggtggacccggcctgcctacctgagcagggtctgggtgacccccaaggccaagggcaggaggaggttgagggaagtgggggcagggccagggcaagctgagggttttgggtctgctgcaggcccatgtcccaggcatgtgatgtgggtcccgtctctcaccccacttctgtggcgtttctggtcgctgggggggcaccagtcagcctcggtgtcgtgtggacccccagaatcagaagcaggtcctgtgctgacctgggtgggtgcagtaacctctgctcccgtgtgaggggctgtgaggtcccatcctcagtaagacgggggtcttgaagactgacttcgaccttcctaccaaggctgcactcggaaacccccaaacacatccgggcgctgacgccttgagctggagtcagcctcgggtctggaatctgcctcccccggccctacagctggacccggcttcagcgattctcattgggaggaatggcagccagtcccccaacggagtgaccacagcctcccgaggccaggggctcctttctgaaattaggccactaattgggccgctggctgagaacacgcagggctctttccgctgccctagaaatagctgtccctggcccgaggggctcttgacccaccaggcgtggggctgtgccgctgggcctggcttggggcaggagcatcgagacctcccatttacagccaaccaagaccgtgggggaagcacaggaggccggaggcccttcacgctgactttagggcttggtaccacactggcatagggggctctgatcccttcctagcgggaagctgcagcagggtctcccgggactggcctctcgctgcggcctcaactccgaatgggtgggggagacagcccccgacaccagtcaactctccggggaacagagggataaagtgctgagctggggaccaaggaccagtcccatcctccacccgcctgtgccctaggctctgcagagggctctggctgtcctagggggaccctgtggcctgcaggacccaagcagcccgggggtggtgggtgaatgtgtgtggaggacacgctgacttccctcagtccctgcaaacaaaactgcaagcgtggggcctggggaaataacgaaggcagctcctcaccaaagaaactcactccgcctagttaactggagctcacggcaacgacttttctgtcatctgtgaaagtttcaaagtgattttcaaaaacaattgaagctcttaaacccaagcacagaaaacacaacggaaaacttcaagggatggggtggggggaggggggagggatagcattaggggatatacctgatgttaaaagacgagtaaatgggtgcagcacaccaacatggcacatgtatacatatgtaacaaagctgcacgttgtgcacatgtaccctaaaacttaaagtataataaaaaaaaaaaacaacttcaagggagtcccgggtgcgtggctgtcatccacacctgacctccattgtgtagtcaggggcctgctgggggcttggccgtagccacgctcgcgctgcagcctcggggtagcgtgcctgccttagctcggtttactctgaacagctgcaggtcagtgcgtggttacagtcgccggaggtttcctacttaagagacgcccgtctcctgaaaagctaggtatgtctttgctaaccagaagcatggcctgaggcaggaggtcctggaaggacagaagcaggctgggcggtggatccccacaggctcggacgccctagctcctggcctgaggactggaggtcagtgtgtcaccaggagcaatgccagctgggctcccggggatggggtgctgcccccattcggaacttgagtgtgtttaaggggaaccgacgggcaaaataacagcctgctgggttcagaggcccccactgccggctccaccaaattacgctcttccaagagtaccagctcagaagtcgcagattttccaaaagagagacacatttgctcagccgagggtggtgggaggccttgaggcgagacctttccaaggtctgtgggggaagggaagggagagtgagtcgcgccttctgccccaggccaccctccggtgtgtcgtggtccctggggcggctttcctaggagcccgtgatccgcagggtggtggccagagccgtgcagcagcctgacagggcttctggctttgggagagtccctgcccacacagacggacacttgctttgggatgactaggctgggtgcagtggctcacacctgtcattccagcactttgggaagctgaggctagaggatcccttgagcctggaaggtggaggctgcagtgaactgtgatcatgccacagctcacaacagggagaccttgtctcaaaaaaaaaaagggatgacaaaggtcccgtgattttgcctaaggacacctagaagttaagacggtgtgttctggcctctggctgtccccacggcttcattcaaacatcccgggctgggtggccaccactgtaagtgcatcagggcccaaggacccgcctgtacctctaaccacaggacatgctgtgaatccaggttggcctctaagaccctggatgggtcacgccacagcccatcagggatcctgggacccccagtgcaggggatggccctgctgctgcttccggggctagggaaaccacagaatgtccagtcttccaaatctgattggcaaatgggtttggcagagcctagccagatgctaggatggcccgaactgaccagaagcccccgtgcagaggtggctgctggggacagccaggtcaccccaacacgggtggggcagctgcacaccccacttaccaccccatgggtcacaggcctcgaacgtgcatcctgctacgtggagaccagaccacaggtggccaagctccgtctcgggaaataagcctggggccctgggcggccggcactcacttcctggctatctctaccaccccatggggcaggaagacacccgcctgcatttctgagctcccaaccagctcaggaacagcgcagccgctcgcaaatgcagtgtgcgaggtacagaccgttccagggcctggcctgcgcccacagggaactcctgccatgcgggccccttctcacaaggggacaccgcccacccccaacccctggggcccagagcagccccagaacagacacaagcatcccaaaaagggggtcactggggtagatgcacacatctggggaccctgtgtgtcatcccaagtgggccatagccctgggcatctggtcttaggtcccagggctttgccagcagaagcctccaggtgtgcagggtctgtgctagaggcctccaaccggccaccatgggctgtccacccgtgtggcagcacccgggtccctgcagcgcctgagactcctcgcactcagtggacagcagagcgcccctgagcagcctcggtatctgcagatgcacaaggctggctggggcagaagcaggggagggaggggctctgaggaaggcgcctgcgtccccacagatcaatcacttgatgtttgacatgacctgcaaacgttttatttgcaaaatacagagagtagacgacaggaagtagcggcttacacctgtaatcccagcacttatggaggccaaggcgggaggatcccttgagctcaggagttggagaccagcctggacaacaaagtgagaccctgtctctacaaaaaaatacaaaaattagctgggtgtggtggtgcgcacctgtggtcccagctattggagaggctgaggtgggaggattgcttgagcctgggaggtggaagctgcagtgagctgagataatgtcactgcactccagcctgggcaacagagtgagactctgtctcaaaaaaagttgaggccgggcatggtggctcacatatgtaatcccagcactttgggaggccaaagtgggcagaccacctggccaacatggtggaaacctgtctctactaaaaatacaaaaattagccaggggtggtggcctgcgcgcctgtagtcccagttactcgggaggctgaggcaggagaatcacttgaacccaggaggtggaggttgcagtgagccgagatcatgccattgcactccagcctgggcaacagagggagactccatctcaaaaaaaaaaaaaaaaaaaaaaaaaaaatgtttgggccgggggcggtggctcacgcctgcaatctcagcactttgggaggcggaggcaggcggatcacgaggtcaggaggttgagaccatcctggccaacacggtgaaaccctgtctctactaaaaaaaatatacaaaaaaattagccaggtgtggtggcgggcgcctctagtcccaggtactcgggaggctgaggcaggagaatggcgagaacccgggaggcggagcttgcagtgagccgtgatcgcgccgctacactccagcttgggtgacagagcgagactccgtctcaaaaaacaaaacaaaacaaaacaaaacaaaaacaagtttggagccacgcggccacaagcctcttaaggacgcctggagctcccagagcccccaggagctcaaagaggcaggaagggtcctccctatagcctctggagggatcgtggcccccattaccttttcaaaatgtcacctctccccgcggtgtgaccctcgaaagctagacgtgcccaggaggcagcagcccaggccccgcaccttccctcccgctccctctggccgccgggcctcagccagcgctgctccctgacccgcctgtgccctcgccagggcccctcgccgccgcctcctgccgcctcccgatatggccaaacacccgggcgcgagccccgcgtgcaggcgccgggcctgggcccctgtggccgtcccgccagcggccgtcttctgtccctgcatttagagaagggggatggcaaagggacccgccagcggatccctcttacaggtggggaaactgaggtaagacggtcagggctggccccagggcgtggcgggccctcggggcagtcgcccagaccacccggacggccccgctcgcagccttcgcccgccccggccaacttttcaaccgaccgtcgcgcgccgtttacttccgccttgggagataatttccgggtcccggcaggaaagggtcagccgcgcacggtggccgcccgcgtgacgtcagcgctcgtcgcagccatcttggctcctggcagcggctgcccaggcctcggtcgtgggctgggcggccatgttggagtcgggcagggctctcatatccggtcactctccactggcgatgatcgattgcatttgacggacgcgacgctggtcgagagtcgctcgcgttgctcgacgttttctgcaactccaggaccgtaaaatatctcgaagacggcgaaagtcgcagacccctgcagaatcagatgatccagaaggatgcccgctgtctttttggtccatttcagttgtaaaccaagaagtagccgggacaggcctcggtgggcttcggagcgtggctcggcaaggtcgaggtcgcgcctggggggacaggtcgatgcctttctccagagatggttttgaggcctccgtatttaaagggggaaagcgggctgcggggtaaggaaggctccggtcctgtttctgagcccacggtgggaagagaaaaggaggggcggggggtggggggctggggtcgccgatgatgcgtccgcaagatgagggcaatggagagtgagatctgacctcgcgtctgtagttacctgcccaacaacacagggagaggcagtaacttgaccggctccgtcttcggcttcgttctgtccttttggcagcctgaattggggtcctgagcttttactttcacaccgtcctccacagtttcctaaatgggatctggaatgcttcttccctggcacgcctgtgagatctgaggcagaagccagtgtacagaaacaggtgtcgcatcagtaggcattctccagaggccgaccaatatattggagagacggattaatagacggatgatagtgggtttgtcaggggaattggcccatgcggttagggaggccgagaagtcccgggagggatgccatctgcaagccggagacctgggatgctggcagcctggctcggtccaagtcaggaaacggaagaaccaggggagctaaaggtgtgactcaggccagggctgaaagctgagaatccaaggagccgctggtgttaagtcctggagtcccaaggctgggggccctgtccaagggcaggaggaggaagagagagtcccagcgccaggaacaagagcagaacttcttttccctctttttttttttttttttgacagagtctcgctctgtctcctaggctagagacagaatgcagtgcagtggcacgacctcagctcactgcagcgttcacctcccaggttcaagcgagtctcctgcctcagtctgcagagtagctgggactacaggtgcatgccaccatgcctggcaatttgttttgtattttttaggagagatggggtatcaccatggccaggctagtcgcgaactcctgacctcaagtgatccgcctgcctcagcctcccaaagtgctgggattacaggcgtggaccatcgtgcccagcccctttttgttctatctgggcccccaggcgattgatggtatccgcccccatggagggtcttccccttggtcccccgacccccaggcaggctcctctggaaaccccctcgcagacacacccagaagcagcgccttatgaggtctctagggatcccttcacccagccaagtaggtgcttgagatgacccacggcaggtcggacatctccctcctcgtccactaggacagtgtctgatttgccctctttccctccctgcataagctgatccagagaattgtcacaagacagagttacaaatttagtttaaagatcctcgtgggctccattcgtgatgctagattcgggcaaccgcttggctctacagagagcagggagtgccccggggggctgaacagaggaggctggttttctagacggaagggctgaggaaagcggaaacagaaaacacggatcgctcacttcgaagctgcttttcttgtaagggtgaaagcagaagagaactccttattgtaccggcaaggatcagcctgtttggggatttggctgttattactctcctggtttctcagaagttcagataaacaacttagcttcagtttggtgacatggaactttttttttttttgttgttgagatgaagtctcgctctgtcgcccaggctggagtgcagcggcgtgatctcgggtcactgcaaactccgcctctccgggttcaagcgattctcctgcctgagcctcccaagtgtctgagattacaagcacgtgccacaacgccttgctgatttttgtattttcagtagagatgagggtttgccatgttggccaggctggtctcgaactcctgacctcaagtgatcctcccgcctcggcctcccaaaatgctgggattacaggcgtgagccaccgcacctggccaccaatggcttcctatagatttcatttaacagaaggaagggaggggagagggaggctgtggtagaggctgggggatttgaggagaggctgcagaggttgctgtgggtgaggaacgggtcccctctggttccctgaggagggctgggagatgcagtgaggtctttctgatgcaattttctataaaaatgccgcccaaatctggaccccatggtacctgggctttgagggttagcagagcctttcatgatgtcccagatggatcttgcagagacctcagtagagacggtgcagcggggagggtgtgggacaggtctgggtgacttgggacatggagccaacaggatagggtgttcctggcggcttctcccaaacaggccacatcaggatgtcccagggaagtagcacaaacccaaactccgtgtgcgcccttggcccggaacctctgggttctggagcaggctcggatctatggagggtttgcctttggagcttccccgggacgtccagtgggctctgggctgccccgggctgctctgcccaaaaggaggctcccacactgagcagccagtggctagagcactgccctgtggggaggcagacctggttctccggacacttgatgtggacggggaccggctggcctctccctcagcagggaggaggtgtggcatggagggacggctgtccacacggctgtgtttggcttgggctcctggctggctctgccacttattaggtggctggcatgggtgagtggcccagcctctctgaggtctgctcgttagaggacggggaggacagtgctgcccagggcttttgggagggttgactgcagcgctgtgtaaagtgtttgcacagtgcccgccaggggtaaggtgggcatcatgaaaaataatagaggctgggggcggtggctcacgcctgtaatcccagcactttgggaggctgagaagggaggattgcttgagctcaggagttcaaggcctgcctgggcaacatagcaaaacactatctctcaaaaaaaaaaaaaaaaaaaattggcgtggtggctcacacctgtcgtccgggctactcaggaggctgaggcaggaggatctcctgagcccaggagtttgaggctgcagtgagctgattccagcctgggacacagagcgaggccttgtctctaaacaaaccaaaaaacatgaatactggggtatgcaaagcgcttagtcataggtgaacttaaatggaaactattaattgaaatcagggctttggccaggcgctgtggctcacacctgtaatcccagcactctgggaggctgaggcgggtggattgcttgagtccaggagtttgagaccagcctaggcaacatgacgaaactctgtctctaccgaaaatacaaaaattagccagtctcttaacccagtctcaaaaaaaaaaaaaaattaaaaagttaaaaaaaaattggaggttacgtggttctggatgggattttttctgttgcctagaaattgtatctaaggcttaaatgtgaaaatagaaagtgcaaagtactcccatgaccgagggtgggacgtagcctcagaatgctggggtctgatacctgcccagtcccatgcgagaggctgaggctggcgctggcgagactcagtggctggtgggggctcaagctctgtggtgagaattctcaccatggtcttcagttacccctagagatgcctgcaatggtgtgggctgagtcccactccccagacggggaggtggaggacctcagacagccactgtacccacaagagcaggacaaggagaatggagtgagctggcagggctgggggtgggggcacccccgcacctcaggagcaggcgggcaggctgctagtctgagaagaggccacggtcttgctgctcgcaggtgtggggggtgaacatctcagacttgagacgctcttgtgaagacccagttcagggctggagcacgtcgtaaggttggtcagagacaatcctcaaaatcctctgcctgggacccccgacccccactccacgagggcaggtgcaggaaagaacaaccaaatatattccagcatcggaggacatgcaggctgcacacaagcggtcagcccacagagcagcacgtcgggggttgcagccaaggaataacgtgaagggggtcttgaaagagctgtgtttacagttcccaaggagataaatgagggaagaacaacaaagaagcaagaacagggaaacatgcaaaaagaacaaggagccaccttcacatgaaaaaacataattgtggccgggcacagtggctcacgcctatagtcccagcacttggggaagctgaggcgggcagatcacctgaggttgggagtttgagaccagcctgaccaacatggagaaaccctgtctctactaaaagtacaaaatcagctgggcgtggtggtgcacgcctgtaatcccagctactcgggaggctgaggcaggagaatcgcttgaatccaggaggcggaggttgcagtgagctgagatcgcgccactgcactccggcctgggcgacagagcgggactctatctcaaaaaaaaaaaaaaaaaacagtaacataattgtagaaataaaacctcaccgatgagttgaatgacagttgagtccccgctctggagtgaaggagtgagccctgacagaaccagggaggttacccccgacagggaggaacagtccctcacttgatcaggtgcgggctcctcaaggttgatttgtttgcttttctgtgcgtaaacatttggcttcataagacatagaataaaaccatgtcatttctcatcctactaaaaaccagtctaccaaaaaatgccaccatgaaccttttcacacctgtaactttatatacgtgtgtgtgtgtacatatcatatatatctcatacggggctgagggctcaggcactgccccttggtgcagccgtgggtggggggcctcaaggactgtgtgggagtccccggggtctgtgaggcccgcaggaggcaaggagaggccgagacccccagggagcgcccaggcctgaacccctcctgcgccgctgaccctgcagatgctgccgtgggcggcgaccgcacagacatcccctctgctattgctgcgggaccggcaaggacgccggaccgacacggcctccccatccctgggtccaccccgactcccatggtggggagcggccggcttggagcccctgtgggacggagtggaggtggagcaagtgcccggagctctcggccatcatgtgcgaatgttttgctccgtgctgacgcctccctcggcaccgtcctgtctgtgttgtggactgggcagctctcacggggttgggcgcttctgcccccgggggacgctggccggcatctggagacgtctgtgatctccgctggtgttgccgcaggcatctggctggtggagcccggggaggccgcccaggaccctgcgacccgcaggaccgccccgccgcggaggacggccagccccgaacccccagcgcccggggcacccctgcctgcctgccctgggcggatccccggggccgcgcggttcgggccgcgctcctgcccgctggggtctcccgccgtcctcgccgtcaccaccgggtggagccacaggtccgtgtgatcgtccccgtgaccccgggttccggaaggatcctcacccaacgctggcccagcccggctcccaggacccttcacaatcctaaaaccattcgggcttttgtttacgtgggcggccgctgtggacattcactctaccagaaacagagcatttaaaaatgttcaccttttcacgtaaaaatagcaataaatccattgcacgtgaacatagcattttaaggaaaagcaactgtttccccataaaaaaaaaatgtagtgggaagaaaaagaaggcgtgactttgtgctggattctcatgtctgcgtctgcttgcaagccggtggcctccggaacattccgccccacactttcaggagagtgggaaggaggccgggcgcagcggctcaggcctgtaatcccagcacctggggaggccgaggtgggctgatcacctcagggcgggagtttgagaccaccctgggcaacatggtgaaaccccatgtctactaaaatgcaaaaatgtagccaggcgtggtggcggacgcctgtaatccgagctactccggaggctgaggcaccagaatcacttgagccctggaggtggaggttgcatggagccgagactatgccatatgccatcgcactccagcctgggcaacagagcgagacacagtctcaaaaaaaaaataataagaatgggaaggaaaccgttcttagaagtgtcaggaaaacaggtttgacctcggggaccctggaagctttctgggtcccctttgagaagcatggtctggacacagccgccagatgcctgttgtggggtctttaccaacgttgctttgcttcattcattcagagatggagtcttgctctgttgcccaggctggagtacagtgtggcacaatctcggctcactgcaaccttcgcctcccgggttcaagcgattctcctgcctcagcctcccgagtagctgggattacaggcgtccggcaccacgccgggctaattttttgtatctgtagtagagatggggtttcaccatgttggccaggctggtcttgaattcctgatctcaagtgatccacctgccttggcctcccagagtgctgggattacaggcgtgagccaccatgcctggccatgctttgctgcttttaaatctttttgttgaagacgaggatcagacatatgttattacagttttcagagtagaaaccagcttgagaaaatcctatttataaccacagtcactctgggaggtgagactcctcagtccagagtcactgaggtccgaattgttggggaattactcacagaaaccccagaagcagctgaggagaagtggggccgagatgggggcccgcgagtacagccaggctgtgcagaaactcggagtgtggcacgtgggctgctggggctcagccaggcccgtctcttctcttttgaggttggtggaaatgctgggctgatgtcattatgggtgaatcgtgctaccttaaaaagttttttttgagacaaagtcttgctctgtcacccaggctggagtgcagtggtgtgatctcggctcactgcaacctctgcctcctgggttcaagcaattcttctgcctcagcctcccgagtagctgggattacaggcgcctgccagcacgctcgcctaatttttgtatttttagtagagatggggtttcaccatgttggccagactggtattgaactcctgacctcaagtaatccatctgcctcagcctctggaagtgctgggattacaggtgtgagtcaccacacccagccaaaaaatgtatttttttgagacagggcctcccttagtcacccaggccagagtgcactggcgccatcctagctcactgcagccttgacctctcctgggctctagtgatcctcctgccccagtctcctgagaccacaggtgggtaccaccgtgcctggctaattttttaatgttttttttttttttttttgatagagacgagggctcagtatgttgcctagggtggtcttaaacttctggtctcaagcgatcctcctgccttggcctcgcaaagtgctgggatgacaggaatcttagtactttaaacaaataacaggttttcttttgggcagctgtgggttttctgaaacactgaggagacagagccgagcccccatctgtgccctccccgcagggtcccgtggaggtgacaccccacactggcgtgaaccaggatcgacgcagtttaccggagtcctcggccttcaccgaggggcctttccccatcctgggacagttcccgtctggctgcctgagcacccctgggctgtgaacccccctgggctgtggccatttcttggacttcccttggttttggtggtctgggcggttttgaggaggaaggtcgggatttcctagaaggtccctcaaccggggcttaccatacttttctcgaggctagaagggacctgtcaccttccctgtaggcacccgtgtccctcccctggcactgggaggaggtgaggggaaccccagagaagaggtcacgtagggtcaggcctggaagccaacaaggcacggggccaggggaggcctggtgcccttgggaggtgcaggggtcccgggagagagctgagcaccaggaggggtgcagaaggctgccccctccacacctgctgtgccccatttgttgtgggtgggggcaggggtctacccagcgggaacacgtggggcagcccccctcccctggcctggggcctcctcagcagggagcagaggctgtgctttcttttttttttttttttttttttgagacggagtctcgctctgtcacccaggctggagtgcagtggtgcgatctcctctcactgcaagctccgcctcccaggttcacgccattctcctgcctcagcctcccgagtagctgggactacaggcgcccaccaccacgcccggctaattttttgtatatttattagagatgaggtttcaccgtgtcagccaggatggtctcagtctcctgacctcgtgatcctcccgcctcgggctcccatagtgctgggattacaggcgtgagccacagggcccggcccgaggctctgctttcgtggggggctctgggtctctggtggctggactcggcggagggtccaggtgtcctcttggcttctctgcacaggcctcagcccacatcaggcaccccctgccccgcagcagagctcgcccctccaggcagtctcacgggaatgcacgttcaggccgcctttccccggaacccgcagcggcctttctggaggctgcttcttggtgactgggggctccttggagccgtccccagcctcaagcggctgcattgcagctcagggaccccgaagggaggaccacgttctgccgctgaagactcggagtcgcctggcaagacggagcgagaaggggagggtggctggcatggggactctgtctgctgcctcgcaccgcaccttggaggacgctccggccaaggctgggaggggcgagtgcggctgcaggcgcgcggtggcgagggagggtgaggatctgaccgggaggcgaggagggaggctctggcaagacgcaacgctttggcgccactgccggccatccccttgccacccaccatcgcccgccaggccctcacacctacctggtcctggcgacagccggtgtgtgaaaagcctgtttcctcccctagaaaaagcacgtttggctccgctctccactgacacgtttttagctgagtgacgatggaagccgctggcttttaacagacggtcttaacgagcctctgctccccggcgaccagcagacgcgggctgacccacggttttacacaccacgtctgcgtggcggcggccgggcggccccacggggcccgggcaggaggtgacggcagcgtttctcgccgcctttgctcagcgcgcctctcatcccctctctcctgtcgactcgcggcttcctgcagaccctcggcctgtctgcggcccctcgcccgcagcctccccagcagccgaggtttcctatagcattaaaagcaggaaagaaccagccctgctccccaggaactgaacttctgtggctcatcttcagagaagccactgttgagtggggctcctcgggggtgctccagctgcgggtgagtgacatgagccagacctccccgttttttttttttttttttttttttgagactgtttcgcttttttatcccaggctggagtgcagtggcgtgatctcggctcactgcaacctctgcctcccgagttcaagtgattctcctgcctcagcctcctgagtggctgggactacaggcgcctgccccacacccggctaattttgtattttaagtggagatggggtttcaccatgctgcccaggctagtctcaaactcctgagctcatgccctccttggcctcccaaagtgctaggattataggtgtgagccactgcccccggactgagactttcccatcttaacgcccacttgccccgtccttccgcccccacggtgcctgggggagccttctctgtgcaggacacaggccaaagcagaaggaggcaggaggaaggaaagcaaggcagtccttgctgactgggcacccacgagcctgctgtgtctgaatgctggctcacctagagttggggggctcagggacaggactaattctggaaccagactgcctgggttcacactctggtggtgttaccttctgcctacgtggttttaacctctctgtgctctggtttcatcagttgtgaattggggctaatggttcctacctaacaggtgtgaggattagataaatggatacatggagagggcaagtggtcagtgccatgtaagtgtcagccaaagatgatggtgacaatggtggtgaagactgtagtgatggtgatgatgacggtgaactgtagtgatggtgatgatgatggtgaagactgtagtgatggtgatgatggtgaagactgtagtgatgatggtgaagactagtgatggtgatgatggtgaagactagtgatggtgatgatggtgaagactgtagtgatggtgatgatgatggtgaagactatagtgatggtgatgatggtagtaaagactgtagtgatggtggtgatgatgatggccctcaccatcttggctgtaccacgtccagtttgctgtcaggacacagcctgaggatgccagacctccatgttgcagaaccacctgacttttactatggaatacacgtggactgtgaagtaataatattccttttcacctccctagagtcatttccattaaatcagaaaataggcgttgagaaagggatgtactagtgggtcccacttaaaaaagagcaagttgagtgtgaactcaagcaacaaagctcaacttagaggattcctgttaagtcatggaagggctcaccgttgggtcctccctggtggccccagtgcatgttgaacctctgggtcctgtgctttctaagcccaagtctctttcagggagttaagaacacttgtgcctatttttggggaaggaatttattcattattccaggtgtcaggtgtaagacattacgacaatttatcagatgctcagagcacaagctctgtttcactgaaagagtgaacccaggagatgctggagtggggggtggagaaggggtggagtgacggtaggcgcgatgcttatctgacgtgtgtgtgttgtcggcactgcggggccctcaggaaacgatcagcggagtggtttccctctgagcatgtccttgtggcctgcgtttatttagcacagcctgagctgggggctgctggcctggcctggggaggccctctgggctctgttggtggcttcccagagtgaggacccatttcagctcctcccctcactccacaccgtggagcctacattcccctcctggttcctgcctcattgggttttggaaacatcctcacttgggagactgaggggctcctagaagatctgctggggcctgatcttagaggaaaagcggatctgcgtccataggacggggtcgcagcacggagcaacgggcccggtgtgttgtggttgagggcctcgaaggggagcgagattcatgacccgaaaccacgccacattggcatcaggagtattgtgagctgcaggcaactgagatcaacagaggcagaaaaacggcttctcagagcttctcttctgactaaaaccagcaactcctgggacctgaggctgctacaaattccttcttcacggtgattccgttcccagaggggagaattggaataaaacatgccccaaatctctgcttggggggaccaagacagaaacaccgcttatgcctgtattatcataaactaacttccttccttccttccttccttccttttttagacagagtctcgctctgttgcccaggctagagtgcagaggcgcgatctcagctcactgaaacctccgcctcctgggtcaagtgattctcctgcctcagccccccgagtagctgggattacaggtgcgcaccaccatgcctggctaattttttttttttttgagatggagtctcactctgtcaccgggctggagtgcagtggcgtgatctcagctcactgcaacctccgcctcctgggttcaagcaattctcctgccttagccccccgagtagctgggattacaggcacgtgtgccaccatgcctggctaatttttgtatttttagtagagagggggtttcacgatgttggtccggctggtcttgaactcctgacctcgtgatctgcctgccttggcctcccaaagtgctggggtgacaggcatgagccaccgcgcccagctgcccagcaaatttttgtatttttagtagagatggggttttgccgtgttggtcgctaggctggtctcaaactccaaccttaggtgaactgccctcctcagcctctcaaagtgttgggattacaggcgtgaggcgcccagacaaactttttccattgtccttctaaaagcccttttgtcttttttgaagaaacctatttgttcttcccctcagaagccttttctgctgcccccttccctgacctagtgaggatacaaggcagtggtttccacgttgctgaaccacccacttcttttgttcgctgccgcgtgcttgtcaatcaagtttttcatcctatggatccgtcttttgtcagtttaatttgcaggccccagtcgcagaatttaagaggacagaagaatggtcttttgttcccaacagcctccttcaccaccacaaccccactggctgcctcaccttacgtgtgacacgctcgtcgaacttgccagcaaacccgggaggtgaggattgcgtgtgatgcccaggcagacacagtggcttttcatgagaacaaagcgttatcaccttgtgcaggtggctgagagaagaggccctgggaggcaggggagggccaggtgcacacctatggggcggtgacccctggcagcattggggggctgtggatattggaaaacgtgaaaaagatgtttcagttttttcatgtgtattcttttctttctttctttttttttttttgagacagagtttcgttcttgtcgcccaggctggagcgcaatggcgcgatctcggctcactgcaacctctgcctcccgggttcaagcgattctcctgcctcagcctcccgagtagctgggattacaggcatgcgccaccacgcgcagctaattgtatttttttttttttttttaccagagatggggtttctccatgttggtcaggctggtcttgaactcccgatctcaggtgatccgcccacctcggcctcccaaagtgctgggattacagggatgagcgaccgcacctggcctttcttgtgtatgttttaaattggtttcaaaatgtctcatgtagaatctttggtggggaggtatggatccaccacgtgtcccccactgcacccacagctgtcaccagagcaggagcggcctgtccccgccagctgggtgctacctgccgaccagccaggagctggggagggtgggaagggttgtcttccaatgtcaggttttcattgaaataccttttcattgtgagcttttaactccggggttgactccgcctttcctcccttcttgaccctcctacccgccccctccagccctgaggagctcagctccccacacggctgcccggaagtggcctctcttgacagccgcctctcatcgctaggcctgacccttctttcttcacttgctggccgctgtctcagcttccccaggtgttccaggagcttggggagggctggacctgcaggagggtccccggcagcactgggacccagggtggggacaagctctgcctgttcttccaggctctccttgaacctggcaccccaggtacacagcatgctttcctggaacagtgtgcccccaaaattctcatctagggagcctcaaatatggccttatttgcaaatacggtcattgcaggaggaattacattaagatgaggtcagactggagccaggtggccttggtcccgtgaccagcgtcctggtgagaggaggaatgagacacgggttggccatgtggacggaggcggagatcagagccatgtgtctacaagcccgggagcactgagggtttctggagtctccagagccatgagggaatgaactggtgtggtttggagcccctgctccttggcggccacaggatgtgaactcacctggagcctctgggcctcccccaggtgcaggtgggaccagcctggctcctgccgtcctgagggctgcagccacggtgtcacggctccttctcatccagtggcaggtcccacagggtggggacacccttccctgacttggtgactgcactctggcaagaccccctggaggacgctcgggccctctgcagaggagcagtgagctcggggggttcagctgcgatgtgagtctgggggctttggcatccagacccacacggagcatgtctgacccacgaaccgaggcttcagtgaggcccagacattgggaatggccaggggcagccccacgcgtggccaccgtagccccccaccctttttaccaggcttggctgctgcggaggtgggggaaggactccggatgtttctcatcagaaactcggattttagcttgtgagtgtgaggggttgtacccacactttcatgtagacacagaaaagtgatggttctgaattttagggagttttttttttttgagatggagactgtctcccaggctgtagtgcagtcacgtgatctcagctcactgcaacctccgcctcttgagttcaagcatttctcctacctcagcctcccaagtagctggaattacatgtgcccaccaccacacctggctaattttgtatttttagtatagacagggtttctccgtgttggtcaggctggtctcaaactcctgacctcgtgatctgcccgcttcggcctcccacagtgctgggatcagaggcgtgagccgctgcgcccggccttgggagctccttttaaatcgtgctgcttttcaagggaaggattctcaaggctgtaggaggtttagaatacagcgtgtgctggtgcggcctgtgtgtgagcgagagtgtctgccgagaatcatacgggccccacttccgtggaaaacaatccgaattccctgtgtatcacgggcagaaggctgaaggaagtctcgagccaccgtgcggagagtgaagctggcggtgtcgcggtaacgcggtggaaacgcgtgttttgattcgatgtctgtcccgatgctgggtttcacggtgaggtctggtgtcactctgcattgcctggcttgggcagtaaccctcttctcttggtatgagggcaaattttggttctgaaaatcctttccagggtggctttggccaggatttgggattgcggtgggtttgcgttccggatttgggattgcggtgggtttgcgttccagatttgggattgctgggctcgcactgggatagtttggaagccgtggccactcttgtatgttatgctggctcatggtcagcctggcctctgggctatcccttagatcccttgaggctatttggggtctgtatcttcccaggagaaagtgaaatatcctggatgacaatgtcgtctgatccaagaaggtccttaaaaatggaacctccagaggatattaaaaccctgagacccccccagtcccgggtctgcttcagggagcattaaccaaaggcctccaccgcctgcaaacgtcctgtcattctccaggggctgggccagggctgaaggcccccattgcctcctgtgagcctcacagccgagtgccggggacatgaggggataccacgggactctggggctgggaggcacatcagagccttgtatacacaggggctcaagaaagacgagaggaaatcacagaaaggcaaagagcccaattaacagacaggcagaggacccgacctgacgcctgtccacagcaggcccacgacggccagcagcggggggagctcgtcacactaggcccacgacggccagcagcgggtggagctcatcacaccgtcacactaggcccacgacggccagcagcggggggagctcgtcacactagggggactctggtcctccgccttgaccagcccccacctgccgcccccagtcccacgttggcagctgtcccctccccaggcccggcagcgtgtagggaggcctgggtcccccgagtctgtggacaaatgtggtttggggacaccagcccctgccgaagccatgaaactcagggagagtggatgccacccctggtgtcttcgtgctgtgtcgggaaagggatgctgtggcagggacgcacctgagcgtccaacctggtcctggggacgggggcggggtggggctccacatcccggcaaggcgtcgggagctgtgagcccgtaacacaagtcattacgatgctggctgagcgtgggcctgctgagagccctggtgggcacgccactgtctcgtccatggcaccgccgtcccatccgcggcaccaccatctcgttcacggcaccaacgtcccgtccacggcaccctcgtcccatccatggcaccactgctggcctggccaggatgcatccctgcgggggggctgcccctgctctgaggatgtttgcagcctcctcagcctccactcacctgatgccagcagcatctgtgattcgagatgggcaaaaacatcccacgttgccctggggtgccctggagggcggagtcccccggggtcttctctggacagtgagaagccacgatggggcattggtgccgattccattcgcgtcacaaagccctgcctcttaccaaccggcgggtgctcagccggccgcctctgcccttcctccctcccccacagaccccgttctgtgcaccccagaatgtgggctgacttttgttcttcaccgtgagagcttccgggaagcagaggagagcgggattccttcctccttgtccctctccgagcgggagggtgatggccgacggcatcggggcaaatgtgttgctttgagaggctgagaggaggacgcgtggcccccaccccttcccatgtggcttcgtgctgtgagccacaaacggccgtggatcccagagccagactccgggcccgcccagcccagggggagggcggactgccaagctcaagcacgcggcctcggttcagggacaggttccccgtgcggcgaggggcacggtgggccgagagccagatgagaacccgctgcctccacgcggccgtgccctctggcagcctgggctggagggaggtttgcacggctgctagacatcttccttgcaggatccctggggaattctaaatttcagtcacactctctaaattttcattaagagccttcacccagagaaaatgatggattagattttgttgttggacaggagccagataaaattagatgcctcttttacttcccagcccccacccctccgttctttcctaaaacctgtacttttctccctcggttcccatcaaaccgggatttgagaatgtttatttgctaaaagcgattacgtacagccgcttcctttgagcctctgcttttattttctgtgtgatttcgccgtcattccactttttaaagtccgggatggctttcggtgtcgagcgctgtgggtttgagagcgagagggttgcttgtggtctctttgtccccttcaggaaagcgtgtcagaattttacagctcaaagctggtaagatattttgctgcacaaagtaaattaatctgattcctcatccgcctctccttctccctcccaagttctctttctctttgatgtgctaacgtgctccttcggccaccgaaatacaactcagcgtttgccacaaaactgctgctttttaacccggccggatttccgtgggctgcgtgtgctgtggtcgccactgtgcctgtggatggtgaattttaaaaacagatgtcggcccgggagcagtggctcacgcctgtaatcccagcactttgggaggctgaggcaggtagatcacctgaggtcaggagtttgaggccaccctggccaacgtggggaaaccccatctctagtaaacacacacacacacacacacacacacacacacacacacacaaaattagccgggcgtggtggtggcacctgtagtcccagctgcttgggaggctgaggcaggagaattgcttaacccgggaagcagaggttgtagggagccaaaatcaaccactacactccagcctgggcgacagagcgagactccgtctcacaaaaagaataagagggtcggggaaatgtgagttttttttttttttgttttgtttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgaaatgtgagttttaaactaaaaaatgtaaaagccgtttcaagactcaccaggccgaggagggaggttctctgaggagcggctgtgccttcggggagcggagggtgcgcacacgtgtctctgtgtgtctgtgcgtgtccacgtgtgtctgtgcgtggtagcacgtgtacctgtgcacgtgtgtgaggtggttttgggagacctggccctggctccacctctgctcataaacactgaggatgtggctctcaggccaggtgtgaagacttctccccacctgccttccgggtgacttcctgaggtcgcttccaggcctcagacctggtgctctccccacctgcctgaccccgtcgcttccaggcctcagacctggcttcgcgtctgttttctgaagcacctctgctccgctccccgagtctgtctcatgggtttcgccgcctgattcttgggcggccccttgcaggctgtggtcttccgtgcaggttggtctcccagtggttgcagagctggttctggtggaacccctgcccttgggctgcactcgggaggtgccagtcactgtgcccagggatttcacggacctgcttgtcactacgctccccggagtcaccccagggattctgggagggtccctgttgcacaaacaaggaaaccgagacacaggacggaaaacgggccacggaaaacgggccggcctctgctgcctgggttgtgatgaaggcctcgggaaacgggccggcctctgctgccgggttgtgctggaggtctcagggtagctgtggaagctgcacgtgtcaccttatgtcatggctgcaacggcacgcaatgcacgcacaacatgtgtgcagacacaacacacacacaatacacgcgcatacacagacactcgctgccaggcacaggaacacacccctcccctcatgccacacacgtgacgactggagcccggacgtgcgtcctggggggaccctgctgtttctctctttgccccactgtgtcctgggagaatgtgctccaggaaccttgcagcagacaggacctggaagggtgtctgtcccaggcccggggaacagcccagctcaggcctggggcgcgggcagccaggcaggggtctggcccagtcctagccaggggaaatgaactctcggcctccagggtatggctggggcctccgtgcctggacccaggtcagacgagtcactcacgcatcccgaaatcctgccagaggctggaagccaggtgcattaaatgtgctgagatttacgcgcccagggcactggggacctgaaccaacagtttgttcaaaagcagacacctgcctacaacagggttgttgtaaagctggattcaaacactgagacttgtgcgatgaaatggacccagggtttgtgtttcaggcctgaggttggaggcaggaggcagggagggacgctgggccgaggcctcgtctcctggaggctctgaccccactggtgcagggtggcgtgtgggcaggggcacctcgggaggggaggtttgacgtggagcacgggagccgctttgggtgggaagaccgaggcctgaggggcactcaggactctctctatcctcgggctctgtgagctagagtggggaatggggggagtggaccgggagcctctgggcggccgacaatgggaaggcccctgacctgggagtctgggggccatcactgtggcagccccatgccctctgggaaggtcctctgctctctgggtggggtccgtgggactgtgttatgagcaggcccctgatggcgggtggggtcctgtccctccgttcctacccagccacgggtggcagttctgtcttcctcctgcatcagccgacagccccttcccaggagctctgagtccgcctgctgctccggggccgctggggtgaggacggggtgaagaggcgcggccctgtctataccagcaccgccactgcccactggggcccacatcccgcccactgggaccgacatcccgcccactggggcccacatcccgcccactggggcccacatcccgcccactggggcccacatcccacccacggcggccagggacagacgtccttcctgtgtcttgtgtcccttcaccactaccagcccggcacgtcctttgcccattctcactccgacactgacctgagatggggctgccccacacccgggcacacacccgggcacgcacctgggaaggcctggatcctgttggctgggaagaagtgggcaggtgggctgtggagtgggcagtgctgtttgcattgctgctgatcagaggtgcctcctgctgctgtgtgaggaggccgggcctccccggagtctctacgaggtgctctcagagagattcgaggggccccgggcctctggcttctgtgtggggtgatgtgggaggttggggaatggaaaagccttctccctccccccatcattaggaaagaaaaacagtttccatggggccaagtttattttattttatttattattttgaggcagagtctccctctgtcgcccaggctggagtgcggtggtccgatctcagctcactgcaacctccacctcctgggttcacgcaattctcctgcctcagcctcccgagtggctgggattacaggtgcccgccaccacgcccggctaactttttttgtatttttagtagagatggggttttgccatgttggccaggttggtctcgaactcctgacctcaggtgatccatctccttcggcctcccacagcactgggatgacaggtgtgagccaccacccccggccggtgttaactgattttaaagtgcacgcttgggcggcgttcagcacattgcagtgtcaggcggccctcacctctctctagtcctgaatgtcctcatcaccccaaaaggaaaccctgtctccatcagcactggctcaccaccctttcccaagcctgagagcctccacgactctctggcttggcctgttctggatgtttcgtagaaatgggatcagacactgtgtccctctgagcctccgtcgctcgaggtcctgcctcaggtttcatcccggtgtggtgtgtgctggggcctccttccttcttgtggctgagtggcgctctgtgtgtggccagcctgtgtgtggtttgtggctcatctgtgagtggatgccaggctgctgggctgctggcctgcatgtggttcgtggctcgtctgtgagtggacgctgggctgctgggctgctgggctgctgggctgctgggcgcagtgcgtgagatgctgtggttgtccatgcaccggctcttgttggacagaggtttttgtggtgcctggacgtgtacccaggagtggtgttgtgggaggtgttgtgggtggtgctgtgggcgttgtggcctcgggcgggatggcgtttggttcactgcgtttcccggccggcgtctccttctgtcatgaaatgctcagtgcccacgcacggtccatactggggtttggtaccgtccacctacggattaaaaacgttcacggatatctgctttcaaaacacccaggccggtcttgtcggcagagccggtctcaggccacctcctcttttccgaggtaggtgagactctgggaagggaaggagcgaaggaggcaggcttggagccttgaccacagggaggaggggaacctgctcctggatgcgccggagcccagcccggcttgtggaacgaggctgcaggagcctgagatcggggactgccgggcctgcgccacggagggtccccagggggacgggacagccttcctgcctcttccagcccctggcgctcagctttgccttagctgtggcctcataactccagcctctgccttggtcgtcatggccgtgtcttctgactttggatttagggtccgtcttgatccggtatgaccgcatctcaatgacgtcggcaaggaccctgtttccaggcaaggcagctttttgatatttgagtggtcggaggcactgtttagccaccttgctgcctcctcgtaggactgaagggcatttttcccttgagcaggagactccacacacgcggacactgacgttgagccgcagggctggtcactgtccccgtcccgtggcaccgcacgccagggcccggcaccttctgccgtgggtcacgtggccttgggtccggcccctgccagaggctggggccccagggacccctctgggctagaaggtgctgctgacacaggcgtttttagataagcaggaagctcctgagaggaagctttatttttactttgttccggcctctgtggtttttggagatggcctttaaagatttgttttcgattttatctttaaagaagatgcaggaaagcccatgggtcaggctccagaagaaatatccgggaggaaggccctgagcctgggacggcggggccaggaggaggcccctgagcctgggagtgtagggcaggggctgcagggatcccaggaggaggcgctcccggccccgcatggccctgtgtctgcagtccctgcctgggcctgtgggcctgctgtgtggtggtcctggggcagggctcacagagcctcactccccaaaaccccagcctgtgtccccgaagggccccctctccttagaggggtttagtcccaccaggtgggtaaagttggcctgcgttgctgggctggtttcaagggagggctctgcccaccatcatcacgggtcaggaaagccctgccgagccctctgtccttcgacttctggcccagcgaggcacctggagcaccccgtggctgtgttgaacgtcacagaggctgccgggcacgtggggacggggcccgctgggaacaggtgtgggggccccagctctgaccagcgggtgcctgggaggggggttctccttggacaagagctgcctccagccccttggtccagaaccccttgtgccaccccggcaccctccgccctgtgagttttttccctctgggagacgtttactttcctggcagttggccagcgtggcactcacagaaaaggccagggcagcccctcagcccctttcctgaggccacaccgccctgagagcagggtgcgtgccctcagcagaagcaaggaccagggcctctcctcccggctggggcccgggattctgagacccatctctaaggccagggcagggccggggcgggggacgtttgttaaatttttaggaaaaaaaagcaaaatcaacacagaaacaaatggatgaacctgccaatgggtggggcctgtggactctgccccggccctgctcagggccctgtggcctcagctccttccctggtgagacacccaccctgccccatgccaccagtggtatgacgcaggggaggagcaagacggggaggggcttggggggaggggcgtgggggggtggagtgtgaggggggagggggtatgaggcaggggaggagcatgagggtggggagggggtggggtggtcagggtgtagggtgaaggcgtgagccacagtgcccggcctctctcttttttttagagctgggtctcactctgctgtccaggctgaagtacaggtaagatcgtggctcgctgtgctcaagtgatcctcctggcctagcctcccaaagtgctgggacaacaggtgtgagccactgcgcccccctccaggtttagctgtgggatgtttgggctttgaaaggagctgatctgacggagccaggagggctggctgcaggacagagacaggacggctgtcacagcagcctctgcccccagccggtgccctgtcctcgccgtctctgtccaggaggtcagagcagtagcacccgccccgccccgtccaccctgtggatcctcagcccatccgccaccccgccccgccccgctccgccccatccaccctgtggcagaggcttttcatggcagctccgagaacaggaggacagtcacctccagcatttgctctgagtctgttccctggcgaggtgaggccccagctgttttagcgctcataaaaatttacggccatcacaagggagctcagctgggtggatcacggtgtcggggcggcgcccctgtgagctaccttttgtgagccgctccggacactttggctccgggctggcatctcctgccaccctcatgagagcagtggctgcagcccccgcctcttgggctggccctgtcatggcagcaagggctctgcgtgtgtacggccgccccctgcaagtgtgcttgttaacggggactgtgaggaactgtgggggactcagggcacggggaaccggggtcgggctgaacattactccctactctgaaaggacagcgttgggacaatgtggccaggctgcgtgaggctgagtggggcagcatggccaggaggggcgaggggagggggtgcgaggcaggaggctggaagtagggagaaggggtgttccactcaccatcacccatcccaccaatctcgctcacaaatccctgtagtctgcagtggctgcctctttattcctggaacagtggcttgggttggggtctgcgtcttggatgggggagagcagggggctcatgcccgggagcccatggacaaaggcacctgctccatggtagagaaggttctgccccagcaagggggccgtcgagcggacagcccagggcagccacatggggaggctgggttggggacagcagccccggcgcctctcccggagaagcagcctccccaagctgtgcctgagccgagggcaccgtccaggtcatctcagccagagccttggccgggtctaggggaggggtcacgccaacgtgatgacctcctggcagctgtgtgacttgaaggttttcaagcaaaggctgaatagcccggagaacatccacacacccaggcccagggtcagccatttcggcaacttgcccatatgtgttttacacgttacgcacatgcctttgtgttttctgcccaccgttttgaagaaagcagcagacactgtgactgtaaatacttcagcgtctcccgacgtggggacactccc

SEQ ID NO: 381 - DNA, 6812 bp, Homo sapiens
ctcttatgctaagattaattgattaactccacctctccaattcccataacttattacacaatacttaagctatgactaataataaaatacatactcatgtgccaatgtcccagcttaagaaataaaaaatgacctaaacagtcgaaacccctatttccccttccctgatggtatcctctacccatccctccaatggaattgtttttcagtattagggatttgtaattctcatgcatggctttatcatttccttcatatgtatgaatcgctaaatcatctatattgttgtttggcatattttaaaactttatatcaatgtcatcatattatgtatgtattttgttttcttccctgagactaattttgtactatgttggtatatgtagctctgcttcattcatttttgtggctatataatattgtattttatgcataattataatacaattcatttatccattccatttttgttggacagttacagttctaacagtgtattcttttgacccactaaagaatgttgctgtgaaccttctcatagatatgtccttgggcacataagcacccgtttatctaggatatgtacctaggaataggacagctgagtaaaagaatatgcacctggtcagtctgacaaggtaatgccaaactattctccaaagttgttgtattagtgttctagggctgccacaacaaagtaccacaaactgagtggcttaaacaacagaagtttattttctcacagttctggaggctagaagtagagatgaaggtgttggtagggttggttccttttgagggttgtgaggaagaatctgtcccatgcctctcctctagcttctggaggtttgctggcaatccatggcgtggaggagcagagtcccagtctctgccttcatcttcatatagcattctccctgtgtgtgtgtctctgtgtccaaattttccttgtttgtaaggacattattcatactggattaggacccactctaatgacctcatcttaactaattacatctgcaacaaccctgtttccaaataagttcatcttttgagatattaggggtttggactccaatatgtcattttttggggaaacagaactcaacctatagcaattgcttacactcacatagcattttattgtttgaggattctagttgccctacatccttcctaatactttgtgtggtcagactttaggttttgatcatcttttgggtatgaaatggcctctcatagtagttgtaatttgattagttttgagtttgagcatctttttatatgttcattccttgactggccttggtgtttgctcttctgtgaagccttttcaattcttttgcttttcttcttgttgatttgaatttgaatttttaaaaataaatcattgaggtgaactctttatcagatgttccaatctgtggcctacctccttgctttttttatttttttttattgagatggagtcttgctctgtcacccagccaggagtgcagtggcatgatctcagctcacagcaacctctgcctcccaggttcaagcgatcctgctgtctcagcctcctgaatagcggggactacaggcgtgtgccaccatgcctggctggtttttgtatttttagtagagacggggtttcaccatgttggccaggctggtcttgaactgctgacctgaagtgatccacctgccttggtctcccaaaatgctgggattacagacgtgagccaccacgcccggcccccactggcctttttttttttttttttttaatacagagtctcgctttgttgccaggctggagtgcaaaggcgcaatctcggctcactgcaacctccgcctatcaggttcaaggattacagacgtgagccaccacgcccggcccccactggccttttttttttttttttttttttttaatacagagtctcgctctgttgccaggctggagtgcaaaggcgcaatctcggctcactgcaacctccgcctatcaggttcaagcaattctcctgcctcagcctcccgagtagctgggactacatgcatgccaccacgcccggctaacttttttgtatttttagtgttagccaggatggtctccatctcctgacctcatgatccgcccacctcagcctcccaaagtgctgggattacaggcgtgagccactttacctgatgccctgcttgctatttaaacaaactgtgaaataatttgtctcaatttataaaaataatacagagagtttccatttactcttcaccctgctttccccaatgataatatcttatataaccacagtacatttcaaaaccaggtaactgacattggtacagtactattgagtaaactaaagactttattcagattcagatttcatcagtttttgcatgtactcttttttttaattgttgctctatagtagtatgaaatttcattacataaataagatttatgtagccaccatcaccacaataaagatgtagaactcttctatcactacaaagaaaactctcctgtgctatcttccctccaatcttaacccctggcaactactgatctgttccccatcactataattctttttgcttttttttttttttttttttttgagacagaattttgttcttgtcccccaggctggagtgcagtggtgcaatcccagctcactgcaacctcggcctactggactcaagcgattctcctgcctcagcctcctgagtagctgggactacaggcatgtgccaccatgcctggctaattttgtatttttagtagagacggggtttcaccatgttggccaacctagtctcgaactcctgacctcaggtgatccacccacctcggcctcccaaagtgctgggattacaggcgtgaaccacttgtgcccagcctcaaattttatttctactaaaatatataattattcttatgctacatttcttcatgtgtcagtctttttaaatttgtgtattttaattaatttgtccacttaacctcagcagttaaatttgttggcataatgttcataatattcccaaatttctttaaaagtgtgtatatttctctagtggtgcttcctctttcattccccatattgtgatttaaaacattttgggggtattttatctaaaggtttattaattttatggatttttgcaaagagtcaacttttggtttcattgattttctgtagtattaatctatatcccatttaagtgatttttatttgtatctttttctgcattctactttctttgggtttaatttcctcttcttcttacttcctgaggtagaagcttaggtcattggtatagaccttcttttctaatacaatcacatatatatctgtacatttatttctaagccttgctttagctgaatcctacaacttttggtgtgttgtgttttctttatcatttagttcatgatattttctaattttcttattttttaacctattggttgtttagaagtgagctgcttaatttccagatattcaggtattttctaaatgttttatttttattggttttcaatttaattgtattttgttgagagaatgtattctgtatattttcaatctttcaaagtctgttgagattaattttatggcacagcatatgatctatttttgtgaacatcctatgagctcttaaaaggaatgtgtattctgcagttgttgagggtactatcctataaatgtcagataggtcatattggtaatatttttcagatgattgatatccttactgagtttttgatcttatttttctatccattactgcaaaggtgtgttaacatatcattgtggatttgtctatgtctctgtagtgatctctaaggttttgattcatacagttagtaattttgctatgaggcacatgtacattaataattgttacgtcttcttattgacctttttatcattatggaatttcctcctttgttttttagcaataccgcttgtcttcaggtctgttatctgatattaatatagctactccaggcttttttttttttgagacagagttttgcttttgttgcccaggctggagtgcagtggcactttctcgggcgtggcttggagatgccacgaccaaacacctcttaaaggcctcctggcttcaagtgattctcctgcttcagcctcctgagtagctgggattacaggtgcccactaccacgcctggctaatttttttcctatttttagtagagacaggatttcaccatgttggccaggctggtctcgaactcctggcctcaggtgatccacctgcctctgcctcccaaagtgctgggattacagacgtgagccaccatgtctggcccattccagctttttaatatttactctttccgtggcatacctttgtccattctttatatttcaatctttttatttgcgtctttgtatttaaaatgagtctcttatagacagcatatagttgatttttttcttctttatccagtttgccaatctctacgttttgttggagtattgaatgcattagcactcaaatgttattgttgataagtaaggttatttctacttttgccagatttttctttgttttctccaatgtgtttttacttgctctgttttctttagcctacttttgttttaatgttttaataaaatactttttagattcttttttcttttttttttttttttttgagacatagtctcactctgtcaccgagactggagtgcagtggtgagatcttggctcagtcatcctctgcctcctgggttcaagggattctcctgcctcagcttcccgagtagctgggactaggggcgcacgctactacgcccagctaatttttgtattgtcagtagagatgggatttcaccatgttggccaggctggtctcgaactcctgacctcaagtgatctgcctgcctcagcctcccaaagtgttcagattacaggcgtgagccaccgcgcccggctcctttttcgatcttcatgttaatttctctcagctatctagctatgtatctgccttgtgtgtgttcatgacttttccagggcttacaatatgtatttttaacttaaaccaattagagttattatttgtttaaggtaatgtaagaatctcacaagagtatgtttacattcccctcatcttcagtgctgttgtcatatacattatttctgtaaacatcctaaacccaatactacagtgttaaaatttttaagccatcgtatagtaatacgtatttttaaagaaattaaggtaaatgtatgtagaaatatgtgtgtgtgctttatatctgtcacatttcttatgctcttcactccttaatgtagatacaagttgccatctgataccattttccttcatcctgaaagacttcctttaacatttagtacagttacctggcattggattttccattttaatctgaaaagattattttctctccagtttgcgaaaattaactggagatagaatcgctggttaacatatttttctctggcattgcagtgtcttctggctttcatagttttgtaatttttgttgagtaattattatattgttcttttatattttgatcttctctggctgtcttcaagattttctcgttatctttggccttcagcagtttgaccgtgatgtttctatgagccgttttctttgtgtttctactacttaagcattatgaagcttcttggctctctaagttttattttctattcactgtgagaagtacttggctattatttcaatatttttcctgtcccttttactctttcctctcattctaggactcccaatttacctgtatattggactgctggaaatatgtttctgaagattcatattgtctcataagcttctgttcatttttcttcagtcttttttctcttttttgaggggtgggtggatatatgtaatttctattcttttattttcaaattcactaatctttcttctttttctgtttgctattaaacctgtctagtgaatttttaaatttcagttgtttttttctttccccctcccctcctctcccctcctctcccctcccctcccctcccctcccctcccctcccctcctcttgtttctgtgggttttaggagtgctctcaggcaagaaagccacaaacaaaattattacccctttctgttgcaattttttgagcataaactcttccccatcttctggctggttatgtatattttccagtgcctttgagtagttatttgttatattttatccagtcttattattttctgctgcagggttcttgtgaccatttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaat

SEQ ID NO: 382 - DNA, 539 bp, Homo sapiens
ttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaat

SEQ ID NO: 383 - DNA, 6669 bp, Homo sapiens
ttttattccatacgcaaataagtagattcatttaaaaaaacaacaacccggaggctgcgacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgaggtcgctcacagccacaagcaggaagaccttccagcacagggctgggcacccagcagctctggggatgcacacattgtcagaaccgtgggaggcggcccagagaccaggcagcagctccaaaccaacaccccgcaacacaccaacaccccgcaacacacaaacacaaacgcacacccatgccagaggacaacaaagggatgcagagcaaagaaaagaaacaaaaatactacacaagaaaagcaggctgaccccagtgagcactccccactcccagctgcaccacgggcggcccggaaaaacacacaaacctcccgcagaagtcccgggacaagaggaaagatgtccttccgagaaatgttcacaccgaaaaacaagcacaggacaccccctgccacctggcatccagccccacgccaagctccccagaaggaggaatgaagagttcacaggcctcttcccgcgccctctgcccgcttgcacagaaacattccatagtaggaggacaaaccaatgcaaaggatccccaaaagagaactcccatcaggtgaggctgtcacccccacaccacatactcctgtagccctgacccagtgtccacaaggcaagtccacaccagccacaatcatgctcaaagggaacacgggcacatgccactctaagcaacatgcagcagctgagtcctgccccaaacactttcaagactggaggttcagcctcatgggtttgggctgaaaccagaagctcacaggcggtgtctgagttcatgttccaagtaccaagctcccctactcatctcctaggaacaagaagaggcccacaggctggcaagggatgatgtcaggttaaagaggccagccgggacccagaagcacttgcccagattgaagagggcagcagcctcccactgcagggctctggaggctgactcggacccgctgcttttctgccttggtctggagcctcccgtgcaaagggcaggcccaggttgacaggttagaggtggaggcagagtttggcctggccctgggcccctggaaggctgtgcactcggccgggtgtgtgcctgcagtgtatttgcagcatttgcacgctcatgcaaggggtgcgcacactggtgggcttctgtgcgtggttccagctctgtgcctcatgcccaaggagtgtgcacatcccactcacgcccgtggccaatccccatggtgtgtgccctcacagcacccacaggggagtcaggcagcaggttgtggtgcatgctactagatctggggagtccctgcctccccccaataccccaaactcacagaggcccatgtgctgccacaaggcactaggctgacttgccagctccagtgaggaagtgggaccctaacccgcatggcacgaaataagggggagccgcctctgcaggggtgccacctgggctgcaggaggggatgcaccccagggatgagtggagaacaaatttcaccctgagaaaccctttccatagtctcccccagaagggcactagacagagtcgctcgatttctgggaaaccacggaagccctgctcaagtctacgtgaagggggtgggggcctagacttcctgagtgtgggtgccgagatgtgggggcttttgcaaaggatcactccacgacatggaaagggttatctaacaagtgagtgagggtcgtaggccacttactccccagcacacactaatattcatacagaggacagcatggatcccagagccggagcctgcagagggcccacgtcctcagctggcctcaaggtccaaaggctgtgttgggggtggggggctggctaagccagggcttggggggttggactggctttcctggccttcctcccaggggtcttcctaaagggcaggtacaaaagggaggcagcgaccctggaaccctggggaggggaagcagaactaaggggtcagatacccaagcaagggggcaaaggggttctggggttgagaacccccagccccagtctcaagccctcagcagggaacaaaggcaaggagggggaggggcagaaaaagaagagagaggggttggactgggggcctcagaacaggctcccttcttgcctggcacagcccatgcccctcaaggaccaagagggagacccaggcccctgccccaggctgtctgcagcgggcacagaggaaacaggactctgggggggcacagctgccatgttagatggctcccctccccggccccacccccacaacactgcaccctctgctcaatgcccccttttatttttccacgtctgatgctactttgtctccctttccctccatctcttcctcctcttttctctctcggatcactcttgggtttctttttcctgcatcttcccctccccccaccccattctctctcccgcagcacattcctttcttcctccatcctcccattttctttctcagcctctttcgccttctcctgtatctttccctatcctctttcactctcctttcttttttctttggcctcctgttgtcccctgtccccagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgggcagccgcctggctcgcctttcaggtcgccgttctggtcgccgccggggcggcctcactgggggcggggagggggaggggccagcaggggcggggggtcgcgggctgggccgggagggcggcccgctgagccccgaggacgctgcgccggccccgagcgcggccgctgccgggagacgctgcccagacctgagcgcgcgggcagcggcgcagccgagggcgggcggccccgggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgtgtgtgcgcgcgcgtggtgtgtgcacgagtgtgcgtttgaatggctgtgtgtgtgtggagggcggcgtggagaccccggggctcccaagaaactgcaagaggctgggccacatttttttatttaagactttgtgtgtaatttaaaaatgggaacactgccaaaacaggactgcgaaatgtggcatatcttaatatttgcacttaaggaaagatgctttcaatgccaactgtagttcggtagaactcttcagttcccgggctcggtaccagtatgtaaggaagtgcaaccacagggctccgctggcagcccgctcgatgttaccaagcaggtcttcaccgcgccagcacccccaccgcccgctccaggggaagccagggccttagaagggggtgggagcttttggcccagcctctgccctgggcgaaggtcttgggggcaggccccttccctcgttgtgcctccgtttcttcgctctaaaggggtggggaggtcctcccatatctgcagcgggaagttcgggaacataacgcaccctggagctgtctccgttccggcgtcgacttcagacttacctacattaggtcactgcgcggacgcgcgggttaagccggcttcacccgatgcgagttatttcgcagagatacatccatcctcccagggccagccccgggcccctctccacccgagtaccgcccgcgttcccggaggtgaccgcaggcctggggcttccgctttgtttaattcttccaaaaaagcacggtggagggagcatcgcccccatttttcagcggagaaaactgacgggagaagagagaagagactcccccagagggtaggtggctccggcaagcctggaattccttcactgatgccccggagtccggctggttggcagggcggtggggctccaggagcggctgaggcctagccagctgggccctcgcggcctgggttcgcagagacaaaatggtgcgcctcttgggagcgtgtcctgggtgcgctttctggcggctgccaggaaggacctctagtgctcagtggctgccgcgatctcgagtgggaggacttttccagggactctaggacaagatgctcagcccatctccttttccccggcatcctagcccaagaggggcaaaaataatcaatgacagggactccccgggttgtttagcctggaggcagcccacagatgggggctcctccctccatgttgttgatgaggccactaagccaaagtggagagagttgggatcttagggaggagctgaggtctcccaagccctgctccctgggatgtccagggtcagagagactccaaggagcagaggtaccccagccagagggggctgggccaaggaaattgggacagagcgcccgattcgattagtttggagcgctagccttggggcagacaccgtctacactagggcgcttttgacagataaggaaactgaggccagagaggggccag

SEQ ID NO: 384 - DNA, 3639 bp, Homo sapiens
gtgagggtcgtaggccacttactccccagcacacactaatattcatacagaggacagcatggatcccagagccggagcctgcagagggcccacgtcctcagctggcctcaaggtccaaaggctgtgttgggggtggggggctggctaagccagggcttggggggttggactggctttcctggccttcctcccaggggtcttcctaaagggcaggtacaaaagggaggcagcgaccctggaaccctggggaggggaagcagaactaaggggtcagatacccaagcaagggggcaaaggggttctggggttgagaacccccagccccagtctcaagccctcagcagggaacaaaggcaaggagggggaggggcagaaaaagaagagagaggggttggactgggggcctcagaacaggctcccttcttgcctggcacagcccatgcccctcaaggaccaagagggagacccaggcccctgccccaggctgtctgcagcgggcacagaggaaacaggactctgggggggcacagctgccatgttagatggctcccctccccggccccacccccacaacactgcaccctctgctcaatgcccccttttatttttccacgtctgatgctactttgtctccctttccctccatctcttcctcctcttttctctctcggatcactcttgggtttctttttcctgcatcttcccctccccccaccccattctctctcccgcagcacattcctttcttcctccatcctcccattttctttctcagcctctttcgccttctcctgtatctttccctatcctctttcactctcctttcttttttctttggcctcctgttgtcccctgtccccagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgggcagccgcctggctcgcctttcaggtcgccgttctggtcgccgccggggcggcctcactgggggcggggagggggaggggccagcaggggcggggggtcgcgggctgggccgggagggcggcccgctgagccccgaggacgctgcgccggccccgagcgcggccgctgccgggagacgctgcccagacctgagcgcgcgggcagcggcgcagccgagggcgggcggccccgggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgtgtgtgcgcgcgcgtggtgtgtgcacgagtgtgcgtttgaatggctgtgtgtgtgtggagggcggcgtggagaccccggggctcccaagaaactgcaagaggctgggccacatttttttatttaagactttgtgtgtaatttaaaaatgggaacactgccaaaacaggactgcgaaatgtggcatatcttaatatttgcacttaaggaaagatgctttcaatgccaactgtagttcggtagaactcttcagttcccgggctcggtaccagtatgtaaggaagtgcaaccacagggctccgctggcagcccgctcgatgttaccaagcaggtcttcaccgcgccagcacccccaccgcccgctccaggggaagccagggccttagaagggggtgggagcttttggcccagcctctgccctgggcgaaggtcttgggggcaggccccttccctcgttgtgcctccgtttcttcgctctaaaggggtggggaggtcctcccatatctgcagcgggaagttcgggaacataacgcaccctggagctgtctccgttccggcgtcgacttcagacttacctacattaggtcactgcgcggacgcgcgggttaagccggcttcacccgatgcgagttatttcgcagagatacatccatcctcccagggccagccccgggcccctctccacccgagtaccgcccgcgttcccggaggtgaccgcaggcctggggcttccgctttgtttaattcttccaaaaaagcacggtggagggagcatcgcccccatttttcagcggagaaaactgacgggagaagagagaagagactcccccagagggtaggtggctccggcaagcctggaattccttcactgatgccccggagtccggctggttggcagggcggtggggctccaggagcggctgaggcctagccagctgggccctcgcggcctgggttcgcagagacaaaatggtgcgcctcttgggagcgtgtcctgggtgcgctttctggcggctgccaggaaggacctctagtgctcagtggctgccgcgatctcgagtgggaggacttttccagggactctaggacaagatgctcagcccatctccttttccccggcatcctagcccaagaggggcaaaaataatcaatgacagggactccccgggttgtttagcctggaggcagcccacagatgggggctcctccctccatgttgttgatgaggccactaagccaaagtggagagagttgggatcttagggaggagctgaggtctcccaagccctgctccctgggatgtccagggtcagagagactccaaggagcagaggtaccccagccagagggggctgggccaaggaaattgggacagagcgcccgattcgattagtttggagcgctagccttggggcagacaccgtctacactagggcgcttttgacagataaggaaactgaggccagagaggggccag

SEQ ID NO: 385 - DNA, 7368 bp, Homo sapiens
agtgaacttttcaaacccgaacaacatatttctcctaggctgaaacacacaccaaatactgtccctcccccacccaaaagcagccagcttggggctgatggaggtggggtggccccagtggcccagaataggggaacgagctctccttcagatcccatcatcaccggccgtgaacagctttgtccaccacctgagtcctccagctgaccagagaccagagactgcaggccgggaggaagacccaaggcaagagcacggtggcctgaccttgagtgccacggctttgttttggcccaaagaaaaattccataccagataggaaatggctgtgcacacggggcgccacacagccgagcccctgtgacgaatgccagcggccatcagtgggcctctgccttcacctgctcctgcctttcggtttcagtcaaggctctagaacttgggacacaccatcatcacttcctcctccctactcccggctcctggcccttccctgtggtgtgtcatagaagaggggcacagcgctcatcacctccgactagggtctgccctgcccacctgcacctggcccagccctgggctccaggtgtccccagtcagcactgaaaggtgctcccaggagggacggcacccagcgcagcttgagctgtctctgccctcgtgatcacaaagcagtgaaactgtccagaaaatgtccctttttattccatacgcaaataagtagattcatttaaaaaaacaacaacccggaggctgcgacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgaggtcgctcacagccacaagcaggaagaccttccagcacagggctgggcacccagcagctctggggatgcacacattgtcagaaccgtgggaggcggcccagagaccaggcagcagctccaaaccaacaccccgcaacacaccaacaccccgcaacacacaaacacaaacgcacacccatgccagaggacaacaaagggatgcagagcaaagaaaagaaacaaaaatactacacaagaaaagcaggctgaccccagtgagcactccccactcccagctgcaccacgggcggcccggaaaaacacacaaacctcccgcagaagtcccgggacaagaggaaagatgtccttccgagaaatgttcacaccgaaaaacaagcacaggacaccccctgccacctggcatccagccccacgccaagctccccagaaggaggaatgaagagttcacaggcctcttcccgcgccctctgcccgcttgcacagaaacattccatagtaggaggacaaaccaatgcaaaggatccccaaaagagaactcccatcaggtgaggctgtcacccccacaccacatactcctgtagccctgacccagtgtccacaaggcaagtccacaccagccacaatcatgctcaaagggaacacgggcacatgccactctaagcaacatgcagcagctgagtcctgccccaaacactttcaagactggaggttcagcctcatgggtttgggctgaaaccagaagctcacaggcggtgtctgagttcatgttccaagtaccaagctcccctactcatctcctaggaacaagaagaggcccacaggctggcaagggatgatgtcaggttaaagaggccagccgggacccagaagcacttgcccagattgaagagggcagcagcctcccactgcagggctctggaggctgactcggacccgctgcttttctgccttggtctggagcctcccgtgcaaagggcaggcccaggttgacaggttagaggtggaggcagagtttggcctggccctgggcccctggaaggctgtgcactcggccgggtgtgtgcctgcagtgtatttgcagcatttgcacgctcatgcaaggggtgcgcacactggtgggcttctgtgcgtggttccagctctgtgcctcatgcccaaggagtgtgcacatcccactcacgcccgtggccaatccccatggtgtgtgccctcacagcacccacaggggagtcaggcagcaggttgtggtgcatgctactagatctggggagtccctgcctccccccaataccccaaactcacagaggcccatgtgctgccacaaggcactaggctgacttgccagctccagtgaggaagtgggaccctaacccgcatggcacgaaataagggggagccgcctctgcaggggtgccacctgggctgcaggaggggatgcaccccagggatgagtggagaacaaatttcaccctgagaaaccctttccatagtctcccccagaagggcactagacagagtcgctcgatttctgggaaaccacggaagccctgctcaagtctacgtgaagggggtgggggcctagacttcctgagtgtgggtgccgagatgtgggggcttttgcaaaggatcactccacgacatggaaagggttatctaacaagtgagtgagggtcgtaggccacttactccccagcacacactaatattcatacagaggacagcatggatcccagagccggagcctgcagagggcccacgtcctcagctggcctcaaggtccaaaggctgtgttgggggtggggggctggctaagccagggcttggggggttggactggctttcctggccttcctcccaggggtcttcctaaagggcaggtacaaaagggaggcagcgaccctggaaccctggggaggggaagcagaactaaggggtcagatacccaagcaagggggcaaaggggttctggggttgagaacccccagccccagtctcaagccctcagcagggaacaaaggcaaggagggggaggggcagaaaaagaagagagaggggttggactgggggcctcagaacaggctcccttcttgcctggcacagcccatgcccctcaaggaccaagagggagacccaggcccctgccccaggctgtctgcagcgggcacagaggaaacaggactctgggggggcacagctgccatgttagatggctcccctccccggccccacccccacaacactgcaccctctgctcaatgcccccttttatttttccacgtctgatgctactttgtctccctttccctccatctcttcctcctcttttctctctcggatcactcttgggtttctttttcctgcatcttcccctccccccaccccattctctctcccgcagcacattcctttcttcctccatcctcccattttctttctcagcctctttcgccttctcctgtatctttccctatcctctttcactctcctttcttttttctttggcctcctgttgtcccctgtccccagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgggcagccgcctggctcgcctttcaggtcgccgttctggtcgccgccggggcggcctcactgggggcggggagggggaggggccagcaggggcggggggtcgcgggctgggccgggagggcggcccgctgagccccgaggacgctgcgccggccccgagcgcggccgctgccgggagacgctgcccagacctgagcgcgcgggcagcggcgcagccgagggcgggcggccccgggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgtgtgtgcgcgcgcgtggtgtgtgcacgagtgtgcgtttgaatggctgtgtgtgtgtggagggcggcgtggagaccccggggctcccaagaaactgcaagaggctgggccacatttttttatttaagactttgtgtgtaatttaaaaatgggaacactgccaaaacaggactgcgaaatgtggcatatcttaatatttgcacttaaggaaagatgctttcaatgccaactgtagttcggtagaactcttcagttcccgggctcggtaccagtatgtaaggaagtgcaaccacagggctccgctggcagcccgctcgatgttaccaagcaggtcttcaccgcgccagcacccccaccgcccgctccaggggaagccagggccttagaagggggtgggagcttttggcccagcctctgccctgggcgaaggtcttgggggcaggccccttccctcgttgtgcctccgtttcttcgctctaaaggggtggggaggtcctcccatatctgcagcgggaagttcgggaacataacgcaccctggagctgtctccgttccggcgtcgacttcagacttacctacattaggtcactgcgcggacgcgcgggttaagccggcttcacccgatgcgagttatttcgcagagatacatccatcctcccagggccagccccgggcccctctccacccgagtaccgcccgcgttcccggaggtgaccgcaggcctggggcttccgctttgtttaattcttccaaaaaagcacggtggagggagcatcgcccccatttttcagcggagaaaactgacgggagaagagagaagagactcccccagagggtaggtggctccggcaagcctggaattccttcactgatgccccggagtccggctggttggcagggcggtggggctccaggagcggctgaggcctagccagctgggccctcgcggcctgggttcgcagagacaaaatggtgcgcctcttgggagcgtgtcctgggtgcgctttctggcggctgccaggaaggacctctagtgctcagtggctgccgcgatctcgagtgggaggacttttccagggactctaggacaagatgctcagcccatctccttttccccggcatcctagcccaagaggggcaaaaataatcaatgacagggactccccgggttgtttagcctggaggcagcccacagatgggggctcctccctccatgttgttgatgaggccactaagccaaagtggagagagttgggatcttagggaggagctgaggtctcccaagccctgctccctgggatgtccagggtcagagagactccaaggagcagaggtaccccagccagagggggctgggccaaggaaattgggacagagcgcccgattcgattagtttggagcgctagccttggggcagacaccgtctacactagggcgcttttgacagataaggaaactgaggccagagaggggccag

SEQ ID NO: 386 - DNA, 5133 bp, Homo sapiens
gtgagggtcgtaggccacttactccccagcacacactaatattcatacagaggacagcatggatcccagagccggagcctgcagagggcccacgtcctcagctggcctcaaggtccaaaggctgtgttgggggtggggggctggctaagccagggcttggggggttggactggctttcctggccttcctcccaggggtcttcctaaagggcaggtacaaaagggaggcagcgaccctggaaccctggggaggggaagcagaactaaggggtcagatacccaagcaagggggcaaaggggttctggggttgagaacccccagccccagtctcaagccctcagcagggaacaaaggcaaggagggggaggggcagaaaaagaagagagaggggttggactgggggcctcagaacaggctcccttcttgcctggcacagcccatgcccctcaaggaccaagagggagacccaggcccctgccccaggctgtctgcagcgggcacagaggaaacaggactctgggggggcacagctgccatgttagatggctcccctccccggccccacccccacaacactgcaccctctgctcaatgcccccttttatttttccacgtctgatgctactttgtctccctttccctccatctcttcctcctcttttctctctcggatcactcttgggtttctttttcctgcatcttcccctccccccaccccattctctctcccgcagcacattcctttcttcctccatcctcccattttctttctcagcctctttcgccttctcctgtatctttccctatcctctttcactctcctttcttttttctttggcctcctgttgtcccctgtccccagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgggcagccgcctggctcgcctttcaggtcgccgttctggtcgccgccggggcggcctcactgggggcggggagggggaggggccagcaggggcggggggtcgcgggctgggccgggagggcggcccgctgagccccgaggacgctgcgccggccccgagcgcggccgctgccgggagacgctgcccagacctgagcgcgcgggcagcggcgcagccgagggcgggcggccccgggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgtgtgtgcgcgcgcgtggtgtgtgcacgagtgtgcgtttgaatggctgtgtgtgtgtggagggcggcgtggagaccccggggctcccaagaaactgcaagaggctgggccacatttttttatttaagactttgtgtgtaatttaaaaatgggaacactgccaaaacaggactgcgaaatgtggcatatcttaatatttgcacttaaggaaagatgctttcaatgccaactgtagttcggtagaactcttcagttcccgggctcggtaccagtatgtaaggaagtgcaaccacagggctccgctggcagcccgctcgatgttaccaagcaggtcttcaccgcgccagcacccccaccgcccgctccaggggaagccagggccttagaagggggtgggagcttttggcccagcctctgccctgggcgaaggtcttgggggcaggccccttccctcgttgtgcctccgtttcttcgctctaaaggggtggggaggtcctcccatatctgcagcgggaagttcgggaacataacgcaccctggagctgtctccgttccggcgtcgacttcagacttacctacattaggtcactgcgcggacgcgcgggttaagccggcttcacccgatgcgagttatttcgcagagatacatccatcctcccagggccagccccgggcccctctccacccgagtaccgcccgcgttcccggaggtgaccgcaggcctggggcttccgctttgtttaattcttccaaaaaagcacggtggagggagcatcgcccccatttttcagcggagaaaactgacgggagaagagagaagagactcccccagagggtaggtggctccggcaagcctggaattccttcactgatgccccggagtccggctggttggcagggcggtggggctccaggagcggctgaggcctagccagctgggccctcgcggcctgggttcgcagagacaaaatggtgcgcctcttgggagcgtgtcctgggtgcgctttctggcggctgccaggaaggacctctagtgctcagtggctgccgcgatctcgagtgggaggacttttccagggactctaggacaagatgctcagcccatctccttttccccggcatcctagcccaagaggggcaaaaataatcaatgacagggactccccgggttgtttagcctggaggcagcccacagatgggggctcctccctccatgttgttgatgaggccactaagccaaagtggagagagttgggatcttagggaggagctgaggtctcccaagccctgctccctgggatgtccagggtcagagagactccaaggagcagaggtaccccagccagagggggctgggccaaggaaattgggacagagcgcccgattcgattagtttggagcgctagccttggggcagacaccgtctacactagggcgcttttgacagataaggaaactgaggccagagaggggccagataaaaagacaatgtctgtggggagaagtgtttttctgatagccgtccagttcacacaggctcccctgggtctgtctgtgagaggcgcctggacactcctgccccgtccagccacgcgcctgcccaggttggtggcatttccatttctccctcaggcctggcgggcttcctctgagtctgagttctaattccctccgctctagggttgtgtggccctggaggaggcgtcttgtgtctctgatcctataactgcggacgatacgcgtccctgacggtgccaggttgttgggagtagaggctggccaccaccaggcgggtggtggccctgagcgcataacgctcgcgggtgtcttcccactgcctctggggggcgcgcatgagaggggcgcttccacacactgccgcgtggggcctgggatgggagcgaagaggggcggtggatccgaagcgaggaccgtgcacccttttcctctgggcgcccgctgtctgggggttgcggagagagcgggcgccagctgggcagaggctggcgcgtccacactctgagtctcccacgccgggtcccagagactttccagcgacaactgcagcggcgaagcctggtcggcgaggcgtaggtgtgggcaattgggcagattgttgacgctaaagcgcagggtcagaccaggacgcgcgaactgaccggactggtgctcgcccaggccactgcctctgtgctcggtgctggtggcggagccggccaggatcgaagtcctgcgtccaggtgagtggcgacgcccagtttggagacagaattgccggcggaggcgcaagcgggaatcgctaccttcgcggcgtggcgcatttcgatgcgccccaggtcagagaggctcgcagttcacggcccaagaacagtctcgggcagggcagggggaggtcgggatgcgtgctcctcgcgctcggaggctgaccccgcaaagccgtcaccttcagtcggggtttcttgccctcccaggagcacggttcaagatttctgatcactgttggacacgtccgaattctgggactgaaggactcccccatccaaaaaaagcaaaacgtctcaaagtgaatgagttgtcaccttcctgtctccccatccctgtgagggcacacacacacacacacacacatccccaacccacagccatccttccatgcaggcagggcgccaccaagcccaccacctccctgtccactttagtccctaggcctccctcccctcctgcgcctgccgtgcatcctctcccttgtatcctgacccaccttggaacttccagcaaacgccctccagggaacccagtgcccttctcaactggacagggaggtgcctgacagggcctaagccctcctcaccggtgtccccagtgcctcgctggatgctagcagccagatgagtgagtgggaagaatccacagagcatagatctggggaggcaaaccacagccgctggcgtatgtttggtttccttttaat

SEQ ID NO: 387 - DNA, 1879 bp, Homo sapiens
tttcaaatttaaaggatgcatgacacagttgaagtttatcacaaatggactcacgagtgtgtctcctcagctcccaactcccggactcctgacctccaaggccaatacttcgaattctgttaggcatttcttctagcatttatctcaatagttccaaataacaagctcgtgatgcgatttcacaacccttgcttcaaatgtcatgtattgactttccatatgagggatggtccttgtttctgttatatctccctgcttcctcttttcagttctctgaatatatgttttaaaaatttaggctggacgcggtggctcacgcctgtaatcctagccctttgggaggccggggcaggcagatcacctgagatcaggagtttgagagcagcctggccaacatggtggaaccccttccctacaaaaatacaaaaattagccgggcatggtggcatacgcctgtagtcacagctactcttcaggctgaggcaggagaattgcttgaaccgggaggtggaggtttcagtgagccaatattgcgccattgcactctagcctgggtgatagagccagactctgtctcaacaaaacccaagggcggaggttgcagtgagccaaaatcatgccactgcactccagcctgggcgacagtgtgagaccctgtcttaaaacagagcaaacaaacaaacaaaaaaaaaaaaaagagagaaagaaaatgggagaagggggctgttccatgaaagggccttatatccaaaatgacccccaaatgccaaaggagctggaaaccagaaaaggagggaaacaaattcagtttggtctagagtgttttactgggggagaacttacaggcagaagcgtagtcttgggattttagctgcaaggcagaagatagatctccacactgctactccccagacccggggcttctgtaccatagggaaagggcgtgtgtgtccagcaagacaataaaaggcagcctccagaacaggcaagaatgttacatgcatcatggcctatgatttgtgtgatgacattcagattgtcatcttcttacactaaggatagtaaataaagtaagaatcagaaggcatttgcaggactggggctaattagaatacaacatggcacattcatatccaagatggagtcacttcctgtctccacaggggcattgaaggaaaggtgacacttacaattctgattggtgcttagtgacattatgcataaataaagaaatatgcagttaacatatatagggtaaaaagttgtggaatacgtaggggtcttaaggtctggagaggggtgattgattctaccctgcatttgtgcttcatctgataggcaaggttacaatcagtcatgccagtgaaatatttgacagactccaccctagcaggcgagacttcagctttagttcataggccttatattagtacctgtttgtccagcctgcagccatcttgggctgtgttttaaaactttttctttcagattttcttttttctaaaaatctttcccttttggttaaattctccaaaagaggactttgaaaaccaaataatatatctgatggatttgaagaggacaggtcccctttgcttggaattatagggcataggggaatcaaattggaatttttaagtgcccttgttctatttttcactcctatatgaagttctgtcatttggtttgtcagtgaggatgcaaaaattcctgtatttcctttcagaatgcgagaggctctcctgtcatgccaatatctcctcacgttatggagaaaagaggtgatcattgcaattagaattattttcttaggctgttcctcagatgcgatgatgtgttgcatggtcaaccatattgctgaagagccttgaggagttgg

SEQ ID NO: 388 - DNA, 9562 bp, Homo sapiens
gttatgtgggttactctgatactctccccactcccataccattgcatgttacaggggaggtgaaaccaggggtggttcagaggctccaacatttcagacatggagctgtcatttttagaactggtggctcacacctgtgatcccagcactttgcggggctgaggtgggaggattgcttgagcccaggagctcgagaccagcctgggcaatgcagagggatctcatctctacaaaataaaaaaataaattagcgagacatggtggtgcatgcctatagtcccagctacccaggaggtgggaggatggtgccactgtactctatcctgggcatcagagcaagaccccatcgccccccccccccaaaaaaggaaaaaagaaacccatttgcctattttgacactgtcatgaatttgtactgcttaggtggtctcagcactctaaatggtggaattttatttaaagtagtttcatgtcggtagtgccccaagataactactacaagcaaaaacatgttttattaagaggaagatagaggctgggtgcagtggctcatgcctgtaatcccaacactttgggaggctaaggcgggcggatcactcaagatcaggcattcgagaacagcctggccaacatgacgaaatcccgtctctactaaaaatacaaaattagcggggtgtggtggctcatgcctgtgatcgcagctatttgggaggctgagggaggagaatcacttgaaccggggaggcagaggttgcagtgagccgagattgtactgccgcactccagcctgggcgacagagcaagactccgtctcaaaaaaaaaaaaaaaaaaaagaagaagaacacagctttaatccaggcctcaaggaattgtgagacaaaatttcagggaaaataagcagttccctgtcaacaaccccaaaaatcataagaaaataaggcaccatgggtgaaaaccaagagatgatgtaaacagcagaatcagacccacaaagtattcagaatacaaacttatcaaaagtaaaataacatggtttttttcttttttgttttttgttttgagatagagtctcactctgttgcccaggctggagtgcagtggcgcgatctcggctcactgcaacctctgcctcccgggttcaagtgattctcctgcctcggcctcctgagtagctgggactacagatacatgccaccacacccggctaattttttgtatttttagcagagatggggtttcactgtgttagccagggtggtctcaatctcctgacctcgtgatacgcctgcctcagcctcctaaagggctgggattacaggcgcgagcccccgtgcccggcctgttttttgatttttttgagacagtgtcttgctctgtcatccaggctggagtgcaatgatgtgttcatgtctcattgcagccttgacctcctgggctcaagctattctcccaccacagcctcccaagtagctaggactacagctgtgcaccaccatgcctagctaatttttttgtgtgtggagatagggtgtcactatgttgccaggctggtcttgaactcatggactcaatccatcctcctacctaggcttccccaaatgctggaattaaggcatgaactaccacacccagcctgtttaatgtttatttttttatttttatttttatgtttgagacggagtcttgctctgtcgcccaggctggagtgcagtggcacgatctcagctcactgcaagctctgcctcccgggttcacgccattctcctgcctcaacctcctgagtagctgggactacaggcgcctgccaacatgcctggctatttttttgtatttttagtagagacgaggtttcaccatgttgaccaggatggtctcgatctcttgacctcgtgatccacctgccttggcctcccaaagtgctgggattacaggcgtgagccactgcgcctggcctgtttaatgtttaaagaaataaaaaaaacaagccaggtgtggtggtggctcacacctgtaatcccagcactttgggaggcctaggtgggtttggagcaagccccccacagtctggccataaactggccccaaaactggccataagcaaaatctctgcagcactgtaacatgcccataatggccctaatgcccacgctggaaggttgtgggtttacgggaatgacggcaaggaacacctggcccgcccagggtggaaaaccccttaaaggcattcttaagccacaaacaaaagcatgagtgatctgtgtcttaagggcgtgttcctgctgcaattaattcggcacatcccttcgtttcccataagggatacttttagttaattcaacatctatagaaacaatgctaatgactggtttgctgttaataaatacgtggataaatctctgttccgggctctcagctctgaaggctgtgagacccctgatttcccacttcacacctctatatttctctgtgtgtcttttaattcctctagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggtgagtaagaaggggagtccggaagcgtcagggtaacaatgggatgggtatggggtctggttcgtttcaccttagaactttttcacactgataacgaggaggaacaacagtatagcgaagtaacagaagaggttacagagcatgtttatttgccagctgaagctaaagcggcaaaggaaggagagtttcatccctacccttctgcatcccctcattattattttgaagaaaatgactccccagatctttcttttccggaggacactgggcgaaaagtagttgccccagtgactgttcgagcagcgccttgagcgacgtctcttagttctattcaggcaggaattcagcaagctagacaagagggtgatttagaggcttggcagttccctgttagaatacaccccccagatcaacagggaagtattacagctacatttgagccttttccttttaaattactcagagaattaaaacaagcaataaatgagtatggaccaggttctcctttagtaattggactgttaaagaatgttactgtttccagtcagatgattcctactgactgggacgctcttacttgagcttgtgtaactcctgctcagttcttacaatttaaaacttggtgggcagatgaagcttccattcaggttgctcgcaatgcccaggtccaacctcaaattaataggactgcagaccaactttcgggggttggcggctgggctggtttcgatgcacaagtggtcatgcaggatgatgccatggaacagcttagagcagtgtgcattagagcttgggaaaaaatcacttcaggtggggaacaatacccttcctttagtgctatagagcagggaccaagggaaccataggttgattttatagctcggttacaggagtctcttaaaaagatgattgcagattcggctgctcaggatacagtgttgcagttattagctttcgacaatgctaatcccgatggccaggctgctctgcgacctatcagagggaaagcacatttagtttattatatcaaagcctatgatggtatcggaggtaatctgcgtaaagctaccttgttggcaatggcaatggcaggactgagagtggataaaggaaatactccatttcctggagcttgttttaactgtgggaagcgtggtcatactaaaaaagaatgtagaaaaaatcagcgagtcaggccaccagataggggaaaaaagaaaactgctgatcctgaaatatgtccaaaatgtaaaaaaggaaaacactgggctagtcagtgtcactctaagttggataaagaagggaacccaatttcaggaaacgccatgaggggcccgtcccgggccccgctctaaaccggggcgtttctggctcaggccattccctcacccctgtacaatgtctgtcccctgccacagccggtagtgctgcagtagatttatgctgcacaaaagctgtgagccttctgcctgcggaaccccggcaaagggtcccaacaggagtctgtggacccttgccagtgggtacaataggattacttttaggaaggtctagtgtaagtttaaaaggtatacaaatacatacaggagtcattgattcagattacagtggggaaatccaaattgttacatctacttctgttctctggaaagcagagccaggagagcgcatagcacagctcctggttgtgccgtatgtgggaatgggaaaaagtgaaattaaacgaacaggagaatttggaagcacaaataaacaaggcaaagcagcttattgggtaaatcaaattactgataaacgtcctacctgtgaaataactattcaagaaaagaaatttaaaggtttggtagatacaagaacggacatttcactcatttctgtacagcactggctgtctgcgtggccaattcaacccgctcaatttaacatagttggagttggtaaagctgctgaagtatatcaaagtagttatatattgcattgtgaggggcccgatggacaacctgggactattcaaccaattataacttctgtacctataaatttatggggaagagatgtattacaacaatggggagcacaagttctaattccagaacaatcatacagccctcaaagtcagcatacaatgcatgaaatggggtatgtccctggtatgggactagaaaaagatttgcaaggtttgaaagaaccacttcaagcggaaaaacaaagttcccagaaaaacaaagttcctgctaaagattaggaaaaaatttttggtggcagccattgttaagcctccagaacctatacctttaaaatggttaacagataagccaatttggatagcacattggccactaagtaaagaaaaactggaggttttagagaaattagttgctgaacaattagaaaatgggcacataactccaacattttctccttggaattctccagttttcataattaagaaaaaatcaggtaaatggagaatgttaactgacttaagagccatcagttcagttatacaacctatgggagcattacagccaggattgccttctcctgctataattccaaaaaattggccttttaatagtcatagatttaaaagactgtttctttactatacctttagctgagcaagactgcgaacagtttgcatttacaattcctgcattaaacaacctgcagcctgctaagtgttatcattgaaaagtgttgccacagtgcatgccaaacagcccaacaatttgccagacatatgtggggcaagcaattgaacctacccgtaaaaaatttccacagtgttacattattcactgtcaactaaaaacattaaatgattttcaaaaattactaggggatattaattggatacgacctgctctaggcattcctacctatgccaggagtaatctgttttctatccttggaggaaatcctagtctcactagccctcggcaattagcaaaagaggctgaggcagagttacaactgattgagaagcaaatccataaagctcagataaatagaatagatccagagaagactctagatttgctaatcttttcaactcagcattcacctactggtgttattgtccaagaacaggacttagtagggtggctttttcttccacatactaattcacagactccaactccttatttagatcaaatcgctactatgatagggattgggagaactcggattgttaaattacatggatatgatcctggaaaaattactgtccctctcacaaaggcacaaatacagcaagcttttataaatagtcttacttggcaaacccatttagctgactttgtgggtattctcgataatcattttcctaaaatgaagctatttcagtttttaaaattcactaattggattctccctaaaataactaaatttaaaccaattgaaggtgctgagaatgtttttacagatgggtctagtaatggtaaagcttcttattctggctcaaaaagtaaagtttttcagacgtcctgtactcagctcaaaaagcggagcttgtagcggtaattgaggtattgactgcttttgatatgcctattaatgggatttctgattcttcatatgtggttcattccacacagttaattgaaaatgctcagttatgatttcataccgatgaacaactgatgataaaaacaaaaaaggtggaaaaatagggattacagaacagcccatacacaattgaatctagcattatttggtgaagagatccaataacaaaaagttgggaaataggtaaaataataatttggggtagaggttatgcttgcgtttctccaggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgt

SEQ ID NO: 389 - DNA, 13840 bp, Homo sapiens
tttcatctgagattatggttaacagattatctacctgggatagaaatggatagtcctggcatgctggcatgggttactgcaggccggttctggggcagcgagtccatggggaaggggctgagtcaccacttcatgcagagggagttctgggggccctggtatgggaagcaagttagaggctgcccctattctgaggaccccagaatttaaacgagtccaggaatcacctgtaatgtgcacagagacttcagcgtctacacattggggctcacagagagatctggaatgtgaggctgtgataggccacccgaggcagagccgggcagttggtggctttgattgtgtgtgtgaaagggtgtctagaatgatgcccaggtgggcagatggtcgggactgaggggtggaggggcagggtgggagggattttggtcatggggcttgtcgtgggtcattcctgagtccattttcctgcctcggccttcccgaggagggaactggatatagaggctgtgggctcaggactgagatcagggccaaagacaagggcatgagcatcattttctggccaaagcaaagagagaaagggatggaggctgacttctggggaccactgacaggcggagagttggaggaagaggcattagtagaggaaaggggacagcagagggcggtgaggggtgtcaatgggaaggtcaagaagaaaggagtggtcagccaggctgggagatggagccctgtaaggacagcaaggcccccgatgctggccaggacagtttccctggatcagtggggagggcagaggtcagagcagagcctgtttagaggggccaggaaagaccagagaggctgaaggtacaggagggagaggcactgggacaaagtgaggatgggagcaggaggacctggtgctcagggggtgctattctgtaggatgtggggaacggtgggcattgtgagtggtgagtctgggggtgctggttgggaggtgatgtggtgaagggggacaatgagggagaggtttgaggacagggaggttctgttggctggtcggggcatgtgtggtatgcctacagggatccaacgagacccaagctgtgggctgctagatggacaggaccccattcaacaccccctccccaccactgtgtatatccggaaatgtgagactgtgatgggccacctgaggcagagccagccctggagcccaggctcaattctcagttcttggaacctctggagagagggagatctagtctgtctgggcttctggctcattctccaaatcaactcaacaaactcagcagctgccaggagccaggccctggtgaggtgtcagggctgctggctggaatggagcagggtcagtgctctggggtctgctcaggagacagtaagggggctgtagacaagcaggaacatttttgtgagtcccctttcttattggggctgctctctcaggccacccactccggactccaggatccaaatgctaactgggcctcacccagatcccttctgtaataaggcatggaagggtgtgttaactgggatattatgatagccgcaaaaagttaacagaatgacagaagctacatctcgagtaacaaccacatatgctttactctacagttaaagtctagaggaaatttctgtttaagagttggccataaaaaagaaaagaaaatgctgagccaggcgcggtggctcatgcctgtaatcccagcactttgggaggctgaggtgggcggatcacctgaggttgggagttcgagaccagcctgaccaacatggagaaaccccatctctactaaaaaatacaaaaattagctgggcatagtggcgcgtgtttgtaatcccagctactcgggaggctgaggtaggaggatggcttgaatctgggaggcggaggttgcggtgagccgagattgtgccattgcactccagcctgggcaacaagagtgaaactctgtctcaaaaaaaaaaaaaagaaagaaagaaaaaaagaaaagaaaaggccagcatggtggctcacacctgtaatcccagcactttgggaggctgaggcgggcggatcacttgaggtcaggagtttatgactagcttggccaacagagtgagaccctgtttctactaaaatacaaaaattagctgggcatagtggcacgagcctgtaatcccagctactcgggattacagtacaggctgatgcaggagaatcgcttgaacttgggaggtggaggttgcagtgagccgagattgcaccattgaccaccagcctgagcgacagagtgagaccctgtttcaaaaaaaagaaaagaaaaaagagaaaagacaagaaaagaaaagaaaagaagtctagaggaacaacaaaccactagaattatacaatgtgactccagggttgtccccaagccccatactgataagtctcacctagtctggcttgcattttttctgcttttattaataatattatttgtgatttcctacaaagtgtcccacattttaatttcatccacttgtcacacaacactgccaaatgactctcatgtccccatgttgcaggcaaagaaatcaaggcttggagaggtcgagacttgtcccaagtcacctctatgttaagttcaaatgcaggtcaggctgactgtgggcctatctgcctgattttatccatctacttgtcccttcttattcacacccatttacaatgggacagtcacttattttggcaagaatatttaacagcaatgctggacaaatctatttttgaaagaaaaatcaagaacttagttcttacggtccatgagggcaccccctgcacaaaccattctcattttggaactgctgcttatttagtgtttgtgacactcttatgaaggaggcattcttttatttatttatttatttttgaggcagagtcttgctctgttgcccaggctggagtgcagtggcacaatcttggctcactgtgacctctgccccctgggttcaagtgattttcctgcctcagtctccaagtagctgggattacaggtgcgcaccaccacgctcagctaatttttgtatttttagtaaagacggggtttcaccatgttggccaggctggtctcgaactcctgacctcaaatgatccactcacctcagcctcccaaagtgctgggattataggcgtgagccactgtacccagccgaggaaggcattcttatgcccctttttcacagaagggagccagagtcagtttgcagcagaaagggatgcccatgccctgtcattccaactccgcgggccgtgtgtcacctgtcctccctgggaaagaggccggcgagccgagctctgaggcacagagcttcgccactctcttggttccaaagagctctgcaggatgtctgggaggaaagagacttcatctggctctggtttttggcaggaggaacagccctggaaccgactccaagctgtgaagactcctccattgtctgtgacacttctcgtggggcataaattactaaacaagttactgagcatgcattctgtgccaggcactgtgctaggctctggggatccaccccgtggcatactgtgggagagaagaaagcaggggctgtcagggggctccagcatttcagatgtgaaacagccattttattaatagagctggtgcacatcaaaaacacagagcaggcttatagcctgtaaggatgtcagacatggaaagtggcagtgggcccaggttggggcatgcaggatggagaagacacaggttagaaaccccaaactcctgggtgggccaggaggctttcagaagaggcttggctgactcggagaaccatcagggacgggggctagggaagaccttccagacaaagggtgcagtgtgtgtgggagagggcacaggcatgagggagaagagcctgtttgggagcgtgagtggtgtggctggagcagcaggtgggaaatgtggggaggcggagggggagagaaatgagactggggagccccggaggcctgggtcaccctgataaagaatttggcttcaacctggatgggttggggagcccttacccatgggataagcagggagcgccacactcagcttgcatttgggaggtggctggaggctggagttgagaaatggttctggaggcctgactgcctctgcatccaggctgtcctgtttcagcactgctcacccctgcaccccggcagagccacaggacttcccacactgcattgcttagaacagcaaatggcccagggaagtgtgtgcctcaggctgtgttatgtgggttactctgatactctccccactcccataccattgcatgttacaggggaggtgaaaccaggggtggttcagaggctccaacatttcagacatggagctgtcatttttagaactggtggctcacacctgtgatcccagcactttgcggggctgaggtgggaggattgcttgagcccaggagctcgagaccagcctgggcaatgcagagggatctcatctctacaaaataaaaaaataaattagcgagacatggtggtgcatgcctatagtcccagctacccaggaggtgggaggatggtgccactgtactctatcctgggcatcagagcaagaccccatcgccccccccccccaaaaaaggaaaaaagaaacccatttgcctattttgacactgtcatgaatttgtactgcttaggtggtctcagcactctaaatggtggaattttatttaaagtagtttcatgtcggtagtgccccaagataactactacaagcaaaaacatgttttattaagaggaagatagaggctgggtgcagtggctcatgcctgtaatcccaacactttgggaggctaaggcgggcggatcactcaagatcaggcattcgagaacagcctggccaacatgacgaaatcccgtctctactaaaaatacaaaattagcggggtgtggtggctcatgcctgtgatcgcagctatttgggaggctgagggaggagaatcacttgaaccggggaggcagaggttgcagtgagccgagattgtactgccgcactccagcctgggcgacagagcaagactccgtctcaaaaaaaaaaaaaaaaaaaagaagaagaacacagctttaatccaggcctcaaggaattgtgagacaaaatttcagggaaaataagcagttccctgtcaacaaccccaaaaatcataagaaaataaggcaccatgggtgaaaaccaagagatgatgtaaacagcagaatcagacccacaaagtattcagaatacaaacttatcaaaagtaaaataacatggtttttttcttttttgttttttgttttgagatagagtctcactctgttgcccaggctggagtgcagtggcgcgatctcggctcactgcaacctctgcctcccgggttcaagtgattctcctgcctcggcctcctgagtagctgggactacagatacatgccaccacacccggctaattttttgtatttttagcagagatggggtttcactgtgttagccagggtggtctcaatctcctgacctcgtgatacgcctgcctcagcctcctaaagggctgggattacaggcgcgagcccccgtgcccggcctgttttttgatttttttgagacagtgtcttgctctgtcatccaggctggagtgcaatgatgtgttcatgtctcattgcagccttgacctcctgggctcaagctattctcccaccacagcctcccaagtagctaggactacagctgtgcaccaccatgcctagctaatttttttgtgtgtggagatagggtgtcactatgttgccaggctggtcttgaactcatggactcaatccatcctcctacctaggcttccccaaatgctggaattaaggcatgaactaccacacccagcctgtttaatgtttatttttttatttttatttttatgtttgagacggagtcttgctctgtcgcccaggctggagtgcagtggcacgatctcagctcactgcaagctctgcctcccgggttcacgccattctcctgcctcaacctcctgagtagctgggactacaggcgcctgccaacatgcctggctatttttttgtatttttagtagagacgaggtttcaccatgttgaccaggatggtctcgatctcttgacctcgtgatccacctgccttggcctcccaaagtgctgggattacaggcgtgagccactgcgcctggcctgtttaatgtttaaagaaataaaaaaaacaagccaggtgtggtggtggctcacacctgtaatcccagcactttgggaggcctaggtgggtttggagcaagccccccacagtctggccataaactggccccaaaactggccataagcaaaatctctgcagcactgtaacatgcccataatggccctaatgcccacgctggaaggttgtgggtttacgggaatgacggcaaggaacacctggcccgcccagggtggaaaaccccttaaaggcattcttaagccacaaacaaaagcatgagtgatctgtgtcttaagggcgtgttcctgctgcaattaattcggcacatcccttcgtttcccataagggatacttttagttaattcaacatctatagaaacaatgctaatgactggtttgctgttaataaatacgtggataaatctctgttccgggctctcagctctgaaggctgtgagacccctgatttcccacttcacacctctatatttctctgtgtgtcttttaattcctctagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggtgagtaagaaggggagtccggaagcgtcagggtaacaatgggatgggtatggggtctggttcgtttcaccttagaactttttcacactgataacgaggaggaacaacagtatagcgaagtaacagaagaggttacagagcatgtttatttgccagctgaagctaaagcggcaaaggaaggagagtttcatccctacccttctgcatcccctcattattattttgaagaaaatgactccccagatctttcttttccggaggacactgggcgaaaagtagttgccccagtgactgttcgagcagcgccttgagcgacgtctcttagttctattcaggcaggaattcagcaagctagacaagagggtgatttagaggcttggcagttccctgttagaatacaccccccagatcaacagggaagtattacagctacatttgagccttttccttttaaattactcagagaattaaaacaagcaataaatgagtatggaccaggttctcctttagtaattggactgttaaagaatgttactgtttccagtcagatgattcctactgactgggacgctcttacttgagcttgtgtaactcctgctcagttcttacaatttaaaacttggtgggcagatgaagcttccattcaggttgctcgcaatgcccaggtccaacctcaaattaataggactgcagaccaactttcgggggttggcggctgggctggtttcgatgcacaagtggtcatgcaggatgatgccatggaacagcttagagcagtgtgcattagagcttgggaaaaaatcacttcaggtggggaacaatacccttcctttagtgctatagagcagggaccaagggaaccataggttgattttatagctcggttacaggagtctcttaaaaagatgattgcagattcggctgctcaggatacagtgttgcagttattagctttcgacaatgctaatcccgatggccaggctgctctgcgacctatcagagggaaagcacatttagtttattatatcaaagcctatgatggtatcggaggtaatctgcgtaaagctaccttgttggcaatggcaatggcaggactgagagtggataaaggaaatactccatttcctggagcttgttttaactgtgggaagcgtggtcatactaaaaaagaatgtagaaaaaatcagcgagtcaggccaccagataggggaaaaaagaaaactgctgatcctgaaatatgtccaaaatgtaaaaaaggaaaacactgggctagtcagtgtcactctaagttggataaagaagggaacccaatttcaggaaacgccatgaggggcccgtcccgggccccgctctaaaccggggcgtttctggctcaggccattccctcacccctgtacaatgtctgtcccctgccacagccggtagtgctgcagtagatttatgctgcacaaaagctgtgagccttctgcctgcggaaccccggcaaagggtcccaacaggagtctgtggacccttgccagtgggtacaataggattacttttaggaaggtctagtgtaagtttaaaaggtatacaaatacatacaggagtcattgattcagattacagtggggaaatccaaattgttacatctacttctgttctctggaaagcagagccaggagagcgcatagcacagctcctggttgtgccgtatgtgggaatgggaaaaagtgaaattaaacgaacaggagaatttggaagcacaaataaacaaggcaaagcagcttattgggtaaatcaaattactgataaacgtcctacctgtgaaataactattcaagaaaagaaatttaaaggtttggtagatacaagaacggacatttcactcatttctgtacagcactggctgtctgcgtggccaattcaacccgctcaatttaacatagttggagttggtaaagctgctgaagtatatcaaagtagttatatattgcattgtgaggggcccgatggacaacctgggactattcaaccaattataacttctgtacctataaatttatggggaagagatgtattacaacaatggggagcacaagttctaattccagaacaatcatacagccctcaaagtcagcatacaatgcatgaaatggggtatgtccctggtatgggactagaaaaagatttgcaaggtttgaaagaaccacttcaagcggaaaaacaaagttcccagaaaaacaaagttcctgctaaagattaggaaaaaatttttggtggcagccattgttaagcctccagaacctatacctttaaaatggttaacagataagccaatttggatagcacattggccactaagtaaagaaaaactggaggttttagagaaattagttgctgaacaattagaaaatgggcacataactccaacattttctccttggaattctccagttttcataattaagaaaaaatcaggtaaatggagaatgttaactgacttaagagccatcagttcagttatacaacctatgggagcattacagccaggattgccttctcctgctataattccaaaaaattggccttttaatagtcatagatttaaaagactgtttctttactatacctttagctgagcaagactgcgaacagtttgcatttacaattcctgcattaaacaacctgcagcctgctaagtgttatcattgaaaagtgttgccacagtgcatgccaaacagcccaacaatttgccagacatatgtggggcaagcaattgaacctacccgtaaaaaatttccacagtgttacattattcactgtcaactaaaaacattaaatgattttcaaaaattactaggggatattaattggatacgacctgctctaggcattcctacctatgccaggagtaatctgttttctatccttggaggaaatcctagtctcactagccctcggcaattagcaaaagaggctgaggcagagttacaactgattgagaagcaaatccataaagctcagataaatagaatagatccagagaagactctagatttgctaatcttttcaactcagcattcacctactggtgttattgtccaagaacaggacttagtagggtggctttttcttccacatactaattcacagactccaactccttatttagatcaaatcgctactatgatagggattgggagaactcggattgttaaattacatggatatgatcctggaaaaattactgtccctctcacaaaggcacaaatacagcaagcttttataaatagtcttacttggcaaacccatttagctgactttgtgggtattctcgataatcattttcctaaaatgaagctatttcagtttttaaaattcactaattggattctccctaaaataactaaatttaaaccaattgaaggtgctgagaatgtttttacagatgggtctagtaatggtaaagcttcttattctggctcaaaaagtaaagtttttcagacgtcctgtactcagctcaaaaagcggagcttgtagcggtaattgaggtattgactgcttttgatatgcctattaatgggatttctgattcttcatatgtggttcattccacacagttaattgaaaatgctcagttatgatttcataccgatgaacaactgatgataaaaacaaaaaaggtggaaaaatagggattacagaacagcccatacacaattgaatctagcattatttggtgaagagatccaataacaaaaagttgggaaataggtaaaataataatttggggtagaggttatgcttgcgtttctccaggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgt

SEQ ID NO: 390 - DNA, 14935 bp, Homo sapiens
cctatctgcctgattttatccatctacttgtcccttcttattcacacccatttacaatgggacagtcacttattttggcaagaatatttaacagcaatgctggacaaatctatttttgaaagaaaaatcaagaacttagttcttacggtccatgagggcaccccctgcacaaaccattctcattttggaactgctgcttatttagtgtttgtgacactcttatgaaggaggcattcttttatttatttatttatttttgaggcagagtcttgctctgttgcccaggctggagtgcagtggcacaatcttggctcactgtgacctctgccccctgggttcaagtgattttcctgcctcagtctccaagtagctgggattacaggtgcgcaccaccacgctcagctaatttttgtatttttagtaaagacggggtttcaccatgttggccaggctggtctcgaactcctgacctcaaatgatccactcacctcagcctcccaaagtgctgggattataggcgtgagccactgtacccagccgaggaaggcattcttatgcccctttttcacagaagggagccagagtcagtttgcagcagaaagggatgcccatgccctgtcattccaactccgcgggccgtgtgtcacctgtcctccctgggaaagaggccggcgagccgagctctgaggcacagagcttcgccactctcttggttccaaagagctctgcaggatgtctgggaggaaagagacttcatctggctctggtttttggcaggaggaacagccctggaaccgactccaagctgtgaagactcctccattgtctgtgacacttctcgtggggcataaattactaaacaagttactgagcatgcattctgtgccaggcactgtgctaggctctggggatccaccccgtggcatactgtgggagagaagaaagcaggggctgtcagggggctccagcatttcagatgtgaaacagccattttattaatagagctggtgcacatcaaaaacacagagcaggcttatagcctgtaaggatgtcagacatggaaagtggcagtgggcccaggttggggcatgcaggatggagaagacacaggttagaaaccccaaactcctgggtgggccaggaggctttcagaagaggcttggctgactcggagaaccatcagggacgggggctagggaagaccttccagacaaagggtgcagtgtgtgtgggagagggcacaggcatgagggagaagagcctgtttgggagcgtgagtggtgtggctggagcagcaggtgggaaatgtggggaggcggagggggagagaaatgagactggggagccccggaggcctgggtcaccctgataaagaatttggcttcaacctggatgggttggggagcccttacccatgggataagcagggagcgccacactcagcttgcatttgggaggtggctggaggctggagttgagaaatggttctggaggcctgactgcctctgcatccaggctgtcctgtttcagcactgctcacccctgcaccccggcagagccacaggacttcccacactgcattgcttagaacagcaaatggcccagggaagtgtgtgcctcaggctgtgttatgtgggttactctgatactctccccactcccataccattgcatgttacaggggaggtgaaaccaggggtggttcagaggctccaacatttcagacatggagctgtcatttttagaactggtggctcacacctgtgatcccagcactttgcggggctgaggtgggaggattgcttgagcccaggagctcgagaccagcctgggcaatgcagagggatctcatctctacaaaataaaaaaataaattagcgagacatggtggtgcatgcctatagtcccagctacccaggaggtgggaggatggtgccactgtactctatcctgggcatcagagcaagaccccatcgccccccccccccaaaaaaggaaaaaagaaacccatttgcctattttgacactgtcatgaatttgtactgcttaggtggtctcagcactctaaatggtggaattttatttaaagtagtttcatgtcggtagtgccccaagataactactacaagcaaaaacatgttttattaagaggaagatagaggctgggtgcagtggctcatgcctgtaatcccaacactttgggaggctaaggcgggcggatcactcaagatcaggcattcgagaacagcctggccaacatgacgaaatcccgtctctactaaaaatacaaaattagcggggtgtggtggctcatgcctgtgatcgcagctatttgggaggctgagggaggagaatcacttgaaccggggaggcagaggttgcagtgagccgagattgtactgccgcactccagcctgggcgacagagcaagactccgtctcaaaaaaaaaaaaaaaaaaaagaagaagaacacagctttaatccaggcctcaaggaattgtgagacaaaatttcagggaaaataagcagttccctgtcaacaaccccaaaaatcataagaaaataaggcaccatgggtgaaaaccaagagatgatgtaaacagcagaatcagacccacaaagtattcagaatacaaacttatcaaaagtaaaataacatggtttttttcttttttgttttttgttttgagatagagtctcactctgttgcccaggctggagtgcagtggcgcgatctcggctcactgcaacctctgcctcccgggttcaagtgattctcctgcctcggcctcctgagtagctgggactacagatacatgccaccacacccggctaattttttgtatttttagcagagatggggtttcactgtgttagccagggtggtctcaatctcctgacctcgtgatacgcctgcctcagcctcctaaagggctgggattacaggcgcgagcccccgtgcccggcctgttttttgatttttttgagacagtgtcttgctctgtcatccaggctggagtgcaatgatgtgttcatgtctcattgcagccttgacctcctgggctcaagctattctcccaccacagcctcccaagtagctaggactacagctgtgcaccaccatgcctagctaatttttttgtgtgtggagatagggtgtcactatgttgccaggctggtcttgaactcatggactcaatccatcctcctacctaggcttccccaaatgctggaattaaggcatgaactaccacacccagcctgtttaatgtttatttttttatttttatttttatgtttgagacggagtcttgctctgtcgcccaggctggagtgcagtggcacgatctcagctcactgcaagctctgcctcccgggttcacgccattctcctgcctcaacctcctgagtagctgggactacaggcgcctgccaacatgcctggctatttttttgtatttttagtagagacgaggtttcaccatgttgaccaggatggtctcgatctcttgacctcgtgatccacctgccttggcctcccaaagtgctgggattacaggcgtgagccactgcgcctggcctgtttaatgtttaaagaaataaaaaaaacaagccaggtgtggtggtggctcacacctgtaatcccagcactttgggaggcctaggtgggtttggagcaagccccccacagtctggccataaactggccccaaaactggccataagcaaaatctctgcagcactgtaacatgcccataatggccctaatgcccacgctggaaggttgtgggtttacgggaatgacggcaaggaacacctggcccgcccagggtggaaaaccccttaaaggcattcttaagccacaaacaaaagcatgagtgatctgtgtcttaagggcgtgttcctgctgcaattaattcggcacatcccttcgtttcccataagggatacttttagttaattcaacatctatagaaacaatgctaatgactggtttgctgttaataaatacgtggataaatctctgttccgggctctcagctctgaaggctgtgagacccctgatttcccacttcacacctctatatttctctgtgtgtcttttaattcctctagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggtgagtaagaaggggagtccggaagcgtcagggtaacaatgggatgggtatggggtctggttcgtttcaccttagaactttttcacactgataacgaggaggaacaacagtatagcgaagtaacagaagaggttacagagcatgtttatttgccagctgaagctaaagcggcaaaggaaggagagtttcatccctacccttctgcatcccctcattattattttgaagaaaatgactccccagatctttcttttccggaggacactgggcgaaaagtagttgccccagtgactgttcgagcagcgccttgagcgacgtctcttagttctattcaggcaggaattcagcaagctagacaagagggtgatttagaggcttggcagttccctgttagaatacaccccccagatcaacagggaagtattacagctacatttgagccttttccttttaaattactcagagaattaaaacaagcaataaatgagtatggaccaggttctcctttagtaattggactgttaaagaatgttactgtttccagtcagatgattcctactgactgggacgctcttacttgagcttgtgtaactcctgctcagttcttacaatttaaaacttggtgggcagatgaagcttccattcaggttgctcgcaatgcccaggtccaacctcaaattaataggactgcagaccaactttcgggggttggcggctgggctggtttcgatgcacaagtggtcatgcaggatgatgccatggaacagcttagagcagtgtgcattagagcttgggaaaaaatcacttcaggtggggaacaatacccttcctttagtgctatagagcagggaccaagggaaccataggttgattttatagctcggttacaggagtctcttaaaaagatgattgcagattcggctgctcaggatacagtgttgcagttattagctttcgacaatgctaatcccgatggccaggctgctctgcgacctatcagagggaaagcacatttagtttattatatcaaagcctatgatggtatcggaggtaatctgcgtaaagctaccttgttggcaatggcaatggcaggactgagagtggataaaggaaatactccatttcctggagcttgttttaactgtgggaagcgtggtcatactaaaaaagaatgtagaaaaaatcagcgagtcaggccaccagataggggaaaaaagaaaactgctgatcctgaaatatgtccaaaatgtaaaaaaggaaaacactgggctagtcagtgtcactctaagttggataaagaagggaacccaatttcaggaaacgccatgaggggcccgtcccgggccccgctctaaaccggggcgtttctggctcaggccattccctcacccctgtacaatgtctgtcccctgccacagccggtagtgctgcagtagatttatgctgcacaaaagctgtgagccttctgcctgcggaaccccggcaaagggtcccaacaggagtctgtggacccttgccagtgggtacaataggattacttttaggaaggtctagtgtaagtttaaaaggtatacaaatacatacaggagtcattgattcagattacagtggggaaatccaaattgttacatctacttctgttctctggaaagcagagccaggagagcgcatagcacagctcctggttgtgccgtatgtgggaatgggaaaaagtgaaattaaacgaacaggagaatttggaagcacaaataaacaaggcaaagcagcttattgggtaaatcaaattactgataaacgtcctacctgtgaaataactattcaagaaaagaaatttaaaggtttggtagatacaagaacggacatttcactcatttctgtacagcactggctgtctgcgtggccaattcaacccgctcaatttaacatagttggagttggtaaagctgctgaagtatatcaaagtagttatatattgcattgtgaggggcccgatggacaacctgggactattcaaccaattataacttctgtacctataaatttatggggaagagatgtattacaacaatggggagcacaagttctaattccagaacaatcatacagccctcaaagtcagcatacaatgcatgaaatggggtatgtccctggtatgggactagaaaaagatttgcaaggtttgaaagaaccacttcaagcggaaaaacaaagttcccagaaaaacaaagttcctgctaaagattaggaaaaaatttttggtggcagccattgttaagcctccagaacctatacctttaaaatggttaacagataagccaatttggatagcacattggccactaagtaaagaaaaactggaggttttagagaaattagttgctgaacaattagaaaatgggcacataactccaacattttctccttggaattctccagttttcataattaagaaaaaatcaggtaaatggagaatgttaactgacttaagagccatcagttcagttatacaacctatgggagcattacagccaggattgccttctcctgctataattccaaaaaattggccttttaatagtcatagatttaaaagactgtttctttactatacctttagctgagcaagactgcgaacagtttgcatttacaattcctgcattaaacaacctgcagcctgctaagtgttatcattgaaaagtgttgccacagtgcatgccaaacagcccaacaatttgccagacatatgtggggcaagcaattgaacctacccgtaaaaaatttccacagtgttacattattcactgtcaactaaaaacattaaatgattttcaaaaattactaggggatattaattggatacgacctgctctaggcattcctacctatgccaggagtaatctgttttctatccttggaggaaatcctagtctcactagccctcggcaattagcaaaagaggctgaggcagagttacaactgattgagaagcaaatccataaagctcagataaatagaatagatccagagaagactctagatttgctaatcttttcaactcagcattcacctactggtgttattgtccaagaacaggacttagtagggtggctttttcttccacatactaattcacagactccaactccttatttagatcaaatcgctactatgatagggattgggagaactcggattgttaaattacatggatatgatcctggaaaaattactgtccctctcacaaaggcacaaatacagcaagcttttataaatagtcttacttggcaaacccatttagctgactttgtgggtattctcgataatcattttcctaaaatgaagctatttcagtttttaaaattcactaattggattctccctaaaataactaaatttaaaccaattgaaggtgctgagaatgtttttacagatgggtctagtaatggtaaagcttcttattctggctcaaaaagtaaagtttttcagacgtcctgtactcagctcaaaaagcggagcttgtagcggtaattgaggtattgactgcttttgatatgcctattaatgggatttctgattcttcatatgtggttcattccacacagttaattgaaaatgctcagttatgatttcataccgatgaacaactgatgataaaaacaaaaaaggtggaaaaatagggattacagaacagcccatacacaattgaatctagcattatttggtgaagagatccaataacaaaaagttgggaaataggtaaaataataatttggggtagaggttatgcttgcgtttctccaggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgtgcaactcatcagagttgcacagggcagagaaagaatgggaaaaaaacaatttctagaaaacttttcgaattttctgatcaacaccaaatattccaaataggaaaaatacaaaaaaatccatacctatatgtggcataatatgattgtagagcaccaaagtaaaagatcttattttttattaaaattaaaaaaaaattaaaatagagggtctcactatgctgcccaggctggtcttgaactcctggcttcaagctatcctcccaccatggcatcctaaagtgctgggattgcaggcatgagctgctgcatctggcccaaagtaaaagatcttagaagcggccagaaaaaatagatttgggctgggcatgaatagattgatcaccaaaaaggtggcagactaacttctcgacagaatccacagaagccagaaggcagtggaacattagctttgatgtactaaaataaaataccacgctaggctcctacatacagtgaaaatgttttgagaatgagaattataattttttggcaaacaaaactaaaggagtttacaactaagaaactcttttgtgagacagccttgctctgttgcccaggctggagtgcagtgacgaaatctcagctcactgcaacctcggcctcccgggttcaggcaattcttgtgtctcagccttccaagtagctgggattacagatgtgcgccaccaggcccagctactttttatatttttagtggagatggggtttcactgtgttggccaggctggtctcaaactcctgacttcaagtgatctgcccgccttggcctgctaaagtgctgggattacaggcatgagcgactgtgcctctccagtccctgtgtttttttttgtttttggaggttttatttgtttgtttttagagacactttcactgtgttgcccaggcctgtctgttggcctcaagtgatcctcctgccttggatctcccaaagtgctgggattacaggtgtgaaccactgtgctcagcccattttttatttgtttcttgaaggaaggtagcagtattaattaattttggactttgctcactaaagtttgaatgttaagaatagatgtatacagtctggatgcagtggtgcatgcttgtaattttagcactttgggaggctgaagcgggaggatcgcttgggctcaagagtttgagaccagcctgggcaacatggtgaaaccttgtctctacaaaaaaattttaaaaaattagccagacatgatggcatgcacctataatcccagctacttgggaggctgaggtgggaggattgcttgagtccagggaggtcgaggctgcagtgagccatgatcacaccactgcactccagcctgggtgacagagtgatactgtctcaaaaaaaaaaaaaaaaaaaaaaagaaagaaaaaagtagatatatatgagactcacttgggcaacatatggagacctagtctccacaaaaaaatttaaaaaattagctaagtatggtggcatgcacctgtggtcccaactacttgggagggtgaggcaggagaattgcttgagaccaggatgatcccttgatcctggcagggggtggagttgaggccgcattccaacctgggcaacagagtgagaccctgtctcaaaagataaataaaaaagaatagacatataatatgtaacttccaaacaaatgaaagggaaataaaggagtacgagaagaaaggcaaattcaatgatccaaaacaaagtgagaaaagagaaaaacaaaataaaaatgaaaaaggagaggttctgcttgtaataggcgaagtagctcctatcagatcaaccttcataccggtaacaattatgagctctgaacaaaaacaaacaaaaaacctcctgaagactctggaaagagagcaaaaacagggagaacctaaagggaaaccgacagttacaagaaaataaatagctaccgggtgcaaaggatatttaaaatctcacaaacatgataattgaaccaaagaagtcagaagaaaggagtctgtgttttataattccatttatatgaagtatgaaaacaggcaaaccatattaaaagtcaggatagctgttcccctgacgaggaggatagcgattggaagtaggacatgaggaggatttctggggtcctggtaatgctctatttctggatctgggtgctggtttcatgggtgtgctcacttggtgaaaattcataaaaatagacatgacatatgcaattttttgcttcagtacaaacttaaaaatcaaaagggagcagagacaagatggacaggcaggcagggcagactgtgaaggggcctcaatgccagactaaggagcttgacgtgaccctggcagcagtggaggacgctgaaggtgttaagaggggaaatgagttgtcagggaagctgcctctctgcctaatgcgggtggctaggagaggggaacacctgccctgtgggacattatttacaggactggccagaatctgggctttcaatgacgaagatctgagctaggatggagggtgtgaggttggaggccaaggatttggaggtaaaattggaaggacttgggagtttacatgcaggaggccagagaggaagagggaggagtcaaaaacgatcattggaagaggcttttcactggagataaagagtgagggaggggacgctggggaaagaagtaagtttgagggaagaatttgtttttttttttttaatcagggtcttgctctgttgcccaggctgtagtgcagtggcaccatcttggctcactgtagctcgacctctcagatgctggtgattccccccacctcagcctgctaagtagctgggactacaggcgcatgccaccatacctggttgatattttttaatttttatttttagtagagatgaagtctcactatgttgcccaggctggtcttgaaatcctgggctcaggtgatcctcctgcctcggtctcccaaattgctgggattacagcatgagccactgcacccagccaaaggaaggatttttgctggggaaggggcaagtggaggaggaatcctcgatgacacaaggcctctgaagcagcagaaggagactgggggtgcaggggaccccctgtccagatttggacaggagaggagagaagcagaaaaagtgagatcctaggtggactggagggaattcaggagagcccatcagctgctcactaatgtgaagtcacagtcaagtgtggggactgagtcggatgaggctgacttctaggcagcttgtctgacaacaggttatgcagtgtatctaaggacatcctgacctgggggaacaggaagatgggaagattccattatcattttgtaaatggtgcccagtgaagtttctattagtatctagtctccaatcatcttaattagctgagctattgctcatcatcaaaaggattttctttagaaagatagccgtagagtcttgcttttcttatcaaaagatctagatgacactgctgtgccccggcctgccccaccctcattcctgccctgctccacgcacttatctgtgcctggaacaggagttagggtggagtaggaaaaagatcaaggatttgagtgcacaaggacaggcaggcatcctagctcctgaccttgggccaatattttctcgctatgggtctcagttgcctcatcacagaccacctgatttcaaagcccttgtcaccctgaaatacacagaggtccaaggtcatatggtgaggg

SEQ ID NO: 391 - DNA, 11189 bp, Homo sapiens
cctatctgcctgattttatccatctacttgtcccttcttattcacacccatttacaatgggacagtcacttattttggcaagaatatttaacagcaatgctggacaaatctatttttgaaagaaaaatcaagaacttagttcttacggtccatgagggcaccccctgcacaaaccattctcattttggaactgctgcttatttagtgtttgtgacactcttatgaaggaggcattcttttatttatttatttatttttgaggcagagtcttgctctgttgcccaggctggagtgcagtggcacaatcttggctcactgtgacctctgccccctgggttcaagtgattttcctgcctcagtctccaagtagctgggattacaggtgcgcaccaccacgctcagctaatttttgtatttttagtaaagacggggtttcaccatgttggccaggctggtctcgaactcctgacctcaaatgatccactcacctcagcctcccaaagtgctgggattataggcgtgagccactgtacccagccgaggaaggcattcttatgcccctttttcacagaagggagccagagtcagtttgcagcagaaagggatgcccatgccctgtcattccaactccgcgggccgtgtgtcacctgtcctccctgggaaagaggccggcgagccgagctctgaggcacagagcttcgccactctcttggttccaaagagctctgcaggatgtctgggaggaaagagacttcatctggctctggtttttggcaggaggaacagccctggaaccgactccaagctgtgaagactcctccattgtctgtgacacttctcgtggggcataaattactaaacaagttactgagcatgcattctgtgccaggcactgtgctaggctctggggatccaccccgtggcatactgtgggagagaagaaagcaggggctgtcagggggctccagcatttcagatgtgaaacagccattttattaatagagctggtgcacatcaaaaacacagagcaggcttatagcctgtaaggatgtcagacatggaaagtggcagtgggcccaggttggggcatgcaggatggagaagacacaggttagaaaccccaaactcctgggtgggccaggaggctttcagaagaggcttggctgactcggagaaccatcagggacgggggctagggaagaccttccagacaaagggtgcagtgtgtgtgggagagggcacaggcatgagggagaagagcctgtttgggagcgtgagtggtgtggctggagcagcaggtgggaaatgtggggaggcggagggggagagaaatgagactggggagccccggaggcctgggtcaccctgataaagaatttggcttcaacctggatgggttggggagcccttacccatgggataagcagggagcgccacactcagcttgcatttgggaggtggctggaggctggagttgagaaatggttctggaggcctgactgcctctgcatccaggctgtcctgtttcagcactgctcacccctgcaccccggcagagccacaggacttcccacactgcattgcttagaacagcaaatggcccagggaagtgtgtgcctcaggctgtgttatgtgggttactctgatactctccccactcccataccattgcatgttacaggggaggtgaaaccaggggtggttcagaggctccaacatttcagacatggagctgtcatttttagaactggtggctcacacctgtgatcccagcactttgcggggctgaggtgggaggattgcttgagcccaggagctcgagaccagcctgggcaatgcagagggatctcatctctacaaaataaaaaaataaattagcgagacatggtggtgcatgcctatagtcccagctacccaggaggtgggaggatggtgccactgtactctatcctgggcatcagagcaagaccccatcgccccccccccccaaaaaaggaaaaaagaaacccatttgcctattttgacactgtcatgaatttgtactgcttaggtggtctcagcactctaaatggtggaattttatttaaagtagtttcatgtcggtagtgccccaagataactactacaagcaaaaacatgttttattaagaggaagatagaggctgggtgcagtggctcatgcctgtaatcccaacactttgggaggctaaggcgggcggatcactcaagatcaggcattcgagaacagcctggccaacatgacgaaatcccgtctctactaaaaatacaaaattagcggggtgtggtggctcatgcctgtgatcgcagctatttgggaggctgagggaggagaatcacttgaaccggggaggcagaggttgcagtgagccgagattgtactgccgcactccagcctgggcgacagagcaagactccgtctcaaaaaaaaaaaaaaaaaaaagaagaagaacacagctttaatccaggcctcaaggaattgtgagacaaaatttcagggaaaataagcagttccctgtcaacaaccccaaaaatcataagaaaataaggcaccatgggtgaaaaccaagagatgatgtaaacagcagaatcagacccacaaagtattcagaatacaaacttatcaaaagtaaaataacatggtttttttcttttttgttttttgttttgagatagagtctcactctgttgcccaggctggagtgcagtggcgcgatctcggctcactgcaacctctgcctcccgggttcaagtgattctcctgcctcggcctcctgagtagctgggactacagatacatgccaccacacccggctaattttttgtatttttagcagagatggggtttcactgtgttagccagggtggtctcaatctcctgacctcgtgatacgcctgcctcagcctcctaaagggctgggattacaggcgcgagcccccgtgcccggcctgttttttgatttttttgagacagtgtcttgctctgtcatccaggctggagtgcaatgatgtgttcatgtctcattgcagccttgacctcctgggctcaagctattctcccaccacagcctcccaagtagctaggactacagctgtgcaccaccatgcctagctaatttttttgtgtgtggagatagggtgtcactatgttgccaggctggtcttgaactcatggactcaatccatcctcctacctaggcttccccaaatgctggaattaaggcatgaactaccacacccagcctgtttaatgtttatttttttatttttatttttatgtttgagacggagtcttgctctgtcgcccaggctggagtgcagtggcacgatctcagctcactgcaagctctgcctcccgggttcacgccattctcctgcctcaacctcctgagtagctgggactacaggcgcctgccaacatgcctggctatttttttgtatttttagtagagacgaggtttcaccatgttgaccaggatggtctcgatctcttgacctcgtgatccacctgccttggcctcccaaagtgctgggattacaggcgtgagccactgcgcctggcctgtttaatgtttaaagaaataaaaaaaacaagccaggtgtggtggtggctcacacctgtaatcccagcactttgggaggcctaggtgggtttggagcaagccccccacagtctggccataaactggccccaaaactggccataagcaaaatctctgcagcactgtaacatgcccataatggccctaatgcccacgctggaaggttgtgggtttacgggaatgacggcaaggaacacctggcccgcccagggtggaaaaccccttaaaggcattcttaagccacaaacaaaagcatgagtgatctgtgtcttaagggcgtgttcctgctgcaattaattcggcacatcccttcgtttcccataagggatacttttagttaattcaacatctatagaaacaatgctaatgactggtttgctgttaataaatacgtggataaatctctgttccgggctctcagctctgaaggctgtgagacccctgatttcccacttcacacctctatatttctctgtgtgtcttttaattcctctagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggtgagtaagaaggggagtccggaagcgtcagggtaacaatgggatgggtatggggtctggttcgtttcaccttagaactttttcacactgataacgaggaggaacaacagtatagcgaagtaacagaagaggttacagagcatgtttatttgccagctgaagctaaagcggcaaaggaaggagagtttcatccctacccttctgcatcccctcattattattttgaagaaaatgactccccagatctttcttttccggaggacactgggcgaaaagtagttgccccagtgactgttcgagcagcgccttgagcgacgtctcttagttctattcaggcaggaattcagcaagctagacaagagggtgatttagaggcttggcagttccctgttagaatacaccccccagatcaacagggaagtattacagctacatttgagccttttccttttaaattactcagagaattaaaacaagcaataaatgagtatggaccaggttctcctttagtaattggactgttaaagaatgttactgtttccagtcagatgattcctactgactgggacgctcttacttgagcttgtgtaactcctgctcagttcttacaatttaaaacttggtgggcagatgaagcttccattcaggttgctcgcaatgcccaggtccaacctcaaattaataggactgcagaccaactttcgggggttggcggctgggctggtttcgatgcacaagtggtcatgcaggatgatgccatggaacagcttagagcagtgtgcattagagcttgggaaaaaatcacttcaggtggggaacaatacccttcctttagtgctatagagcagggaccaagggaaccataggttgattttatagctcggttacaggagtctcttaaaaagatgattgcagattcggctgctcaggatacagtgttgcagttattagctttcgacaatgctaatcccgatggccaggctgctctgcgacctatcagagggaaagcacatttagtttattatatcaaagcctatgatggtatcggaggtaatctgcgtaaagctaccttgttggcaatggcaatggcaggactgagagtggataaaggaaatactccatttcctggagcttgttttaactgtgggaagcgtggtcatactaaaaaagaatgtagaaaaaatcagcgagtcaggccaccagataggggaaaaaagaaaactgctgatcctgaaatatgtccaaaatgtaaaaaaggaaaacactgggctagtcagtgtcactctaagttggataaagaagggaacccaatttcaggaaacgccatgaggggcccgtcccgggccccgctctaaaccggggcgtttctggctcaggccattccctcacccctgtacaatgtctgtcccctgccacagccggtagtgctgcagtagatttatgctgcacaaaagctgtgagccttctgcctgcggaaccccggcaaagggtcccaacaggagtctgtggacccttgccagtgggtacaataggattacttttaggaaggtctagtgtaagtttaaaaggtatacaaatacatacaggagtcattgattcagattacagtggggaaatccaaattgttacatctacttctgttctctggaaagcagagccaggagagcgcatagcacagctcctggttgtgccgtatgtgggaatgggaaaaagtgaaattaaacgaacaggagaatttggaagcacaaataaacaaggcaaagcagcttattgggtaaatcaaattactgataaacgtcctacctgtgaaataactattcaagaaaagaaatttaaaggtttggtagatacaagaacggacatttcactcatttctgtacagcactggctgtctgcgtggccaattcaacccgctcaatttaacatagttggagttggtaaagctgctgaagtatatcaaagtagttatatattgcattgtgaggggcccgatggacaacctgggactattcaaccaattataacttctgtacctataaatttatggggaagagatgtattacaacaatggggagcacaagttctaattccagaacaatcatacagccctcaaagtcagcatacaatgcatgaaatggggtatgtccctggtatgggactagaaaaagatttgcaaggtttgaaagaaccacttcaagcggaaaaacaaagttcccagaaaaacaaagttcctgctaaagattaggaaaaaatttttggtggcagccattgttaagcctccagaacctatacctttaaaatggttaacagataagccaatttggatagcacattggccactaagtaaagaaaaactggaggttttagagaaattagttgctgaacaattagaaaatgggcacataactccaacattttctccttggaattctccagttttcataattaagaaaaaatcaggtaaatggagaatgttaactgacttaagagccatcagttcagttatacaacctatgggagcattacagccaggattgccttctcctgctataattccaaaaaattggccttttaatagtcatagatttaaaagactgtttctttactatacctttagctgagcaagactgcgaacagtttgcatttacaattcctgcattaaacaacctgcagcctgctaagtgttatcattgaaaagtgttgccacagtgcatgccaaacagcccaacaatttgccagacatatgtggggcaagcaattgaacctacccgtaaaaaatttccacagtgttacattattcactgtcaactaaaaacattaaatgattttcaaaaattactaggggatattaattggatacgacctgctctaggcattcctacctatgccaggagtaatctgttttctatccttggaggaaatcctagtctcactagccctcggcaattagcaaaagaggctgaggcagagttacaactgattgagaagcaaatccataaagctcagataaatagaatagatccagagaagactctagatttgctaatcttttcaactcagcattcacctactggtgttattgtccaagaacaggacttagtagggtggctttttcttccacatactaattcacagactccaactccttatttagatcaaatcgctactatgatagggattgggagaactcggattgttaaattacatggatatgatcctggaaaaattactgtccctctcacaaaggcacaaatacagcaagcttttataaatagtcttacttggcaaacccatttagctgactttgtgggtattctcgataatcattttcctaaaatgaagctatttcagtttttaaaattcactaattggattctccctaaaataactaaatttaaaccaattgaaggtgctgagaatgtttttacagatgggtctagtaatggtaaagcttcttattctggctcaaaaagtaaagtttttcagacgtcctgtactcagctcaaaaagcggagcttgtagcggtaattgaggtattgactgcttttgatatgcctattaatgggatttctgattcttcatatgtggttcattccacacagttaattgaaaatgctcagttatgatttcataccgatgaacaactgatgataaaaacaaaaaaggtggaaaaatagggattacagaacagcccatacacaattgaatctagcattatttggtgaagagatccaataacaaaaagttgggaaataggtaaaataataatttggggtagaggttatgcttgcgtttctccaggccaaaatcaacagccgatttggataccttcaagacacctgaaaccttatcatgagccagatgccaaggaagagactctgggaggatccagaggaccccctggttgcagccacgtagagactgacgctgaggaggactccaactatcatgagcaacacccgtcgaacacagccaccccgctaagaacagatcaagaagctgtcacagatggcggaagaaaacctgaggaaagcgggacaaccagtcacaatgaataatttaatggtagctatgatagcagttatcaccactgccgtgagtattccttcaataagggctggtaataatgcctggatgcaatcattctatgacacagttacacatgctttctgatctcagtatttaccataataaatcggctcctataattgaggcataccaccctcaaaaacctatttgtaaacaggattggacccagttagaaaaaatgaacgtacttatttaggaagattgctttgcagaataggcagagatgctgcacaacgattcctatggaatcattactaattggtcccccaaggggatgtttagcttgaattgcacctctcagtctgcatgccacggtcacactatgttcagatgatctgaacaaaacagtcagatggtagaaatgttaagtacggcaaaagttcctattatctggaaccatggcggtatagtggcacctcaacctcaaataatatggcccgctctaggagctaaacataaggatttgtaaaaactattaaatgctcttaataagatcaaaatttgggaaagaataaaagagtatctagaaggacactctacaaacttgtttttggatatagcaaaattaaaagaacaaatatgtaaagcatcccgggcaacctgaccttaatgccaggaaccagagtgcttaaaggagctgcagaaaaattagcagctagtaacccatttaaatgggtaaaaacacttggaagctctgtgatttcaatgatgactatgctttttaatctgttgtttgcctttgtatagtctgcagatgcggatcccgactcctgcgagagtctctttgcaaatcgaagaagggagacatgttgggagcaagccccccagagtctggccataaactggccccaaaactggccataagcaaaacctctgcagcactaaaacatgtccataatggccctaacgcccaatctggaaggttgtgggtttatgggaatgagagcaaggaacacctggcctgcccagggcggaaaaccgcttaaaggcattcttaagccacaaacaaaagcatgagcgatctgtgtcttacgggtgtgttcctgctgcaattaattcagcccatccctttgtttcccataagggatacttttagttaatttaatatctatagaaacaatgctaatgactggtttgctgttaaatgaaggggtgggttgcccctccacacctgtgggtgtttctcgttaggtggaacgagagacttggaaaagagacacagagacaaagtatagagaaagaaaagtgggcccaggggaccagcattcagcatacagaggatccacactggcaccggcctctgagttcccttagtatttattgatcattatcgagcatggcaggataataggataatagtggagagaaggtcagaaggtaaacacatgaacaaaggtctctgcatcataaacaaggtaaagaattaagtgctgtgctttagatatgtatacacataaacatctcaatgccttaaagagcagtattgctgcccgcatgtcatacctacagccctaaggcggttttcccctatctcagtagatggaagtatattccatgtaaagtaaatcggctttacacccagacattccattgcccagagacgagcaggagacagaagccttcctcttatctcaactgcaaagaggtgttccttcctcttttactaatcctcctcagcacagaccctttatgggtgtcgggctgggggatggtcaggtctttcccttcccacgaggccatatttcagactatcacatggggagaaaccttggacaatacctggctttcctaggcagaggtccctgcggcctttgcagtattttgcgtctctgggtacttgagattagggagtggtttgagattagggagtggtgatgactcttaaggagcatgctgccttcaagcatttgtttaacaaagcacatcttgcacagcccttaatccatttaaccctgagttgacacagcacatgtttcagggagcacagggttgggggtaaggttacagattaacggcatctcaaggcagaagaatttttcttaatacagaacaaaatggagtctcctatgtctacttctttctacacagacacagtaacaatctgatctctcttttccccacagttaataaatatgtgggtaaatctctgttgggggctctcagctctgaaggctgtgagacccctgattttctacttcacacctctatatttttgtgtgtgtgtctttaattcctctagcgctgctgagttagtgaccgagctggtctcggcagaggtgggcgggtcttttgagttcaggagttcaagagcagcctggccaacatggtgaaaccccttctctactaaaaatatgaaaattatccgggcatggtggtgtgcctctgtactttcagctactcaggaagctgaggcacaagaattgctggaacatgggaggtggaggctgcagtgagctgagatcatgccactgcactccagcccaggcaatagagtaagactctgtctcaaaacaaaaagagttttaggccaggtgtggtggctcacgcctgtaatcccagcactttgggaggctgaggtgggcagatcacctgaggtcaggagttcgagaccagtctggccaacatggcgaaaccccatctctctctactaaaaatacaaaatttagccaggtgtggtggtgggtgcctgtaatcacagctgcttgggaggctgaggcaggagaattggttgaacccaggaggcagaggttacagtgagcagagatcgtgccactgcattccagccggggtaagagagcgagactctgcctcaaaaaaagaaggcttagtgt

SEQ ID NO: 392 - DNA, 5709 bp, Homo sapiens
tatccatgcatgattacatataaacaaaaatgtttagtttagaaagggaaaaatagtgggtacaatcacagttttattttatttttatatatatattttttattatcctttaagttctagggtacatgtgcacaacgtgcaggtttgttacatatgtatacatgtgacatgttggtgtgctgcacccattaactcgtcatttacattaggtatatctcctaatgctatccctcccccagcccccaaccccacaacaggccccggtgtgtgatgttccccttccggtgttcaagtgttctcattgttcaattcccacctatgagtgagaacacgcggtgtttggttttttgtccttgtgatagtttgctgagaatgatgatttccagcttcatccatgtccctacaaaggacatgaactcatccttttttatagcagcaaagtattccatggtgtatatgtgccacattttcttaatccagtctatcattggtggacatttgggttggttccaagtcttggcgattgtgagtagtgccgcaataaacatacatgtgcatgtgtttttatagcagcatgatttatattcctttgggtatatacccagtaatgggatggctgggtcaaatggtatttctagttctagatccctgaggaattgccacactgacttccacaatggttgaactagtttacagtcccaccaacagtgtaaaagtgttcccatttctccacatcctttccagtacctgttgtttcctgactttttaatgatcaccattctaattgatgtgagatgatatctcattgtggttttgatttgcatttctctgatggccagtgatgatgagcattttttcatgtgtctgttggctgcataaatgtcttcttttgagaagtgtctgttcatatccttcacccactttttgatggggttgtttgttttttttcttgtaaatttgtttgagttatttgtggattctggatattaaccctttgtcagatgagtagattacaaaaattttctcctattctctaggttgcctgttcactctgatggtagtttcttttgctgtgcagaagctctttacgtagatcccatttgtgaattttggcttttgttgctattgcttttggtgttttagacgtgaagtccttgcccctgcctacgtcctgaatggtattgcctaggttttcctctagagattttatggttttaggtctaagatttaagtctttaatccatcttgaattaatttttgtataagatgtaaggaagggatccagtttcatctttctacttatggctagccagttttcccagcaccatttgttaaataggaaatcctttacccatttcttgattttgtcaggtttgttaaagatcagatagttgtagatgtgtggtattatttctaagggctctgttctgttccattggtctgtatctctgttttggtaccagtaccatgctgttttggttactgtaacctcgtagtatagtttgaagtgaggtagtgtgatgcctccagctttgttcttttggcttaggattgacttggcaatgcaggctctttgttggttccatatgaactttaaagtagttttttccaattctgtgaagaaagtcattggtagcttgatggggatggcattgaatctataaattaccttgggcagtatggccattttcatgatattgattcttcctatccatgaacatggaatgttcttccatttttttgtgtcctcttttatttggttgagcagtggtttgtagttctccttgaagaggtccttcacatcccttgtaagttggaatcctaggtattttattctctttgaagcaattgtgaatgggagttcactcatgatttggttctctgtttgtctgctattggtgtgtaagaatgcttgtgatttttgcacattgattttgtatcctgagactttgctgaagttgcttatcagcttaaggagattttgggctgagatgatggggttttctagatatacaatcatgtcatctgcaaagagggacaatttgacttcctcttttcctaattgaatgccctttctttctttctcctgcctaattgccctggccagaacttccaacactatgttgaataggagtggagagagagggcatccctgtcttgtgccagttttcaaagggaatgcttccagtttttgcccattcagtatgatattggctgcgggtttgtcataaatagctcttattattttgagatacatcccatcaatacctaatttattgagaggttttagcatgaagggctgttgaattttgtcaaaggccttttctgcatctgctgagacaatcatgtggtttttgtcattggttctgtttatatgctggattacgtttattgattttcgtatgttgaaccagccttgcatcccagggatgaagcccacttgatcatggtggataagtttttgatgtgttgctggattcggtttgccagtattttattgaggatttttgcatcaatgttcatcaggggtattggtctaaaattctctttttttgttgtgtcgctgccaggctttggtatcaggatgatgctggcctcataaagtgagttagggaggattccctctttttctactgattggaatagtttcagaaggaatggttccagctccttcttgtacctctggtagaattcatctgtgaatccatctggtcctggactttttttgcttggtaagctactaattattgcctcaatttcagagcctgttattggtctattcagagattcaacttcttcctggtttagtcttgggagggtgtatgtgtccaggaatttatccatttcttctagattttctagtttatttgcgtagaggtgtttatagtattctctgatggtagtttgtatttctatgggatcagtggtgatatcccctctatcattttttcttgcatctatttgattcttctctcttttcttctttattagtcttgctagcagtctgtcaattttgttgatcttttcaaaaaaccagctcctggattcattgatttttggaagggttttttttgtctctgtttccttcagttctgctctgatcttagttattccttgccttctgcaagcttctgaatgtgtttgctcttgtttctctagttcttttcattgtgatgttagggtgtcaattttagatcttttctgctttctcttgtgggcatttagtgctataaatttccctctacacactgctttaaatgtgtcccagagattctggtacattgtgtctttgttctcgttggtttcaaagaatatctttatttctgccttcatttcgttatgtacccagtagtcattcaggagcaggttgttcagtttccatgtagttgagtggttttgagtgagtttcttaatcctgagttctaatttgattgcactgtggtctgagagacagtttgttgtgctttctgttcttttacatttgctgaggaatgctttacttccaactatgtggtcaattttgcaatagctgtggtgtcgtgctgagaagaatgtatattctgttgatttggggtgaagagttctgtagatgtctattaggtctgcttggtgcagagctgagttcaattcctggatatccttgttaattttctgtctcattgatctgtctaatgttgacagtggagtgttaaagtctgccattattattgtgtgggagtctaagtctctttgttggtctctaaggacttgctttatgaatctgggtgctcctgtattaggtgtatatatatttaggatagttagctcttcttgttgaattgatccctttaccattatgtaatggccttctttgtctcttttgatctttgtttgtttaaagtgtgtttcatcagagactaggattgcaacccctgcctttttttggtttccatttgcttagtggatcttcccccatccctttattttgagcctatgtgtgtctctgcatgtgagatgggtttcctgaatacagcacactgatgggtcttgactctttatccaggttgacagtctgtgtcttttaattggagcacttagcccatttccatttaaggttaatattgttatgtgtgaatttgatcctgtcattatgatgttagctggttattttgctcgttacttgaagcagtttcttcctagcatcaatagtctttacaatttagcatgtttttgcagtggctggtgcgctttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttatttaagaatgttgaatattgacccccactctcttctggcttgtagagtttctgctgagagatccattgttagtctgatgggcttcactttttgggtaacccaacctttctctctgtctgcccttaacattttttccttcatttcaactttggcgaatctgacaattatgtgtcttggagttggtcttcttgaggagtatctttgtggcattctctgtatctcctgaatttgaatgttggcctgccttgctaggttggggaagttctcctggataatatcttgcagagtgttttccaacttggttccattctccccgtcactttcaggtacaccaatcagatgtagatttggtcttttcacatagtcccatatttcttggaggctttgcttatttctttttattcttttttctctaaacttctcttctctcttcatttcattcatttgatcttccatcactgataccctttcttccagttgattgaatcggctactgaagcttgtgcattcatcacttagttctcgtgccatggttttcagctccatcaggtcctttaaggacttctctgcattggttattctagttagccattagtcgaatcttttttcaaggtttttaacttctttgcaatgggtttgaacttccttctttagctcagagaagtttgattgtctgaagccttcttctctcaacttgtcaaagtcattctccgtccagctttgttccattgctggtgaggagctgcattcctttggaggaggagaggcgctctgatttttagaattttcagtttttctgttctgttttttccccatctttgtggttttatctacctttggtctttgatgatggtgacgtacacatggggttttggtgtggatgtcctttctgtttgttagttttccttttaacagtcaggaccctcagctgcaggtctgttggagtttcctggaggtccactccagaccctgtttgcctgggtatcagcagtggaagctgcagaacagcgaatattgctgaacagcaaatgttgctgtctgatcatttctctggaggttttgtctcagaggagtacccggccttgtgaggtgtcagtctgcccctactgggggctgcctcccagataggctgctcgggggtcaggaacccacttgaggaggcagtctgcccattgtcagatctcacactccgtgctgggagaactactactctcttcaaagctcagttggaaatgtggaaatcacccatcttctgcgtcactcacactgggagctgtagactggagctgatcctattctaccatcttggatggagta

SEQ ID NO: 393 - DNA, 10228 bp, Homo sapiens
agtgtttttcttcaaactctgcaattaggaatacccacatattggaacatttgctactctatctcattccacatgtgtgtgtatggtgtatatatgtgtttacatatttgtgtatattaatttccacaagtattttatgcccataaatattcatgccataatagacttttgttcatttatgatgcaaaaattaactctgaagcaaactgtattcttgcttctcatggtcacatactttctctctctgtctctaagctttgttaacctagtggtaaattctgtggtacccatttgcatgcatacatacgtgtgtgtgtgtgtttatgtgtgtatagatatagacatagatatagatattcttgactatttgtatccatggtgcacgtgtgcacgtgcgcacacacacagacacacacacacacaagtatgtatacatggaatagcaagtctctaggggctttgctgaagttaaaccaagaatttcaatatatgatactactactaaacagtatcaggccctgcgaacatgacacattcattgccaacatcaggacacctaatagagtggatactgaccaagggggtgtattcttgcccagatgatacttatttaggcaatgccagtgttggctaatttcacttttccttcatggcctctgtctctctgttacttatgtagcactcattctgtgtcagactgtgttctaagaacttcaactatattaaccttacttaactgttaaaaagacttctgagatagataccatttatccatttcattttcaggtgggaaattgaggcataaggcatttgggcaatgtgttcaatgacaattaaacagctagaaagtgcctggttagctaggatgtaagccaggcattttggttcctgagcccacactcttatacactgtaatactatctcattcatcctgctgtaattattcatttaattacatgagctcctgccagactgcatgttctatgaataaggggccatgtcaatcttgcctgtctttctatcttgtgtcatcataatgcctggtaggtaatagggaatacataactggttttcacttttaattgaattaaagtaaaagtttgtctctataagatcccttttcatatatcttcctgataaaaaacctgtttaataagctgaaaagatgaggtttcattaagaagaggtgatacagaaaaacaacaccatatttttctaacttatgcctcatctggcttactgcttagttcccatttgtcatcagtgcacttaaaaaattattttgaaaaattgccatttttaatatctttggaacttcctaacacattacctattttttaaccaaacgaggtgattccttatgggaaaatatatacagcaagaaaaaaaaaaggaaaaaatgttgatgatacctgtttaattgggaaatatgtttgcatatttattatatctcggaaagaaatgtatgacttattataacagcatttagtcttccaaaatatcagtgactccacagtatatgccttcatttccaaaatgaggggaaaagcattgagtgtatagtacttcctttttttcccccacaaagaaaaaatcatagtggaaattacattgaagaataatctgcacaaaacaaaaaagcacaaatcttatgtttctggttcagtgacttttgataaaggtaacccataattactaacccaatcaagatacagaaccattctgtacctctggaaagttcccatagtctccctcccagtgaatcttccctagtcaccccttggtaaccattgataggatatctatcgcaataacttaattctgcccattcaagaacctcattttaaaccttacaaaaccagaagttattgaaagagatgtgattgtaaccatctttgtttttgtaaggaccacgagttaactacacgtagatatatcatccagagaaaagtcctgataaaagtataatcagtgcaagttgaattcacaggtaaggtttactgtagacgtggaagggtgtttcaaaattactcttgagaaacaggtctcaggctaacagtttctctcacctctgttgcattgtctctttcttttgaataactactgtgtgctgtggtttcacaaacctctcagtaaagtagtgatgggaaaatacttttgttctatgttttgttgacctagtggtaaattctgttacccagctgtcaagcaattagattataataatgaatattttcttaaggcaatttattgggccaaagaaccctgtgaataaatagtagtatcttttattttcagagagcctagttaacatccctccacttgctaaaactagccagaatgtgatattagtgactttcattctattaaataagcattcatgattatcctaaacattcttgccaaatgtgcatatgaaaatagcatagccactgtaattgttaagtcagtcaatttttctcaaggactgtgttgctttaaaaagttagtagtgtttacacattcatgtgattggtctgaagtttacatgctaaataatatttactgtgaaagatgtgtgtgtttgtcagtggatgtgtgcatatattcagatacctaatatgaccaatgtgacaagggaccccatttttttctgccataaattaagggttaatgatagcatttattgcattgagctgctgagaggaccaaatgagataatgcattcagaaatgttgagtgttatttggtttggaaattgataaaaagggcaggtcttacatcgagtgcagctttacaacatattatccatgcatgattacatataaacaaaaatgtttagtttagaaagggaaaaatagtgggtacaatcacagttttattttatttttatatatatattttttattatcctttaagttctagggtacatgtgcacaacgtgcaggtttgttacatatgtatacatgtgacatgttggtgtgctgcacccattaactcgtcatttacattaggtatatctcctaatgctatccctcccccagcccccaaccccacaacaggccccggtgtgtgatgttccccttccggtgttcaagtgttctcattgttcaattcccacctatgagtgagaacacgcggtgtttggttttttgtccttgtgatagtttgctgagaatgatgatttccagcttcatccatgtccctacaaaggacatgaactcatccttttttatagcagcaaagtattccatggtgtatatgtgccacattttcttaatccagtctatcattggtggacatttgggttggttccaagtcttggcgattgtgagtagtgccgcaataaacatacatgtgcatgtgtttttatagcagcatgatttatattcctttgggtatatacccagtaatgggatggctgggtcaaatggtatttctagttctagatccctgaggaattgccacactgacttccacaatggttgaactagtttacagtcccaccaacagtgtaaaagtgttcccatttctccacatcctttccagtacctgttgtttcctgactttttaatgatcaccattctaattgatgtgagatgatatctcattgtggttttgatttgcatttctctgatggccagtgatgatgagcattttttcatgtgtctgttggctgcataaatgtcttcttttgagaagtgtctgttcatatccttcacccactttttgatggggttgtttgttttttttcttgtaaatttgtttgagttatttgtggattctggatattaaccctttgtcagatgagtagattacaaaaattttctcctattctctaggttgcctgttcactctgatggtagtttcttttgctgtgcagaagctctttacgtagatcccatttgtgaattttggcttttgttgctattgcttttggtgttttagacgtgaagtccttgcccctgcctacgtcctgaatggtattgcctaggttttcctctagagattttatggttttaggtctaagatttaagtctttaatccatcttgaattaatttttgtataagatgtaaggaagggatccagtttcatctttctacttatggctagccagttttcccagcaccatttgttaaataggaaatcctttacccatttcttgattttgtcaggtttgttaaagatcagatagttgtagatgtgtggtattatttctaagggctctgttctgttccattggtctgtatctctgttttggtaccagtaccatgctgttttggttactgtaacctcgtagtatagtttgaagtgaggtagtgtgatgcctccagctttgttcttttggcttaggattgacttggcaatgcaggctctttgttggttccatatgaactttaaagtagttttttccaattctgtgaagaaagtcattggtagcttgatggggatggcattgaatctataaattaccttgggcagtatggccattttcatgatattgattcttcctatccatgaacatggaatgttcttccatttttttgtgtcctcttttatttggttgagcagtggtttgtagttctccttgaagaggtccttcacatcccttgtaagttggaatcctaggtattttattctctttgaagcaattgtgaatgggagttcactcatgatttggttctctgtttgtctgctattggtgtgtaagaatgcttgtgatttttgcacattgattttgtatcctgagactttgctgaagttgcttatcagcttaaggagattttgggctgagatgatggggttttctagatatacaatcatgtcatctgcaaagagggacaatttgacttcctcttttcctaattgaatgccctttctttctttctcctgcctaattgccctggccagaacttccaacactatgttgaataggagtggagagagagggcatccctgtcttgtgccagttttcaaagggaatgcttccagtttttgcccattcagtatgatattggctgcgggtttgtcataaatagctcttattattttgagatacatcccatcaatacctaatttattgagaggttttagcatgaagggctgttgaattttgtcaaaggccttttctgcatctgctgagacaatcatgtggtttttgtcattggttctgtttatatgctggattacgtttattgattttcgtatgttgaaccagccttgcatcccagggatgaagcccacttgatcatggtggataagtttttgatgtgttgctggattcggtttgccagtattttattgaggatttttgcatcaatgttcatcaggggtattggtctaaaattctctttttttgttgtgtcgctgccaggctttggtatcaggatgatgctggcctcataaagtgagttagggaggattccctctttttctactgattggaatagtttcagaaggaatggttccagctccttcttgtacctctggtagaattcatctgtgaatccatctggtcctggactttttttgcttggtaagctactaattattgcctcaatttcagagcctgttattggtctattcagagattcaacttcttcctggtttagtcttgggagggtgtatgtgtccaggaatttatccatttcttctagattttctagtttatttgcgtagaggtgtttatagtattctctgatggtagtttgtatttctatgggatcagtggtgatatcccctctatcattttttcttgcatctatttgattcttctctcttttcttctttattagtcttgctagcagtctgtcaattttgttgatcttttcaaaaaaccagctcctggattcattgatttttggaagggttttttttgtctctgtttccttcagttctgctctgatcttagttattccttgccttctgcaagcttctgaatgtgtttgctcttgtttctctagttcttttcattgtgatgttagggtgtcaattttagatcttttctgctttctcttgtgggcatttagtgctataaatttccctctacacactgctttaaatgtgtcccagagattctggtacattgtgtctttgttctcgttggtttcaaagaatatctttatttctgccttcatttcgttatgtacccagtagtcattcaggagcaggttgttcagtttccatgtagttgagtggttttgagtgagtttcttaatcctgagttctaatttgattgcactgtggtctgagagacagtttgttgtgctttctgttcttttacatttgctgaggaatgctttacttccaactatgtggtcaattttgcaatagctgtggtgtcgtgctgagaagaatgtatattctgttgatttggggtgaagagttctgtagatgtctattaggtctgcttggtgcagagctgagttcaattcctggatatccttgttaattttctgtctcattgatctgtctaatgttgacagtggagtgttaaagtctgccattattattgtgtgggagtctaagtctctttgttggtctctaaggacttgctttatgaatctgggtgctcctgtattaggtgtatatatatttaggatagttagctcttcttgttgaattgatccctttaccattatgtaatggccttctttgtctcttttgatctttgtttgtttaaagtgtgtttcatcagagactaggattgcaacccctgcctttttttggtttccatttgcttagtggatcttcccccatccctttattttgagcctatgtgtgtctctgcatgtgagatgggtttcctgaatacagcacactgatgggtcttgactctttatccaggttgacagtctgtgtcttttaattggagcacttagcccatttccatttaaggttaatattgttatgtgtgaatttgatcctgtcattatgatgttagctggttattttgctcgttacttgaagcagtttcttcctagcatcaatagtctttacaatttagcatgtttttgcagtggctggtgcgctttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttatttaagaatgttgaatattgacccccactctcttctggcttgtagagtttctgctgagagatccattgttagtctgatgggcttcactttttgggtaacccaacctttctctctgtctgcccttaacattttttccttcatttcaactttggcgaatctgacaattatgtgtcttggagttggtcttcttgaggagtatctttgtggcattctctgtatctcctgaatttgaatgttggcctgccttgctaggttggggaagttctcctggataatatcttgcagagtgttttccaacttggttccattctccccgtcactttcaggtacaccaatcagatgtagatttggtcttttcacatagtcccatatttcttggaggctttgcttatttctttttattcttttttctctaaacttctcttctctcttcatttcattcatttgatcttccatcactgataccctttcttccagttgattgaatcggctactgaagcttgtgcattcatcacttagttctcgtgccatggttttcagctccatcaggtcctttaaggacttctctgcattggttattctagttagccattagtcgaatcttttttcaaggtttttaacttctttgcaatgggtttgaacttccttctttagctcagagaagtttgattgtctgaagccttcttctctcaacttgtcaaagtcattctccgtccagctttgttccattgctggtgaggagctgcattcctttggaggaggagaggcgctctgatttttagaattttcagtttttctgttctgttttttccccatctttgtggttttatctacctttggtctttgatgatggtgacgtacacatggggttttggtgtggatgtcctttctgtttgttagttttccttttaacagtcaggaccctcagctgcaggtctgttggagtttcctggaggtccactccagaccctgtttgcctgggtatcagcagtggaagctgcagaacagcgaatattgctgaacagcaaatgttgctgtctgatcatttctctggaggttttgtctcagaggagtacccggccttgtgaggtgtcagtctgcccctactgggggctgcctcccagataggctgctcgggggtcaggaacccacttgaggaggcagtctgcccattgtcagatctcacactccgtgctgggagaactactactctcttcaaagctcagttggaaatgtggaaatcacccatcttctgcgtcactcacactgggagctgtagactggagctgatcctattctaccatcttggatggagtacccacaattttaacctaaatgatttcttccaaaattccatagtttactttttagattgagccatatatggtgtactgcacaagtggattaagatattttaaggtatttttaggagtaattttgactatacttgagctaattaacgctgacgtcgaatctattccctggcaaaagtaaactccattgtattcctgttctttagtccttttggtagaaacccatttgggatattattccaacatatattatctatctatctatgatcttgctttgtacaaatacataaatagatgattcccttgcttttgatattttgggttgagtagaaattttgcccctctcatctgtccataaggttggcctcatctgtgtgcaagtctgaccattatatctgacaatggcttgagtgtctgcttttttagttttgtgctcacctcaaggcctttttagttgaacttggcctctctccatgctttggcctaaatctgagggttgccttattacaatccttcaggagacttagtgtgttattcagaaagttggatacaatgtgtttattttacgatgcatttgggcagaaatatgcctgggaagaattgaaactagattgttccttatttttgtttgtctactttgtgactcagtgcctttactacaaataatcatgacgagatcagcaagatctggttactatctaatatgatacctacagagactctctaatccaaggctttatgaaacatcaaaatgtgaaaaggatgatgaaggcttcactaagtagtgaaaatatttatacattaccacaaagtcaattgacactcaaattaaaacaactatttgccgggcgtggtggctcacattgtaatcccagtacttgggaaggccaaagcgggtggatcacctgagatcaggagtttgagaccagcctggccgatatggcgaaaccccatctgtactaaaaacataaaaaattagccgagtgttgtggcatgcacttgtagtcccagctactcaggtggctgaggcatgagaattacttgaacccaggaggcggaggttgtggtgagctgaaattgcgccactgccctctagcatgggtgccagagtgagactctgtctcaaaaacaattaaaaaaaaaaaaaaaacctgttttttagcaacagttaaaaacagcaaatattttaaaaaattgataaaaatttttttttgctatcaaataggatagaaatttaaaacatattatttaatgtggcaaagatgagcagaaacagttactttcatatactattaagtataacttagaaaaacttttgtgttaccacttgggaatattcatcagatttttaaattcatgtttcttagggccaatatttctacttctaggaagtggaatgatataggtacaggaatgtttattgcaggcatattggaaccattacatgtccaaagtgagggggaggggcgattaaatatagaacagatgcgtatatggcattaaaaattctcaaatatatcattaatcgaaaacaattctgcaaaacaatgcatatagagtgatatgttatataaaaattgatttgtgagtatatatttataaacatttacaattgcataaaaacattagcagagaataagggggattcagggaagggtgataaaggggagaagaacaaacatcaacagaggacctaattgtggcagaccgtgactatattttataacttagcagagctt

SEQ ID NO: 394 - DNA, 8430 bp, Homo sapiens
accagttgtatttcaagaattgaactcctctaactatgttgaatacctggttcactttactttctaatcagaaatttgttcactttgtgtctgtgactatatctgcacagtggttgctagataaatgtaggataactcttaacctttcaccctacagaggttagcaaaactatcacattaggcctgaggaagaagcagcataggagaaatgtaaatatgcgagcactttgaagataaatcagtggctgacacaagaccagtaatatactcaagacccttggatgtctgaaatggcaaagcgaattatgcagtgtgcttgcaagcacacatgcttgtgcatgcatgcacatgcagaaggttaaaatggttttaaatgctatgaggtctctaattcaggttcactgagtggtccagttgtctaaattagttctgtcataccgtcacgttgtgattatcgtctagagcagtcctatctaatagaacaactgtgatgatgcaaacgttctgtattctgtactgtccagaatagtagccaccagccccatatggctatttagcactaggaatatgattagtgaaactgaggagatctgaatttttaaaattaaatttatattatatgtaacagttacatatgattggcggctaccatatatagtgtgaaacaattatttgtgacactaaaggatagaacgatgttggatcgatagaacatattgattttggttcagcttaaggatgtcatttccttttgtttgtttgtttgtttgttttggagacggagtctcgctctgtcacgcaggctggattgcagtagcacaatctcagctcactgcaacctctgcctcctgggttcaggcgattctcctgcctcagcctcctgagtagctgggactacaggcacataccaccacacctggctaattttttgtatttttgtggagacgagatttcactctgttgcccaggctggtctcgaactcgggagctcaggcattctgcccacctcggcatcccaaagtgctgggattacaggcgtgagccaccatgcccagccaggatgccaattctaatatatgtcccattgagcgttagactgtgaggaatgcacatcctcaaatcctcacatcctcaaatgcacatccacatcttcaaaacataaagttttgaagagaaccttagtgacttcttgatgggaatagaaagacagagcccaggaatcaatttgatgggcactcagaataaatgatgtcctgattgagctcattttgaggttatgggatgtttcttgagaagaaaggaagcttaacttgagtgctttctgttaatacctgcatcagcatcttctaagaatagacaaggtctaagtcttaacttttcttgggtagcttctgttttgttactcccagcaaaaaaaggttttggattcaaagcaccaatccatacagttgttggctttaacacaggaagcttatgaggttgtccatgtttgcgggcattttaaaaatcatttatggtagctgagtcagataaaccttatatggaaagttttatctgtgttcgacagtttaaccaatataagtaaagactgctctgtttctaccttgctaccttttccctgctttttcactcttcctctcactccagatcatttgtgctgtcagatggaaattctgactcagccattttctctttcccaataagttacccactttactctgtggtcgctgataatgatgtagatggtctatgatattaaagtagtacttctgatgtgaggacttatatcatctcagcattttcaaaacccgcttgcctgcaatctggtgtatctgcggttagccataacatatctacttgccaaacaagtggtttaggttaccggggttttcatttaactttgaatttaggggattagaaaaaaaaataactcaggaacatactttgataaattacgtgagaatgaaatgttgggattcaatcagttttacttttcagaatgattcttcgcagtgtgtttgttgaagtgtgcatgtgttgttggcacacatttaaaacttatgcttattacccttgtaaaactgttgatgatgctattatataatatagtgctccctattttaagttgccacgtgataactgaatttacttgtacagttgatactaataaaacatttctttgcagtaaagagctggtataatttctccattctgataatgaaaactgaacaacttttcatatttctcttcttacattggtgttcaggaagattgtcgacaaatttgggaccatatgtgggctttacttttgttaattttcaaaggagcattataaaataaatcaataaaattgctactacaactgattttcttccttgtaaatatttcttgcttcactgtttagatgcttatattagaataaaaacatgtatctctctttattatgaaatattttgaaaaggattatcagattcgccttcatggaagatgaattggaaaatatagaagtgtttaaaacggaagataagctacattgtaatctcatagtatgttgttaatgttagaattttgatgtttattctttctggtaccttctaaatttaaatagaaaagtcaagtatttcaaatatagtcagggtatcctatagggaggcataagatcagccctagactctgcctgtaacatggagagtacgtttgggacttaacctgtgcattaacccgtatgatatgctacatggatgattatccatagggtgtataaaaataacagacctcagaatgtcagttgtttctacaaaacacctacatacactctggagaatgtgagtgctttgaggctggaactaggaccagtggataatcactataggttggcagattttgtccttttgaagacagttttacctctggttattggaaaaatgggctgtgttttaaaataaagggagtttccggtggctgaaacatttaaaaggagtccagatgattgcttggacaagataaggctgaatttgacaacgattaaaaccctttttgatagtgtatctataattttaataaagtgatagatcagcatctttttatgaacagtgactgaaatttagaagtatttgaggaaactaggaagcccagtctgccatttaggaccattattattggaaataggattacagattcttgatactcttgacagtttggtgctctaaccaataaggtgactttagcaggtcagatatttgtaagaagtttgcagaggatcctgagttatgctattctggtgtttgtaaaactttttgtgaaaaaggcagctttctatctgtgatgtttattgcaggataattaacccggaaaatgtctttctgttactagaatttctgaaggtttttctcctttcttcttattttttggatatcaaccttgagttgtgtttttccattcaccttatacttaatttattaacattttgtaattcttgggatgatttggcagtttgcaactacaggggagttctaaggatgtggggcagttttctcaaaccagtaattctggagactagctccagattgtgcaaattcctgctagcacctcagcacatactgctttatctgctttaaatgccacataaatcctaagcaccccgttgcattgtttagctgaacaaatacatccgtatgtatacacacatttttcttgattctgagctctaatcttaacagtgccactcatttaactatgcgatcttgggcatattattacaaatctcagccatcatttctttgtaagttgagtgatctgtttaattgtggcccaaagaaaccaagaattgaccacctgcctgtatatatcacttttctaggtattctaggatcctattaggcaacatatcctttcattataataaagctgaaattccaggtgaaggaatttactgttgtttgaggtagtattgatagacatgtagctccatagccttgtttcagataagctggaggatgtggatgaatgaatatgctggatggatgtgggtggaaaaattcaacatttcgtgttatgtcctgtgcactagtcgtcattgttctcaggatccatctttttcacaagcatttatttgaaagtcactatcctgggcactgggataaatgttggagataaaatgatccataatatttttcttgcctttcaggatctagaatatatgctggggaaacatgagtaaaaatttttaatgatataattagtgctacagttctatcctgtaaactacgtgctatgaaagcactgaaagaaaatgatagatgagtctgctgtatgtttgtgagtcagctacataggtgacatttgaatgggggtcttgtaggttgattgtgaattttctagatggtagaggggtggttgggtgctttgggcagatggaacacagagattcccccaccatcatctgtgtaataatggtgactaagcttctttcccatttgcaagcctctcccattctctgtgtttcattctcacaacaaccaagcaaccaaaaacagagaccaaaaccaataaccataagaatctctaaacagatgaaatattggtaaatattgcttggttccttagtcatctgtataaggtgtagagtgaaaatgtttgtctttcacaaagaaattgcaaaaattctgtgtcgactttgtggacagtctagtagtgggattattatactaaggataataactacaagacagtgcatctgatttaattgtattatggatctctgtttagaaggatcatctatctcccagacaggtggaatatcatggcatattggaaagaacagggaatttggagacttaattagaaaagtagccctgccattgattgctttgactagtaacaaaataaatgaagatggaacacctatgtagattatttgcttagcttcagccaaaattagatgccactaccctcccactgtcatactgtgtttagattttgttaatttcaatggcatgaaaattttagaacactaaaaaatggagaaggatcaaaagtttgtgttaccctttgttctgtagtaaatgaattgctcacgtattacttaagtgttcttttgttttcagccttgagcctgaaagtgagaaattttagctatcagtgatcagcaactcagaactaagtttgcttttatggggctcataattggggtatttgagtgagcataagagcgtgtctgctgtctatagccaagcatctctaagctccctacttgccctgctgatgggggtggaggagggggttggttttgctaatgatattggcggtagtgatattgatgtcattttgttgatctctatataaagattgctggggttgagaatgtagaggatttttcattaggataagatctattcagtttctctgaatcccatttctcttttactgtggtaattttattagaacttttaataaagagaagaaactctaacagattagggagacatttcttttgtagggtagcgtaaaagttttacaaaatacgtttattatttcaaagtgtcattaatatatcttagacacatgagtctaaaattgaacaatatcttctcttcccaaatggagggaaacttgtggatgttgaaaagagggttagagagatgagggcaagtggtaggtcccaaagagagatttcccttagaatttttcactgtagtcactacctagggtttcctgtaggtcacttaggaaacactgtgaaagaatcggaaggatggggtggtgggaagagggtgagagatgagaaggtacttaatgaagtacagtgtacattattcaggtggtgattacggtaaaagcccagacttcactactagacagtatatccatataactaagctgcacttgaaacccttaaatttatacaattaagaaactttttattcctgttttttcaggtgtaaatataggccgactgtgattgctagaagtctattcttgggagacagtgaggcaaagtaaactaggtctcatttttatttgcattttgggggacatggaaaccactttctgaatacatgtaccatctttactaaaaattacttttatccttgattttaaagaacttaatgcccatttatcttattttaactagtatttaataataccccccccctccctttttttttcctgatactctaagcagaaatatctggggcaagaagaggtggatttgatttccagttcatttgttttatttgttgggtagtcttattcaagccgttttatttctcttgagccttagtttcctcataagtaaaatggggatgttgataaagcctttatcctcagatggttaggaggaataaatgtgaaagtgcattgtaatttatgaagtgctgtataaatttcagttgtggctgtctgttattaccaaactttcacaagacaaaatgtatctcttgaatatctttcttgttcatagtagatgttttcatgtatacagaacaaaggaaagcaagcataatccctgctttcaaagcagagtatatagtccctctgctactcatagcatttacataaaaagaataattcacaaaattctaccattctataaaagggaaaacagacacaggtgaaagaaatagcctctagttaatgtggtattaatccaggcatttttatgtggatggaagcttttaaagatgaatcatggcaattgtaatttccgaaagtcttaggatgtaggtaaaagaacaacggaaaggaaatggcttttttttcacttcctttttagtttatgtagaattagttgggaaagcactgggaatgtgcacattatttggataatgtgtgaaaggaacgtgtagccgttcatggaatcagaaaattctggctttggttgaaatggggtgatagataggtactcattctgcatacttgactgaggtgaaagaaggagttcttgatagcaggagtgctgttcactgtttagatttggttaatcttgtgcagagcttttaaacttttgagcagagttagtttagcaaaatgtcccccactaagtttttttctcaccggcattgccagtataaatacaagttaagttcctgattcttggccaaaatttgagactgtgttcctttagtggaagagtaaacaaaattcctgctgccctttaggggtatgtgtgtatgtgggggatgtggcaggggttgggagggggcacttctctttgtccctgagaaaaagataaggggattctaaagactcttaccccatcacttgtaaatctgaatcacctctttgaaacagtctttaaaaagaatattttgtttctgagtgagaaggagagaaacttgctgtaaatgagctttttaaaataacaatctgaaatacgttttatgaaaaatgctcagagtttacttatttctttgttggtgaaagctgaggagatcttaatctagtactgttaatgactaagaaaagaattttttaaaggctgttttaggcctccaaatttgatgtcatttgggctggaattttaagagacattcaaatcaatgttgatcagtttccttttaaagtgttgaattattaaaatatacaaattttgtctctatttttctactgattgccaaggggagggcagacaagggtgttacctgtagaaggagaacaagtagttctgcttcaaagttcatagaatgctcctacagttattggtagggaattggggagtgggctgtgtctggagctggaggggtaaagttggcaagtagatgtacctgaaaaaaggtgtgtgaggagaaacaataaggcgaaaacaaaaatgagagacttcggaagcaaatgcaagaagagaaaaaatataagagatagagtttggttggcgtgaggtggagtggggtggtaaatcaccagattttctttggtacatttcaggtaagttgtataccaggaagcctatgtaaaaaaagaaccaattccttatgagggtgcacagggtctttcctatcccatctcttgctgtaattctctttggggcttctgtgctccggacacacacaactccaggatggcctgtgggttttcatctttttgtctttttccataattgacccctttgccaagaatgtttaccgcttctgtgcataggaattttaacttaccttgagatacatttcgtgttaattactttaaggtttcttgatacacggtttcttgatacattctgtttaaatcacccccacttcttacatccacccccagttcataacaagcataactgttccagtgtttatgacttcaaagaattttctttagtacaactaattgtctttagtacagtgtttattaacttacattatacctgttttcctctctgatatttcatctcagtgatggcttggagatgactcattcatcctgaaatagagttcaacacatgtt

SEQ ID NO: 395 - DNA, 6804 bp, Homo sapiens
aaccttgctatgacctcttgtttaaaagcatgatgacacagatgttaaattggttctcactcattgtcagtctatttttctctcaaataaaatctttgactggtgctgtgttacacaggaggaagtaaaaactcttacgggtataataaaagatatgaatagaccttggttgagcttggaaaactgaatgtaagcacagctgcagggagattcttgagaaaaatgttaccatctgtcatcattttcttcaacaggtgcttgtagtttttctttttctaaatctcaaaagcctcgttacttcaaacatttgtttataatatcaatttctacaataagtgttatggtggtttaataatattgatagtataataataaatattttgtgttaaagggaatctttgatcctaaaaaatcacagagctgtacaaacaaattatataaacacaatcttcagagttcaatataagctgatcttaataagttatttcttcagtaatcttagaaatttaagtggaatgtcaaaatagaaggcacttaccttttagaaaccacttcagataaagctgaaactgtctatgtctaataagggatctgttaaatacctactaaaatgccaaaatatgaaccctgtagctagtgttccaatgagaaagaggcccacctgagcaacctgtttgttctttaagtgtcaccttctaaaaatgaacatcctgaattttctcccatgccaactgtctcatttcagttgtcacgtaggataatgtaataccttgctataattatagaatcatgaaagatacagcataaaatcaaaattttgactctttatttggaataatatatttcagtggaaaaaacaatttcagactacaccatctgaataagatactactttgccttcatcctatcccatcaccttaatttttaaaaaatttggatgatggctgggtgcagtggctcgcacctgtaattccagcactttgggaggccaaggcgggcagatcacctgaggttaggagtttgaggcaagcctggccaaaatagtgaaaccccatctctactaaaaatacaaaaattagccggttgtggtggctggcgcctgtaatcccagctactcgggaggctgaggctggagaatcacttgaacccgggaggtggaggttgcagtgagccgagatcatccactgcagtccagcctgggcggcagagcaagattctgtctcaaaaaaaaatgaattatcttaactggttatgtctattttttgcaaggaataaattttgaagttaaaactagttctttcctttatccttccctccctttcttcctctctcccttcctctcttccttcctccctccctctcttccttccttcctccttccttcctccctccctctcttccttccttccttccttccttccttccttccttccttccttccttcctccttccttcctccctccctccctttcattcttccttttttcctccttcttccctctcctttctttccccagcatatactttattgagttactattcttcagaccttatgtagggttgaggatacatgactatactggacagtagacaatggaacttatagtttagttgggggggacagacaatttctaaagaaacttaaacaataaaatatccaacaatttttagataaatacttacagaaaaataaaacagagataacagggggatcagaaggctatttcagggtgagtgatcagaaaagtcaccactgaggcaatgatacttaggctaagaagtaaaccacaattaggaaccatccatgcaatgtgtggagaaagtagtttccaggaagagattagctattgaaaagggcctggacaggaggttgggttatccagtgggatgaagcaaataaaagccagtgggactgaattacagtgcccaaagaggtccctgaggtcagcagagatcagatgaggccctaaacactgtgataacttacatgccattgtagggagctataagcagcaagtggcataatgtgtatctgtatctgtatctctgtatttctgtggcttccatgtgaggaatgaggagaagaaggaataggaatggtagttggaagacactcaggagcctggcagtggtcctgcaggttcaagcttgagtggtagtatcactggagagaggtgggcaggtgttagatttagtttcgaggaagagtcaatagaacttgacgatgggttttatatattgggtgaaggaaggagcagaaagaaggatggcttctaatttttgactggagctaaagctaacaagaagtgccatttgtagagatggggaagcctgggaaggaaacaggttggagtttagtcaggttaagtttaagatgcctacccagaaggaaggccaggaggcagagaacatgtagactgttcttaggtcaaagtaatgtaccaccaggggaggggctcaggacctcagaaacttcacgctcagctttgcttttgaagccctccaccttcttttgagtatataccagtcagaaaacattcttttccctcttttaattattttttcagatttcaaaacttatacataacaactatagagaattcaaaatatactgaaattattattattattattattattattattattattattagagacacagtttcactccattacccaggctgaagttcagtggcacaatcttggctccctgcaatctccatctcctgggttcaagcgattctcatgcctcagcctcccaagtaactgggattacaggtgcctgccaccatgcctggctaatttttgtattattagtagaggcagggtttcaccatgttggccaggctggtctcgaactctggaactcctgacctcaagcgatctgcctgccttggcctcccaaagtgctgggattacaggcgtgagccactgagcccaaccaatatactgaaattaaaaacaggaaaagaggccgggcgaggtggctcacgcctgtaaatcccagccctctgggaggctgaggcgggcggatcacgaggtcaggagatcgagaccatcctggctaacacggttaaaccctatctctactaaaagtacaaaaaattagctgggcgtggtggcgggcgcctgtagtcccagctactcgggaggctgcggcaggagaatggcgtgaacccaggaggcgtagcttgcagtgagccgagatcgcgccactgcactccagcctgggcgacagggcaagactgcgtctcaaaaaaaaaaaaagaaaaggccaggcgcggtggctcacgcctgtaatcccagcgctttgggaggccgaggcgggcggatcacgaggtcaggaaatcaagaccatcctggctaacacggtgaaaccccgtctctactaaaaatacaaaaaattagccgggcttcgtggcgggcgcctgtagtcccagctacttgggaggctgaggcaggagaatggcgtgaacccgggaggcggagcttgcagtgagccgagatcgcgccactgcacttcagcctgggcgacagagcgagactccgtctcaaaaaacaaaacaaaacaaaacaaaacaaaacaaaaaaaaaaaacaaaaaaaaaacgggaaaagagatgaaataatctcataaccattgtgatgataatgattcaatgcatatctatccagagaccaggcaaacttcttgaggcaggtgaaaaagcaatatagacagttttatagttgctaatgtcttcccttccattcatttcttgaataacctgaaagtgtaaatgcaaagtaattttagcatcacacgtaagttggaagacaggctgaaggaaacctaatcccagctcccaccaaaggagaatttgtctcaaaaatgttttaagaaatgatcacacagtatttaatacttccagtgacaatgctcatgatctcacaatcttacaaggcaatctactcaattttaatatctctgcttgtcagaaatgtattccttatagtaagctaaattcttctactctttcattatatttattgggtcttctcttctttcttctggggcttaataagtaggcactaatccacctttcctgagcaagactgtacactacaacgccaaagacaatgatcatgtctttctcattgttctttctccaggcaaaatattgccagctgtttttttttcctcaggtactcagatttcccaaggtttcaaccatccttgtaattctttgatatgctccagtttatccatatgtccattaaaagctatttccagaaggagtcctctggtgtggtcagcctaagatagggtgctatgtcaatattacttcctttgatatgaacagtagaattttaggctaatgttgcatttatctgtttggcagccacattgtattgagctaatacaatatagctaatacgtagagctttttcctatgaattccagttaagtacaattttatactgtgtacatgcacagatcattttttaacagagttgttgaactttacttgtattcccaatgaatttttaacttttagtttccttttattatttaagaatatcgctatcttttaagtcctcattatgtaacctaatgtagccagtctattaataatgagtttggggtggagcacggtagctcacacctgtaatttcaccactttgggaggccgaggcaggtggatcgcttgaggtcaggagtttgagaccagcctggccaacaaggtgaaactccatctctactaaaaatacaaaaattagccgggtatggtggtgcacgcctgtaatcctagctactccggaggctgaggcaggagaatcattttaacctggggaacggaggttgtagtgagccaagatcgcgccactgcactccagtctggcaaaaaagtgaaactccatctaaaaaaaaaaaaaaaaaaaaaaaagagtttgggtataggtttaaaatatttaggattataactaattcaactttattagtgcatcctctacaaggatatagtgagaaaccctgcaaaataccttactattactcagatgcacttatatttaataccctaatctacaggtccagcaaatcaaatgcaaaagaaaatgcagtcttgtataatttgtgtactgaaaccatactggtctctagtcattaatgattacaaggtgttcacaaaccaattacttcaagtttgacttcgaagttttttcaaaaattactataatctctcccacctatatatttagtggagacctttcccctaagttcaaaagctggaatatttgtcttcatgtggtcttctgaccatcgtctcattacactaagcgattgattcattatatcttgtatttattaagtgttttcagtgtgtcacatactctcctaagaattttacatgcctatttcatttaatcctcacaaaagcccatgcattaaatatgatctcccttcttcacagaaagaaactgtcacttaggttaaggagtttgccaagggccacacaatgaataagcagcaagcagtgctgggattcacaccccgtctagaagatttcctgctctttaccgctcagcagatatttattgaatatctgccaagcacatggaatcattcctggtacctctagaagatttggcagcattgacacagtcatcaacttgcaaatgttccttccatactctaataagatactaattatccaccactgctgttactcttcctcctcctcccttctgcaactatagcttgagggcatttcactgcttattagtaaccttggagaatggagaggaaagggaagggaagggatatctatttacataactggaaagacgctggagaatttttcagaataaaaagggggtccattttgttactgttaattctaataaaagactttggagaagaatacttctcttggcttaaatacaagcctagaattacctaggactttcatttactaatgaaatgaaataacattgctttgacgccctgtgaccacacacaactgttaaattttaaactctgtgtgtgcagttattcgtgttgcttagaaatacagcagctggtaccggttgacaaaaggtgtgtaggaatgggagagggctatgaggatgaaagaaaggctcctagttcagaaaattttgaaacacacctctaccctcagttcaacgattgctgtgtcagtccataaattattattattattatttgggggacagagtcttgctctgttgcccaggctggagtgcagtggtgcaatcatagctcactacagcctcaaactcctggcttcaagtgatcctcctgcctcaacctcctgagtagctaggattataagcatgagccactgtgcccagccctcactatataaattagagaaaatacttactcattaagcttatcccagaagggtttccatgccaggaaaaccaagcttattttcctatcttaaaaaataatcttaaatgtgcaagcacatgctagcccttgtttaaaacatcagatggtcactctgaatggctgtgtatggaatcttgctttgtatccccatgtcctatgtctgcaattttccatgcttctgcaggttgaattgcctgattcctatcaaacaacctaaccatataaggtcagtagttactcaacttggcccacattggaatcaatggagaaacttgaaaaatatattaatgcctgtgtccacctcccaaggattgtgctttgactggtgggggatggggttgcctgggcactggaattattaaaacatctccaagtgattctaatgtgcagatgaacttgaaattt

SEQ ID NO: 396 - DNA, 10188 bp, Homo sapiens
aaccttgctatgacctcttgtttaaaagcatgatgacacagatgttaaattggttctcactcattgtcagtctatttttctctcaaataaaatctttgactggtgctgtgttacacaggaggaagtaaaaactcttacgggtataataaaagatatgaatagaccttggttgagcttggaaaactgaatgtaagcacagctgcagggagattcttgagaaaaatgttaccatctgtcatcattttcttcaacaggtgcttgtagtttttctttttctaaatctcaaaagcctcgttacttcaaacatttgtttataatatcaatttctacaataagtgttatggtggtttaataatattgatagtataataataaatattttgtgttaaagggaatctttgatcctaaaaaatcacagagctgtacaaacaaattatataaacacaatcttcagagttcaatataagctgatcttaataagttatttcttcagtaatcttagaaatttaagtggaatgtcaaaatagaaggcacttaccttttagaaaccacttcagataaagctgaaactgtctatgtctaataagggatctgttaaatacctactaaaatgccaaaatatgaaccctgtagctagtgttccaatgagaaagaggcccacctgagcaacctgtttgttctttaagtgtcaccttctaaaaatgaacatcctgaattttctcccatgccaactgtctcatttcagttgtcacgtaggataatgtaataccttgctataattatagaatcatgaaagatacagcataaaatcaaaattttgactctttatttggaataatatatttcagtggaaaaaacaatttcagactacaccatctgaataagatactactttgccttcatcctatcccatcaccttaatttttaaaaaatttggatgatggctgggtgcagtggctcgcacctgtaattccagcactttgggaggccaaggcgggcagatcacctgaggttaggagtttgaggcaagcctggccaaaatagtgaaaccccatctctactaaaaatacaaaaattagccggttgtggtggctggcgcctgtaatcccagctactcgggaggctgaggctggagaatcacttgaacccgggaggtggaggttgcagtgagccgagatcatccactgcagtccagcctgggcggcagagcaagattctgtctcaaaaaaaaatgaattatcttaactggttatgtctattttttgcaaggaataaattttgaagttaaaactagttctttcctttatccttccctccctttcttcctctctcccttcctctcttccttcctccctccctctcttccttccttcctccttccttcctccctccctctcttccttccttccttccttccttccttccttccttccttccttccttcctccttccttcctccctccctccctttcattcttccttttttcctccttcttccctctcctttctttccccagcatatactttattgagttactattcttcagaccttatgtagggttgaggatacatgactatactggacagtagacaatggaacttatagtttagttgggggggacagacaatttctaaagaaacttaaacaataaaatatccaacaatttttagataaatacttacagaaaaataaaacagagataacagggggatcagaaggctatttcagggtgagtgatcagaaaagtcaccactgaggcaatgatacttaggctaagaagtaaaccacaattaggaaccatccatgcaatgtgtggagaaagtagtttccaggaagagattagctattgaaaagggcctggacaggaggttgggttatccagtgggatgaagcaaataaaagccagtgggactgaattacagtgcccaaagaggtccctgaggtcagcagagatcagatgaggccctaaacactgtgataacttacatgccattgtagggagctataagcagcaagtggcataatgtgtatctgtatctgtatctctgtatttctgtggcttccatgtgaggaatgaggagaagaaggaataggaatggtagttggaagacactcaggagcctggcagtggtcctgcaggttcaagcttgagtggtagtatcactggagagaggtgggcaggtgttagatttagtttcgaggaagagtcaatagaacttgacgatgggttttatatattgggtgaaggaaggagcagaaagaaggatggcttctaatttttgactggagctaaagctaacaagaagtgccatttgtagagatggggaagcctgggaaggaaacaggttggagtttagtcaggttaagtttaagatgcctacccagaaggaaggccaggaggcagagaacatgtagactgttcttaggtcaaagtaatgtaccaccaggggaggggctcaggacctcagaaacttcacgctcagctttgcttttgaagccctccaccttcttttgagtatataccagtcagaaaacattcttttccctcttttaattattttttcagatttcaaaacttatacataacaactatagagaattcaaaatatactgaaattattattattattattattattattattattattattagagacacagtttcactccattacccaggctgaagttcagtggcacaatcttggctccctgcaatctccatctcctgggttcaagcgattctcatgcctcagcctcccaagtaactgggattacaggtgcctgccaccatgcctggctaatttttgtattattagtagaggcagggtttcaccatgttggccaggctggtctcgaactctggaactcctgacctcaagcgatctgcctgccttggcctcccaaagtgctgggattacaggcgtgagccactgagcccaaccaatatactgaaattaaaaacaggaaaagaggccgggcgaggtggctcacgcctgtaaatcccagccctctgggaggctgaggcgggcggatcacgaggtcaggagatcgagaccatcctggctaacacggttaaaccctatctctactaaaagtacaaaaaattagctgggcgtggtggcgggcgcctgtagtcccagctactcgggaggctgcggcaggagaatggcgtgaacccaggaggcgtagcttgcagtgagccgagatcgcgccactgcactccagcctgggcgacagggcaagactgcgtctcaaaaaaaaaaaaagaaaaggccaggcgcggtggctcacgcctgtaatcccagcgctttgggaggccgaggcgggcggatcacgaggtcaggaaatcaagaccatcctggctaacacggtgaaaccccgtctctactaaaaatacaaaaaattagccgggcttcgtggcgggcgcctgtagtcccagctacttgggaggctgaggcaggagaatggcgtgaacccgggaggcggagcttgcagtgagccgagatcgcgccactgcacttcagcctgggcgacagagcgagactccgtctcaaaaaacaaaacaaaacaaaacaaaacaaaacaaaaaaaaaaaacaaaaaaaaaacgggaaaagagatgaaataatctcataaccattgtgatgataatgattcaatgcatatctatccagagaccaggcaaacttcttgaggcaggtgaaaaagcaatatagacagttttatagttgctaatgtcttcccttccattcatttcttgaataacctgaaagtgtaaatgcaaagtaattttagcatcacacgtaagttggaagacaggctgaaggaaacctaatcccagctcccaccaaaggagaatttgtctcaaaaatgttttaagaaatgatcacacagtatttaatacttccagtgacaatgctcatgatctcacaatcttacaaggcaatctactcaattttaatatctctgcttgtcagaaatgtattccttatagtaagctaaattcttctactctttcattatatttattgggtcttctcttctttcttctggggcttaataagtaggcactaatccacctttcctgagcaagactgtacactacaacgccaaagacaatgatcatgtctttctcattgttctttctccaggcaaaatattgccagctgtttttttttcctcaggtactcagatttcccaaggtttcaaccatccttgtaattctttgatatgctccagtttatccatatgtccattaaaagctatttccagaaggagtcctctggtgtggtcagcctaagatagggtgctatgtcaatattacttcctttgatatgaacagtagaattttaggctaatgttgcatttatctgtttggcagccacattgtattgagctaatacaatatagctaatacgtagagctttttcctatgaattccagttaagtacaattttatactgtgtacatgcacagatcattttttaacagagttgttgaactttacttgtattcccaatgaatttttaacttttagtttccttttattatttaagaatatcgctatcttttaagtcctcattatgtaacctaatgtagccagtctattaataatgagtttggggtggagcacggtagctcacacctgtaatttcaccactttgggaggccgaggcaggtggatcgcttgaggtcaggagtttgagaccagcctggccaacaaggtgaaactccatctctactaaaaatacaaaaattagccgggtatggtggtgcacgcctgtaatcctagctactccggaggctgaggcaggagaatcattttaacctggggaacggaggttgtagtgagccaagatcgcgccactgcactccagtctggcaaaaaagtgaaactccatctaaaaaaaaaaaaaaaaaaaaaaaagagtttgggtataggtttaaaatatttaggattataactaattcaactttattagtgcatcctctacaaggatatagtgagaaaccctgcaaaataccttactattactcagatgcacttatatttaataccctaatctacaggtccagcaaatcaaatgcaaaagaaaatgcagtcttgtataatttgtgtactgaaaccatactggtctctagtcattaatgattacaaggtgttcacaaaccaattacttcaagtttgacttcgaagttttttcaaaaattactataatctctcccacctatatatttagtggagacctttcccctaagttcaaaagctggaatatttgtcttcatgtggtcttctgaccatcgtctcattacactaagcgattgattcattatatcttgtatttattaagtgttttcagtgtgtcacatactctcctaagaattttacatgcctatttcatttaatcctcacaaaagcccatgcattaaatatgatctcccttcttcacagaaagaaactgtcacttaggttaaggagtttgccaagggccacacaatgaataagcagcaagcagtgctgggattcacaccccgtctagaagatttcctgctctttaccgctcagcagatatttattgaatatctgccaagcacatggaatcattcctggtacctctagaagatttggcagcattgacacagtcatcaacttgcaaatgttccttccatactctaataagatactaattatccaccactgctgttactcttcctcctcctcccttctgcaactatagcttgagggcatttcactgcttattagtaaccttggagaatggagaggaaagggaagggaagggatatctatttacataactggaaagacgctggagaatttttcagaataaaaagggggtccattttgttactgttaattctaataaaagactttggagaagaatacttctcttggcttaaatacaagcctagaattacctaggactttcatttactaatgaaatgaaataacattgctttgacgccctgtgaccacacacaactgttaaattttaaactctgtgtgtgcagttattcgtgttgcttagaaatacagcagctggtaccggttgacaaaaggtgtgtaggaatgggagagggctatgaggatgaaagaaaggctcctagttcagaaaattttgaaacacacctctaccctcagttcaacgattgctgtgtcagtccataaattattattattattatttgggggacagagtcttgctctgttgcccaggctggagtgcagtggtgcaatcatagctcactacagcctcaaactcctggcttcaagtgatcctcctgcctcaacctcctgagtagctaggattataagcatgagccactgtgcccagccctcactatataaattagagaaaatacttactcattaagcttatcccagaagggtttccatgccaggaaaaccaagcttattttcctatcttaaaaaataatcttaaatgtgcaagcacatgctagcccttgtttaaaacatcagatggtcactctgaatggctgtgtatggaatcttgctttgtatccccatgtcctatgtctgcaattttccatgcttctgcaggttgaattgcctgattcctatcaaacaacctaaccatataaggtcagtagttactcaacttggcccacattggaatcaatggagaaacttgaaaaatatattaatgcctgtgtccacctcccaaggattgtgctttgactggtgggggatggggttgcctgggcactggaattattaaaacatctccaagtgattctaatgtgcagatgaacttgaaattttgacataggaataaaaagtatctttcccagttctcacttctctattaacttggcctgctcatgactggactgcaatctgccatagcatgaactcatcttggccctatccaaaaggatctgggtctgccaagtaccaggaggcctagtgtctacctggttacatctgtcatgagtttccttttataagtgaggtttcaatgtataaacttcatagaaaaaaaaggcagacatttagtttttcctaagaaacttgagatttcaaagttttagtttaaaaattgcatgaaagatggaaatcttcctcaggcatacatttttgttgatctgtcttctcaaaggcctttagctctctaatattattgaagatgagaaagaatacagaatataagagaaatacatcaacgcctagtattaagaaagaaacttctataaaatcaccaagtctctagatcaaagcttgaaagactctagctgagcttactaaacatctgtgtaacaatgccacagaaatagaaaagagagctcatgcggttcagacacatttgaaaaaaacattaattatattttccccaggtaggtagtttcctgtattcaaggtctactgagttctttgatgcctatgccagatcatcttcttcatagtacataatgctttgaattgtacacactatggttaacgtcgaaagacaaccttcaaaacttgggacacttgttttctttcatgttttgagtatcagcatcctgatctcaaatagccacacagacacactgcttatcacatcactccgttttaattatctgcacagcacttagcacttagtactttctgatgtttctcttgcttatttatttgtttaatgctacccccaccaccacaatacgggctccgtgataccaatggttttatctcattcaatgttgtgtccccagcatctcgaagtgttcaataaacattcagtgaatattcagtaaatgaacattccaacattctgagtactttcctgaaacagtcatatgacagccacagacaatttccatgctttgtgacatgaaggcccacatttatacacctacaaaatgagagtaataagatattgacctcacaggactatcacgagaattgcatgagaacacactgtaaggacttatcacaaggtatggcatatgatgaatgaaaaatcataaaaatcatattatggaaatgtgtcagtgtgccatttatagtggaataaaagcagtaagagaaatgccatgatttcattttatcaatttgtttaaaatgtatctgattatacatgttctttcactatttaggaggaaaattaacatatgtttttatgtaagctacagtttgctttcaggagaagaagagtaccaaactgggactcagaggaataaatccaggctgctgatctgtatggcccaatacgccatttaatagttacctaaggtttagttttctcacctgaaacattgaggggagaggcaaggaagagtaggaggtttgaggggaatcaaccgaaatatgagctcttaagaggcagcgagtaaatatgcaaaaatcaatatttagctcataaaagaaagaatggcgtcaagattttctcacaatgtttggctaaattagatgaataagatagaccttcataataaattaaatctgatctatacattatttgtatgatactcagatatacaatccctagcttacagttaataaaaattatccatttgaaattatttttgcagacatttttgcgtatatgctatatggtgtccttatgaacagctttttttttctactgaaatttaacaagttaaaaagaaatagatttagaagaagcttcctggagaaatgtttttcctgtttaaaagttctttaccagttttttttaagttacaataaaaagcattgtgagtcatccatacgcagtttttttgtattacgtatggatcaaatacttccagaaacatgacaatgtgtaatgaattcatccccttcaccagtaactttattttaatatggctctattacaaatgaaaaatcaataaaccaccattcagtttctttgaagtagactcttgcctctccttccaacactctagaaatatgccattggttgcctaaagccttgaacttcgtttgtcaattcaggtgcattgtttccttggctgttaggtctgcctgtttcctcaggctaattatgaaatcatctgctccgccaggaagaagcacacagctgaagagcatcatcctgtgttccagcattactgtggagcatgtgtccttattactaatgcacaaagcacgacacttggagaagtctcttcgttgcctggaaattggggggcataatctgaagacttataaatatctcttaacaaagcaccagctgagctgtgtcagggttgcacactctcttcatctctcccttacagcctttcaatttgctttccaaacatttctttgtcgccgttggctggggtgtgcttaaaagaagcacatcgttaaccacaaagaatgctcactgttttctgtgatttcaaatcagttccaagcacttcctcagcaagtggcccggcagcaattaccctgctgctgaagacacttcgcatcacaggcctcagtttttgagacaagcaagcaaggctgtaagaaatgataacatatgtttcagcctccattcaccagcgatttatacccccataagaagggtgaatcaattttcatgcaaattcaacaggcatattcaacaacgttgctctcttctctaattcacacaaactcagcattcatcggctgcattacttgcctcaaatgggcactcacagttgctaaatgattcgggcgggggtggagttgctctgtgtcaaaaaggggcaaagaacaaggaaaggacatgaatccatcagggcaatgagagctgaactgattcactgagacaaaatagtgaggttttgaaaagccagtgcaaaaggagatggcttcccacctcaccctgacacttctgtgaaagatggtgtagaaactgacctcggcagcattcaagggaaatgtttccacaagcatgagctgctccagaacaatttatccaatagattatgttgagataggcttcactttacaaccacatttctctcttttctttcccatcttgatcatacctgttaatatcctctttgcggaaatatctccagaaggagtcaaaaaggttaaaatgggcagcgcaaatttccatatgccaggtccctggatatagttttaaagggcctgtggccttaagtaaaatctgatttcttaactccacaggtctgcaggtaaatgtcacactgccctctggaggtagtctcattggatctaaccctgaattaatgattgccagc

SEQ ID NO: 397 - DNA, 4307 bp, Homo sapiens
gccctccaccttcttttgagtatataccagtcagaaaacattcttttccctcttttaattattttttcagatttcaaaacttatacataacaactatagagaattcaaaatatactgaaattattattattattattattattattattattattattagagacacagtttcactccattacccaggctgaagttcagtggcacaatcttggctccctgcaatctccatctcctgggttcaagcgattctcatgcctcagcctcccaagtaactgggattacaggtgcctgccaccatgcctggctaatttttgtattattagtagaggcagggtttcaccatgttggccaggctggtctcgaactctggaactcctgacctcaagcgatctgcctgccttggcctcccaaagtgctgggattacaggcgtgagccactgagcccaaccaatatactgaaattaaaaacaggaaaagaggccgggcgaggtggctcacgcctgtaaatcccagccctctgggaggctgaggcgggcggatcacgaggtcaggagatcgagaccatcctggctaacacggttaaaccctatctctactaaaagtacaaaaaattagctgggcgtggtggcgggcgcctgtagtcccagctactcgggaggctgcggcaggagaatggcgtgaacccaggaggcgtagcttgcagtgagccgagatcgcgccactgcactccagcctgggcgacagggcaagactgcgtctcaaaaaaaaaaaaagaaaaggccaggcgcggtggctcacgcctgtaatcccagcgctttgggaggccgaggcgggcggatcacgaggtcaggaaatcaagaccatcctggctaacacggtgaaaccccgtctctactaaaaatacaaaaaattagccgggcttcgtggcgggcgcctgtagtcccagctacttgggaggctgaggcaggagaatggcgtgaacccgggaggcggagcttgcagtgagccgagatcgcgccactgcacttcagcctgggcgacagagcgagactccgtctcaaaaaacaaaacaaaacaaaacaaaacaaaacaaaaaaaaaaaacaaaaaaaaaacgggaaaagagatgaaataatctcataaccattgtgatgataatgattcaatgcatatctatccagagaccaggcaaacttcttgaggcaggtgaaaaagcaatatagacagttttatagttgctaatgtcttcccttccattcatttcttgaataacctgaaagtgtaaatgcaaagtaattttagcatcacacgtaagttggaagacaggctgaaggaaacctaatcccagctcccaccaaaggagaatttgtctcaaaaatgttttaagaaatgatcacacagtatttaatacttccagtgacaatgctcatgatctcacaatcttacaaggcaatctactcaattttaatatctctgcttgtcagaaatgtattccttatagtaagctaaattcttctactctttcattatatttattgggtcttctcttctttcttctggggcttaataagtaggcactaatccacctttcctgagcaagactgtacactacaacgccaaagacaatgatcatgtctttctcattgttctttctccaggcaaaatattgccagctgtttttttttcctcaggtactcagatttcccaaggtttcaaccatccttgtaattctttgatatgctccagtttatccatatgtccattaaaagctatttccagaaggagtcctctggtgtggtcagcctaagatagggtgctatgtcaatattacttcctttgatatgaacagtagaattttaggctaatgttgcatttatctgtttggcagccacattgtattgagctaatacaatatagctaatacgtagagctttttcctatgaattccagttaagtacaattttatactgtgtacatgcacagatcattttttaacagagttgttgaactttacttgtattcccaatgaatttttaacttttagtttccttttattatttaagaatatcgctatcttttaagtcctcattatgtaacctaatgtagccagtctattaataatgagtttggggtggagcacggtagctcacacctgtaatttcaccactttgggaggccgaggcaggtggatcgcttgaggtcaggagtttgagaccagcctggccaacaaggtgaaactccatctctactaaaaatacaaaaattagccgggtatggtggtgcacgcctgtaatcctagctactccggaggctgaggcaggagaatcattttaacctggggaacggaggttgtagtgagccaagatcgcgccactgcactccagtctggcaaaaaagtgaaactccatctaaaaaaaaaaaaaaaaaaaaaaaagagtttgggtataggtttaaaatatttaggattataactaattcaactttattagtgcatcctctacaaggatatagtgagaaaccctgcaaaataccttactattactcagatgcacttatatttaataccctaatctacaggtccagcaaatcaaatgcaaaagaaaatgcagtcttgtataatttgtgtactgaaaccatactggtctctagtcattaatgattacaaggtgttcacaaaccaattacttcaagtttgacttcgaagttttttcaaaaattactataatctctcccacctatatatttagtggagacctttcccctaagttcaaaagctggaatatttgtcttcatgtggtcttctgaccatcgtctcattacactaagcgattgattcattatatcttgtatttattaagtgttttcagtgtgtcacatactctcctaagaattttacatgcctatttcatttaatcctcacaaaagcccatgcattaaatatgatctcccttcttcacagaaagaaactgtcacttaggttaaggagtttgccaagggccacacaatgaataagcagcaagcagtgctgggattcacaccccgtctagaagatttcctgctctttaccgctcagcagatatttattgaatatctgccaagcacatggaatcattcctggtacctctagaagatttggcagcattgacacagtcatcaacttgcaaatgttccttccatactctaataagatactaattatccaccactgctgttactcttcctcctcctcccttctgcaactatagcttgagggcatttcactgcttattagtaaccttggagaatggagaggaaagggaagggaagggatatctatttacataactggaaagacgctggagaatttttcagaataaaaagggggtccattttgttactgttaattctaataaaagactttggagaagaatacttctcttggcttaaatacaagcctagaattacctaggactttcatttactaatgaaatgaaataacattgctttgacgccctgtgaccacacacaactgttaaattttaaactctgtgtgtgcagttattcgtgttgcttagaaatacagcagctggtaccggttgacaaaaggtgtgtaggaatgggagagggctatgaggatgaaagaaaggctcctagttcagaaaattttgaaacacacctctaccctcagttcaacgattgctgtgtcagtccataaattattattattattatttgggggacagagtcttgctctgttgcccaggctggagtgcagtggtgcaatcatagctcactacagcctcaaactcctggcttcaagtgatcctcctgcctcaacctcctgagtagctaggattataagcatgagccactgtgcccagccctcactatataaattagagaaaatacttactcattaagcttatcccagaagggtttccatgccaggaaaaccaagcttattttcctatcttaaaaaataatcttaaatgtgcaagcacatgctagcccttgtttaaaacatcagatggtcactctgaatggctgtgtatggaatcttgctttgtatccccatgtcctatgtctgcaattttccatgcttctgcaggttgaattgcctgattcctatcaaacaacctaaccatataaggtcagtagttactcaacttggcccacattggaatcaatggagaaacttgaaaaatatattaatgcctgtgtccacctcccaaggattgtgctttgactggtgggggatggggttgcctgggcactggaattattaaaacatctccaagtgattctaatgtgcagatgaacttgaaattt

SEQ ID NO: 398 - DNA, 7691 bp, Homo sapiens
gccctccaccttcttttgagtatataccagtcagaaaacattcttttccctcttttaattattttttcagatttcaaaacttatacataacaactatagagaattcaaaatatactgaaattattattattattattattattattattattattattagagacacagtttcactccattacccaggctgaagttcagtggcacaatcttggctccctgcaatctccatctcctgggttcaagcgattctcatgcctcagcctcccaagtaactgggattacaggtgcctgccaccatgcctggctaatttttgtattattagtagaggcagggtttcaccatgttggccaggctggtctcgaactctggaactcctgacctcaagcgatctgcctgccttggcctcccaaagtgctgggattacaggcgtgagccactgagcccaaccaatatactgaaattaaaaacaggaaaagaggccgggcgaggtggctcacgcctgtaaatcccagccctctgggaggctgaggcgggcggatcacgaggtcaggagatcgagaccatcctggctaacacggttaaaccctatctctactaaaagtacaaaaaattagctgggcgtggtggcgggcgcctgtagtcccagctactcgggaggctgcggcaggagaatggcgtgaacccaggaggcgtagcttgcagtgagccgagatcgcgccactgcactccagcctgggcgacagggcaagactgcgtctcaaaaaaaaaaaaagaaaaggccaggcgcggtggctcacgcctgtaatcccagcgctttgggaggccgaggcgggcggatcacgaggtcaggaaatcaagaccatcctggctaacacggtgaaaccccgtctctactaaaaatacaaaaaattagccgggcttcgtggcgggcgcctgtagtcccagctacttgggaggctgaggcaggagaatggcgtgaacccgggaggcggagcttgcagtgagccgagatcgcgccactgcacttcagcctgggcgacagagcgagactccgtctcaaaaaacaaaacaaaacaaaacaaaacaaaacaaaaaaaaaaaacaaaaaaaaaacgggaaaagagatgaaataatctcataaccattgtgatgataatgattcaatgcatatctatccagagaccaggcaaacttcttgaggcaggtgaaaaagcaatatagacagttttatagttgctaatgtcttcccttccattcatttcttgaataacctgaaagtgtaaatgcaaagtaattttagcatcacacgtaagttggaagacaggctgaaggaaacctaatcccagctcccaccaaaggagaatttgtctcaaaaatgttttaagaaatgatcacacagtatttaatacttccagtgacaatgctcatgatctcacaatcttacaaggcaatctactcaattttaatatctctgcttgtcagaaatgtattccttatagtaagctaaattcttctactctttcattatatttattgggtcttctcttctttcttctggggcttaataagtaggcactaatccacctttcctgagcaagactgtacactacaacgccaaagacaatgatcatgtctttctcattgttctttctccaggcaaaatattgccagctgtttttttttcctcaggtactcagatttcccaaggtttcaaccatccttgtaattctttgatatgctccagtttatccatatgtccattaaaagctatttccagaaggagtcctctggtgtggtcagcctaagatagggtgctatgtcaatattacttcctttgatatgaacagtagaattttaggctaatgttgcatttatctgtttggcagccacattgtattgagctaatacaatatagctaatacgtagagctttttcctatgaattccagttaagtacaattttatactgtgtacatgcacagatcattttttaacagagttgttgaactttacttgtattcccaatgaatttttaacttttagtttccttttattatttaagaatatcgctatcttttaagtcctcattatgtaacctaatgtagccagtctattaataatgagtttggggtggagcacggtagctcacacctgtaatttcaccactttgggaggccgaggcaggtggatcgcttgaggtcaggagtttgagaccagcctggccaacaaggtgaaactccatctctactaaaaatacaaaaattagccgggtatggtggtgcacgcctgtaatcctagctactccggaggctgaggcaggagaatcattttaacctggggaacggaggttgtagtgagccaagatcgcgccactgcactccagtctggcaaaaaagtgaaactccatctaaaaaaaaaaaaaaaaaaaaaaaagagtttgggtataggtttaaaatatttaggattataactaattcaactttattagtgcatcctctacaaggatatagtgagaaaccctgcaaaataccttactattactcagatgcacttatatttaataccctaatctacaggtccagcaaatcaaatgcaaaagaaaatgcagtcttgtataatttgtgtactgaaaccatactggtctctagtcattaatgattacaaggtgttcacaaaccaattacttcaagtttgacttcgaagttttttcaaaaattactataatctctcccacctatatatttagtggagacctttcccctaagttcaaaagctggaatatttgtcttcatgtggtcttctgaccatcgtctcattacactaagcgattgattcattatatcttgtatttattaagtgttttcagtgtgtcacatactctcctaagaattttacatgcctatttcatttaatcctcacaaaagcccatgcattaaatatgatctcccttcttcacagaaagaaactgtcacttaggttaaggagtttgccaagggccacacaatgaataagcagcaagcagtgctgggattcacaccccgtctagaagatttcctgctctttaccgctcagcagatatttattgaatatctgccaagcacatggaatcattcctggtacctctagaagatttggcagcattgacacagtcatcaacttgcaaatgttccttccatactctaataagatactaattatccaccactgctgttactcttcctcctcctcccttctgcaactatagcttgagggcatttcactgcttattagtaaccttggagaatggagaggaaagggaagggaagggatatctatttacataactggaaagacgctggagaatttttcagaataaaaagggggtccattttgttactgttaattctaataaaagactttggagaagaatacttctcttggcttaaatacaagcctagaattacctaggactttcatttactaatgaaatgaaataacattgctttgacgccctgtgaccacacacaactgttaaattttaaactctgtgtgtgcagttattcgtgttgcttagaaatacagcagctggtaccggttgacaaaaggtgtgtaggaatgggagagggctatgaggatgaaagaaaggctcctagttcagaaaattttgaaacacacctctaccctcagttcaacgattgctgtgtcagtccataaattattattattattatttgggggacagagtcttgctctgttgcccaggctggagtgcagtggtgcaatcatagctcactacagcctcaaactcctggcttcaagtgatcctcctgcctcaacctcctgagtagctaggattataagcatgagccactgtgcccagccctcactatataaattagagaaaatacttactcattaagcttatcccagaagggtttccatgccaggaaaaccaagcttattttcctatcttaaaaaataatcttaaatgtgcaagcacatgctagcccttgtttaaaacatcagatggtcactctgaatggctgtgtatggaatcttgctttgtatccccatgtcctatgtctgcaattttccatgcttctgcaggttgaattgcctgattcctatcaaacaacctaaccatataaggtcagtagttactcaacttggcccacattggaatcaatggagaaacttgaaaaatatattaatgcctgtgtccacctcccaaggattgtgctttgactggtgggggatggggttgcctgggcactggaattattaaaacatctccaagtgattctaatgtgcagatgaacttgaaattttgacataggaataaaaagtatctttcccagttctcacttctctattaacttggcctgctcatgactggactgcaatctgccatagcatgaactcatcttggccctatccaaaaggatctgggtctgccaagtaccaggaggcctagtgtctacctggttacatctgtcatgagtttccttttataagtgaggtttcaatgtataaacttcatagaaaaaaaaggcagacatttagtttttcctaagaaacttgagatttcaaagttttagtttaaaaattgcatgaaagatggaaatcttcctcaggcatacatttttgttgatctgtcttctcaaaggcctttagctctctaatattattgaagatgagaaagaatacagaatataagagaaatacatcaacgcctagtattaagaaagaaacttctataaaatcaccaagtctctagatcaaagcttgaaagactctagctgagcttactaaacatctgtgtaacaatgccacagaaatagaaaagagagctcatgcggttcagacacatttgaaaaaaacattaattatattttccccaggtaggtagtttcctgtattcaaggtctactgagttctttgatgcctatgccagatcatcttcttcatagtacataatgctttgaattgtacacactatggttaacgtcgaaagacaaccttcaaaacttgggacacttgttttctttcatgttttgagtatcagcatcctgatctcaaatagccacacagacacactgcttatcacatcactccgttttaattatctgcacagcacttagcacttagtactttctgatgtttctcttgcttatttatttgtttaatgctacccccaccaccacaatacgggctccgtgataccaatggttttatctcattcaatgttgtgtccccagcatctcgaagtgttcaataaacattcagtgaatattcagtaaatgaacattccaacattctgagtactttcctgaaacagtcatatgacagccacagacaatttccatgctttgtgacatgaaggcccacatttatacacctacaaaatgagagtaataagatattgacctcacaggactatcacgagaattgcatgagaacacactgtaaggacttatcacaaggtatggcatatgatgaatgaaaaatcataaaaatcatattatggaaatgtgtcagtgtgccatttatagtggaataaaagcagtaagagaaatgccatgatttcattttatcaatttgtttaaaatgtatctgattatacatgttctttcactatttaggaggaaaattaacatatgtttttatgtaagctacagtttgctttcaggagaagaagagtaccaaactgggactcagaggaataaatccaggctgctgatctgtatggcccaatacgccatttaatagttacctaaggtttagttttctcacctgaaacattgaggggagaggcaaggaagagtaggaggtttgaggggaatcaaccgaaatatgagctcttaagaggcagcgagtaaatatgcaaaaatcaatatttagctcataaaagaaagaatggcgtcaagattttctcacaatgtttggctaaattagatgaataagatagaccttcataataaattaaatctgatctatacattatttgtatgatactcagatatacaatccctagcttacagttaataaaaattatccatttgaaattatttttgcagacatttttgcgtatatgctatatggtgtccttatgaacagctttttttttctactgaaatttaacaagttaaaaagaaatagatttagaagaagcttcctggagaaatgtttttcctgtttaaaagttctttaccagttttttttaagttacaataaaaagcattgtgagtcatccatacgcagtttttttgtattacgtatggatcaaatacttccagaaacatgacaatgtgtaatgaattcatccccttcaccagtaactttattttaatatggctctattacaaatgaaaaatcaataaaccaccattcagtttctttgaagtagactcttgcctctccttccaacactctagaaatatgccattggttgcctaaagccttgaacttcgtttgtcaattcaggtgcattgtttccttggctgttaggtctgcctgtttcctcaggctaattatgaaatcatctgctccgccaggaagaagcacacagctgaagagcatcatcctgtgttccagcattactgtggagcatgtgtccttattactaatgcacaaagcacgacacttggagaagtctcttcgttgcctggaaattggggggcataatctgaagacttataaatatctcttaacaaagcaccagctgagctgtgtcagggttgcacactctcttcatctctcccttacagcctttcaatttgctttccaaacatttctttgtcgccgttggctggggtgtgcttaaaagaagcacatcgttaaccacaaagaatgctcactgttttctgtgatttcaaatcagttccaagcacttcctcagcaagtggcccggcagcaattaccctgctgctgaagacacttcgcatcacaggcctcagtttttgagacaagcaagcaaggctgtaagaaatgataacatatgtttcagcctccattcaccagcgatttatacccccataagaagggtgaatcaattttcatgcaaattcaacaggcatattcaacaacgttgctctcttctctaattcacacaaactcagcattcatcggctgcattacttgcctcaaatgggcactcacagttgctaaatgattcgggcgggggtggagttgctctgtgtcaaaaaggggcaaagaacaaggaaaggacatgaatccatcagggcaatgagagctgaactgattcactgagacaaaatagtgaggttttgaaaagccagtgcaaaaggagatggcttcccacctcaccctgacacttctgtgaaagatggtgtagaaactgacctcggcagcattcaagggaaatgtttccacaagcatgagctgctccagaacaatttatccaatagattatgttgagataggcttcactttacaaccacatttctctcttttctttcccatcttgatcatacctgttaatatcctctttgcggaaatatctccagaaggagtcaaaaaggttaaaatgggcagcgcaaatttccatatgccaggtccctggatatagttttaaagggcctgtggccttaagtaaaatctgatttcttaactccacaggtctgcaggtaaatgtcacactgccctctggaggtagtctcattggatctaaccctgaattaatgattgccagc

SEQ ID NO: 399 - DNA, 1682 bp, Homo sapiens
aagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgcttaaacagactaattgaaatggttgaatgggtaagaaaatgctcccttgaatccacatccttaaatgaggccaggcagacttggaggggtctgtgagcccctgagctcctgtcttacagtctcaggctattggagggggctgcacatcccacatttgggtagatgcccaaattctccttttagtatatactctcccttttcttgggtgttcttggaactctggtagaagacagggagaatgatagattttccttgccctccacagacacaggcaaactagtttctgttaggcattcactctgtgtaacattcatcccaattgcaatggtgatacagctaccgtcaacagactgatcaccttgcctgtgccatgtgccctgtgcacatttactctagtcttcacagtaacctccagagaggtgttatcccattttatagattacagccgaaaaaggttaaggaccttgtcactgaactgcccagtagaagttcaagcatatgctcatggaatttgattttacggaagtatgtaccctttagggatctacagttaggtgccctctagggtgtctagaattgctgaggagcccatcgttccttaagcacctgtgctgcgttgtattgtaatcacctgagggtgctttaaagactatgaataatactcagactttcttctccaaccatttacatcagagcatctgggggtggaacccaggcatcagtattttgcaaagttcccaaacgatgtcagtgtttagccaaatatgagacccactggtttagagctgtaaacagtgcagttgctactgttttatggtagatgttacagaaatatgtcgttgaattgcctataaaatgaattaaagattggagcatttcttttt

SEQ ID NO: 400 - DNA, 3933 bp, Homo sapiens
aagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgcttaaacagactaattgaaatggttgaatgggtaagaaaatgctcccttgaatccacatccttaaatgaggccaggcagacttggaggggtctgtgagcccctgagctcctgtcttacagtctcaggctattggagggggctgcacatcccacatttgggtagatgcccaaattctccttttagtatatactctcccttttcttgggtgttcttggaactctggtagaagacagggagaatgatagattttccttgccctccacagacacaggcaaactagtttctgttaggcattcactctgtgtaacattcatcccaattgcaatggtgatacagctaccgtcaacagactgatcaccttgcctgtgccatgtgccctgtgcacatttactctagtcttcacagtaacctccagagaggtgttatcccattttatagattacagccgaaaaaggttaaggaccttgtcactgaactgcccagtagaagttcaagcatatgctcatggaatttgattttacggaagtatgtaccctttagggatctacagttaggtgccctctagggtgtctagaattgctgaggagcccatcgttccttaagcacctgtgctgcgttgtattgtaatcacctgagggtgctttaaagactatgaataatactcagactttcttctccaaccatttacatcagagcatctgggggtggaacccaggcatcagtattttgcaaagttcccaaacgatgtcagtgtttagccaaatatgagacccactggtttagagctgtaaacagtgcagttgctactgttttatggtagatgttacagaaatatgtcgttgaattgcctataaaatgaattaaagattggagcatttctttttcccctattcataaaccattgtgatcgcagtcttctatagaaattacctattttgcctgatgagatttacttagaaagggaaataaacacatagctatatctctcctgaagtcttcttgcagttactaattaaggcagtacacacattctcagttgagctagaactttagctattgtctctttgctctactgaaggtaacccgagtgttacggctttttaaatgagctggaacaataaatacaaatttcgttggcaagacaaatactttttctcatatgccaacgattatgtaatcaaagtataaagtatccatataaagccttgcttttgaaaataatttcaatttaaaaattaaaaatagtaattaacattggtaacagtatattgatgaccactgtttagctgatacagtgaatacaggtgttcatataaaacatcatttaaaatcgtctatccatatggaacacattacgttttcttccaatttacattgacttcctgttggtttctgaatacaactcaaggtgttaatttcgttttcaaagccagatgttatttggcaggataaaacttaaatttcccctaatagatatttttaggcacttaggatgctagggaacttagtaagtgctttttaaaatctagagcattttcaaaatgctcctttctgttcagtctttcttctctgctaaaattgttatgtgctaggggagatttgtgaattttagagtaatatctttaagaagcctgacagagtagatcgagaccatcctggctaacacggtgaaaccccgtctctactaaaaatagaaaaaattagccaggcatggtggcaggcacctgtagtcccagctactcaggaggctgaggcaggagaatggcgtgaaccggcaaggtggagcttgcggtgagccgagatcacgccaccacactccaacctgggcgacagagcgagactccgtctcaaaaaaatacaaaaacaaaaacaacaaaaaaacctgacggatgtcagtgaaattgggggatactaaataaagagtggacagcagtggcggggcaacaagcagttcttcagtgttcctgttcctcagcgtagccaacttggtcctgtatctccacagttcacaggtaacaagtgccctgttgcttcctggttgactgatgctctctctgttacataacatccctgacaacctgttaagtttgtaattattgaacaaagtcccacctcattggcaataatggcaaacagaacgatgcagctgtttagcttgctcttgattgaacagaggacataagttggctgttagttgactaatgactaaaattttgataaagataagaaaacactaggcatttgagattcatgtaataagtagcttatgcatgtactgtattcaaagagaagatttattttatttttttatttttctattttttgagacggagtcttgctctctcgcccaggctggagtgcagtggcgtgatctctgctcactgcaaggtctgcctcccgggttcacaccattctcctgcctcagcctccccagtagctgggactacaggtgcccgccaccaagcctggctaatttttttgtatttttactagagacggagtttcaccgtgttagccaggatggtctcgatctcctgacctcataatcctcacacctcggcctcccaaagtactgagattacaggcgtcaaccaccatgcctggctgaagagaagatttagatatatgtctgtctgtccatccatctccctacccttcatctaactgtccattcaggacatttcttcacagctaaactctacctcagtttttaatctttaagtccagagctcagtccattgatttactgtattcatcagattttaatggatgcttatagttttgttctcaaagaaaattaaaaatattacttctagtgtggtgtgctgttctcactgcagagtactgtttgttttgtttttaatttacatatatttactaggaagtgcccacactgataaaacagtcagtagtaatcaagaaatgtgactttcttgcactattatttaactaaaggaaagcagaattatagaaaagaatgttaggaatgttatcttcatgagtcagggcttttgcaatgctaggccttctcactttcaatttctctcttgcaaggttaaaagaattattcttgtgttaactcacaattactgcatttgatcatcctttctcacttatgacatagcttctatgact

SEQ ID NO: 401 - DNA, 9378 bp, Homo sapiens
acatagttttacagtctattcatcgatcagataccttaaactacctacctactaacaacaattaaaaatattagaggagagatgtaaaaaactattgaaaatgtatttctgaccaggcaagagaagacggaattggcagggtgaaaaagggcaagccagactctagggagggcagcgagctcttagactgccttcaccgtctttctgaactcaagggccgggagtgtctgctttgatggctgcatgggactccggagataggcaataaagcccatggtttctacaaagtgggaagctccaagatttattgctgaataaatctggaaccctaaagtccgtaatgtaaaaggtgaatgagaaagaaatctctgcgcagaagagagaaggaaacaagccttaactcactggagtagcaaggaaagcgcttctctgagaattgatgaccaccagagggcctcccacaggtcttccctgcacattcctgctatcctactggggaggtccaaaacaacctccagcaaacaattcaacgtggtcttcaagtagttgtgtacccaggcaactggcaaaaacaaatacaactcctctctggaggaaagcagcttccacccaatattcaaggcattactgaaggcaacaaaacaggaaaacaggtaaaggattctcaggcaactcacaggacataaaatgtacatcttgattacgaaataatctgtgtaataagcttagaaaattgcctgacacgtaataagtgctaagtaaacgttagctatgatgatgctggtgacaacaatgatgatttcaagtctttttaattctctcctattaattgatttctcttgctttgttaaaatcacaccagtttaattaacacttgtcatattgtaaactttttaaaatgttcaaattttttcattgttctttttagaagttttcttacatattttatgtgagttttaggattggcttgtcaagttcctgaaaaatcatgtttgaattttgatgaggataggggttacctttatagattactttgttaaaaactgacatctttacagtattgagtcctagcatttctgaatagagtatatcttttagtttattcaggcttcttttatgtcctttagtcaagttttatagttgtcttcataaagatcttgccacctttttttagttttatacccacttttccatttatgttgctctttcctattaaatgcttaaattggctatattgaagatgtaagaaggctgttgagttttgtgttcaccttgtatgttttgcgcttgccaaaatcccttactttttctgattgcctctgattttctaggtgaataatcatattgtttgtaaattgtgataatcatttccttgtgaatatttctgtctctaaatttttatcttattgcaatccctgcaccactacaatgcgggattttaacaagtggaacagatatccttgttttcttcttcattttaatggatgcttctaatattttaccattaaatgtaatattttctctaaatttttgatatataccttttatcagaatttgctaagcatttttgttaggaatgggtgttcagtactattagatgatatttatttcagtctctgatagttacatgatgtttctcctttaatacatgactatagtaaattcattggaacatttcttttttctcctctttatcattaaaatgtttatatatacgttggataagctctacatggccataatacttgtctaacattttaaaatttatttttagtttttaactaatacataatagttggacatatttatggggtacatgtgatattttgatatacgcatatgatgtgtaataaatcagggtaattgggatatctgtcacctcaaacatttatcatttctgtgtgttggggatactccaaatattctcttgcagctatttaagaaatgccttacttcagtatatgtgaggggttgattccagggtcccctgtataaccaaaatcgaagcatgctccagtccacaggtggccctgccaaacccacggatacaaaatttcaccttctgtatccatgaattcacatccctccaatactgtacagttttgtaggatttgaactgcatgggtccatgtatacacacattttttttcaaccaaacatagatcgaaaatacatattcactggatgcgaaacctacatatatgggggctgacttgttgaatatgaggttccacaaggccgacttcgggacatgagtgtgtgaggatttcggtaaacatgagggtcctggaactagttccccatgtagaccgaggaacggctatattttcagtttggttggaaaaatatccttgtataagtggatcctggcagttcaaaccagagttgttcaaggattaactgtacaatagttaactatggtctcctgccagtgctgttgaacactagaacttattcctttcctctaactgtggttttgtatccataaccaacctcgcctcacactttcctctcccctgcccttcctagcctctgggaaacactgttgcactcactacctccacaagatcggttttttttagctcccacataggagtgagaacatgggatatttgtctttctgggcctgactttcgcttaatgtcctccagttataaacgtgttgctgcaaatgacagcatttcattttttcagtggctgaatagtattcctttgtggaagcataacatattttgtttgttcattcatctgttgatgagcatttagcttgattccatatcttggctattgtgaatggagctgtagtaaacgtgggactgcaggtcatctgtttgatagactaatttcctttcttttgggtatatacccagcagcggaattgctagatcatatggcagttctattttccatttctggaggaccctccatactgttttccataatagttctgccaatttacattctcaccaagaccgtatgaacattctttttctctgcatcctagccagcatttgttattttctgtctttttgataatagctatcatatctggggtgagatgaaatctcactgtggttttgatttgcgtttcttaatgactagtgatattgagcattttttccctagacgtggtggccatttgcaggtcttcttttgagaaatgtctcttcagatactttgcccatttaaaaatcagattatttgcttatttgcgattgagttgtttgagttcagtgctgggttccaccgtggcagggctaacacctagttccaatgccaagtcccacactcactttgctttccctaccccaagcataggtgttttccctccaggctgtgctgcctggggatgaggtaccagggtgtaggtaatgtgagactgtcttccctacccctttaaatgcatcttttcttgttaagctaaaaccaggtcctgtcatctcccatctgatttttagctgttatgaaaatgctttcttgtatggatagttgttcattttgatgtttgtgctgaggggatgatctttggagggttttttttttttttttttttttgagccatcttgctccacctttctctctggtaatttttaaactttatttaaaaatgttccatctatattcataagtgctattcccacgtaagtgtgttttcttattatatttatgaatccaactatggtggctttctaaaacatcttaggtttttaaaaaatcttattctttgtcccgttaggacagtttatataatattggttttatctattttttgaagatttgaaaaactcttcattaaaaccatctatgcctagtgcttttaggacactattaggacagtttatataatattggacagtttatataatattggttttatctattttttgaagatctgaaaaactcttcattaaaatcatctatgcttagtgcttttttcccccctgagttaaattattacctgtaattttgatttcttctatggttatttggtcttttgttttcttttttcttatgaaaattttagaacattcttctagtatctgttttgcttagcttttaatgttaattaaaattatatggagttaaattttaaatctttaatatctgaggttgttttcttttccatttctattgtactttatttggatcttctttcttttttcttagttagacttggcaaaacttagccagttttatgggtcatttcaaagaacctgggtttcaaatgtgctggtatttttgtttggttttctaattcatttctttttttatgtctaataatttattctactttcctgtttggttttgtttttacccccctaattttgtaagttataaactaagtttacttattttcaatctcttgtgttttctggtaaatgcattttatgctatgattttttctgaccctgctgtggctgtttcccagtctttattttgtgcgctttatttgttatgtatgtatgatgaaaatggaaatttttcttcagtttttttttcttcatcccaaagcacaagtaaggcgttaaatttcaataggtagatagatgtagagatagtagatttttagccacgttttaattttatcctattacatttattttaaaagatttggaagacttgtatttttttaatttgtaaatatatccttttgtcctaaaacttagataatttttgtgaacattccacatgtttgataagagggtgcattactctctgcctctcttaactgtcttattctctaccagtttatcttatataaatattaaaactattattacatgtgtaaaggttatatttgctttgctaagattgtattagctatctttttatggtctggaacagaggttggcaattttttcttgtaatgggccggatggcttctgtcaaaaccactcagctcgccattgtgttgtgaaagtcgccttacacaatatgtaaatgcaagtgcagctctgttccaataaaattttatttacaaaaacatgtggcaggctagaattggcccactggtcttagtgtgccagctcctggtcagcataagccttatgacactctgaaatttagatattaagtttatgtaatatcgtatatgtctgttaaccttttgggtagtaatttgttgaaaaacatacaactttacccattattttggtatttctggtattctcccttttgaatcactatggaaaatccttatttttctaaaccatcgtacttaacattaatgcttgtattctcaacaagcacaatattgtgaaaattggtttgggtcaggaggaggaaaaaaaaatcttagaaattgcaatggctgtgcatggtggctcattctggtaatcccagcactttaggaggccaaggtaaacagatcacctgagcccaggagttcgagaccagcttgggcaacgtggtgaagccctgttactacaaaacaaacaaacaaacacccaaaaaattagccaggcatggtagcttgcacctgtagtcccagctattcggaagactgaggtgggaggatcagttgatcccaggaaattgaggctgcagtgagctgtgatcatgcccctgcattgcagcctgggcaacagagcaagaccccatctcaaaaaaaaaaaaaaaaaaaaaagaaaaggaattacagtgtcttgtggctctccaaagctcagcccaacaaaatcataccttagcatttatttacaagcggagggtgttgagcaaggcaggttcctttgggggttgataatgaaaaataggtaaggtattcaagtttattaatgtaatgctcttttaagtgtttgtagcatctgtgtctgtggtattgttgctacacattttgcttactcctacttttgcaatttgtattttctgtaattcttattagactagaggcttgtttcccccacacctttcaaagaagtctcttggtctaatttttcagttcaactcttgtgcagattcatctctttaccttttatctttactttgccattgctgtgtgttttccgatgcctttaattgaatgactaatttgttttctgcctcccgttccctctgccactcctcctccccaattttatgctgtgtcttttcctctaattataaatctgggtttatttgcttttttcttttcttttctgtgctttctctttctttaacttctttttttgatatgcagcgtccttactgtcgttattttctaaagattttgtaattgcttgtttggcttctttgagacacgatttaatattagtggaggatttttaaaacatttcccttctttagctatttttggtttgtatttttgtcctgaatttcagtttttattgcattatcttcagaggctgtgatccttataattaatcttcttttgacttgaggcttagtttgtggcaacatatgtcatcaagttttctaagtcttccatgatcacaaaatgatagttgaagtcccttacaatgctcatcagctaggatgctttcagcttcaggtaatgaaaaaccaactgaaaatggcttgaatagaaagaacatttattatctacataagaagtcctggagtagggtaattttagaggttgttaactgggggcctcagtagcatcatcaaaaacctacattcaattcttccctactcaatctgacagcttggacttgtctcataggctggctgtcctcagggtctcaggatgacactcacatgagaggttgcatgtcccctttctagcacttctctctttcccttcattcctccctccgtgtgtgtgtgtgtgtgtgtgtgtgtgtgtgtcattcacagaagtttctcttagatccacagctctttcaatgagtggaatggtgttacatgtccattcttaaaccagtcgttgggaatgatatcaccaggggtagtagagtgcaatgttgattcatggcttgagggccagtccaggctagcgatacagagtgggtaatattctctccctgcagacatagcccctggacccaagtgaacagaatcagagttctcactgaatttaaggctaggggtgggtgcaggcaggtacagggaaggcagttaggcaggcaccagtagtatcatctgcacagttgaatactttattagccataacaatgtgcaaacaatccacacacttcatttgggatatttattccttcaggtgtaacttaagcatcttttttgactctaaacaattgagcgtattgtggaaattttccggtgatttttgtcttaaataagtaattgctgcagcgctgaaaattattactataaaattctactcctgttagtatatcagatatatatatttttaccattttctttataattcagaattttaggattttgagcagccagacattgtgttgtctttattgttcttccagcactgagtgctgaatttccagaaacgaatggtaataatgaaaggtgcatatctggagatagatggaagtgtaactcaagatgtgattagctacccagtttgtttttattaaaatgttatttttttctgcatatttgtaattcagggaaagtttctaatgtgaaaaataaagtagcttttcttaaggcaacgtataaaaaataattggtttaacagcattgtgtgaatacagatgagatggtcctattaaaatttgatcacaaagtatacatggtaaatgcagcaagattcatgctaactaattactatttcaagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgcttaaacagactaattgaaatggttgaatgggtaagaaaatgctcccttgaatccacatccttaaatgaggccaggcagacttggaggggtctgtgagcccctgagctcctgtcttacagtctcaggctattggagggggctgcacatcccacatttgggtagatgcccaaattctccttttagtatatactctcccttttcttgggtgttcttggaactctggtagaagacagggagaatgatagattttccttgccctccacagacacaggcaaactagtttctgttaggcattcactctgtgtaacattcatcccaattgcaatggtgatacagctaccgtcaacagactgatcaccttgcctgtgccatgtgccctgtgcacatttactctagtcttcacagtaacctccagagaggtgttatcccattttatagattacagccgaaaaaggttaaggaccttgtcactgaactgcccagtagaagttcaagcatatgctcatggaatttgattttacggaagtatgtaccctttagggatctacagttaggtgccctctagggtgtctagaattgctgaggagcccatcgttccttaagcacctgtgctgcgttgtattgtaatcacctgagggtgctttaaagactatgaataatactcagactttcttctccaaccatttacatcagagcatctgggggtggaacccaggcatcagtattttgcaaagttcccaaacgatgtcagtgtttagccaaatatgagacccactggtttagagctgtaaacagtgcagttgctactgttttatggtagatgttacagaaatatgtcgttgaattgcctataaaatgaattaaagattggagcatttcttttt

SEQ ID NO: 402 - DNA, 6453 bp, Homo sapiens
actgattacatctcacagtttttaacaccgtaacatagttgaaattttgctttgaatccatacattttacacgtacacgttagtatatgccatggtctaaatattagtgtccctccaaaatgtgtgtgaaaattgtaacccccaggagatggtgttaggagatggtgcctttgaggggattagattgtgagggctggttgggattagcacccttatgaaagagacctctgagagctagctagtcccttctgtcatatgagattacagttagaaggcaccatctctaagaaaacaggccctcaccagacactgaatctgcctcagtcttggccatcccagcttgcagaactgtgagaaataaatgtttgttgtttatgtgctacacagtctatgatatttttgttatagcagcctgaactaagttggtatacttttcacaggttcttgcagctgtctattgcattcactcaggtgcccaaagacgtcatttaagaggccgtttttgataccaatatcctctgctttaaccaatcttcaaagtgagaccccttcaccaaaagtaataacaatgatgatgataacgatgcattgttcatagattcttgcaaaactctttggacagccaatgcttgtcaatttgaaattgcaataggaaatttaaacgtttctgcttttgaataatattgtttgaagatgcatggatgacaggtcagatgaccaaagacgaacttcatctagaagatcattaaatcgaacaagcttcgactgcacactgggagaactgatgttagtaacaacacttgatgtgtagcgtgagtctgaatctctcaaaagaaattcttgggctaggcatggtggctcattacctgtaatcccaatactttgggaggatgaggtggggggatcagtggaagccaggggcttgagaccagcttgggccgcatagtgagacccatctctacaaaaaatgcaaaaaattagctgattgtgatgactcatctgtaattgcagctactcgggaggctgagttgggaggatcgcctgagcctgggaggttgaggttgctgcagtgggccatgattgaaacattgcatcccagcttgggcgacagtgcaagaccacatctcaaaaataaaaataaaatagcttcttttgtcaaaaatgacattctgattccatatttttcacaaagcaaaaagcaagtgggaccatagcatcttggattttattagacgtgccattctgataacatcacttaatgaggaatacagctttataggccatcttttacctagagaccttctctgcgaatacaacaatggatttcttgattcccaggctcttcagattgaattttgctataaagtgtttatacctttttaccatcattggtatccaaaacttataatttttttctctattatgtattccaaagtgtttgtgtaagctttgaccatttcatccccagcagtttgtctggtatatggtagatactgtagtgctgccacccaggtcggttcttcagggtgacacagctgtccccagtgctggcacataggctgcccagctcacagctgtgaccttcactgagaactgcctgaccaaggtgacacccctcccatgggtcatcctgtggctaacggcgccacaggaaagcccagtcccctttgaatcagttgaggacaacttaagacccctctattccagagctccccagaggatcgactgaggcctcagctactgccatcctgtgggacagcttctccttctgccctgtcctggcctccccacttcctggcagatgtctctgttgagttccactgaaacttaaactccaaactcttcacgcccagagtctatgaccggggcaaacaattgaagacagggaatttttttttttgtaccttaaatagtgttcaaagcatttattttgagggattcaaactcatgccatacaccaagtgccgttactaacatcagcacttatcaatctgcagtggaagcttgtttgatgtaataatcctctagactgggtttctctgggtcatttgacctgtcatccatgcatcttctaatggtattattcgaaagcggtacttttcttatttcctgtgcttcactggtcccaaacatgttgctgacagtttctaatgcaccttggcaaagtgagtgattctgcaattgcaggaggaattttggctttggctgttaaatgcaggacattggaactagcatcttgtattcagtctgacacagttgtggtccactcatcaatactcccacttcttattgtgtaactgcagacaattttcccagttctgatctttttctgtatgagatcaatgctttagggaaaggtgctggcataatttgcctgatgtcattgcatcttctgattcctttttcattaaatacgacattgagacagaagaagacaggattattggaaaatgcaaatctgaatttgagatcattttcattataatttcctgagtagcaactttttttaccactctacttggtacacttgatgactttctttaattaaaaaacgtaaggacaaaaaaccaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttaatgggttcagcacaccaacatggcacatgtatacatatgtaactaaccagcacgttgtgcacatgtaccggaaaacttaaagtataataaaaaaaaaagtttcttattatgatgggaaaatatctctctataaatatgcaacagtattaaaaatatcaacctaagtaattttactaaatatatacatatttaaatataaaagtatataaagtggcctgtaggccttaatggcttcaaaaattaacttttcaagatattttgattgcatacatcctcaagaatgtttcaaaataaatcaagttgaaaaattcaaaaagcaaagcttgcattaaccaaaatgagcaatattgacattcctttttatttgattggacaattaaagttctgaaaaactcatgaatataaatgtcagtgatgtcatctctgatccaaaatattttgaaaactcaattatttgaagatataaaaccctacagtcctctttactgagttgatttaattatggaacttattataacatctttaaaaatctgtaaaaacagtaatttattttgagattccatcagtaatcagatcttgctaaatttacatcatcactagccagaaacgaagggaagggggtgggggagaagaaaattttaaaaatcatttttgttttaataaggaacacctaataccagataataattataaacataatcatacgttttacttagtcacataggtaaaaatactagcaaattaattgaataagaagcgcccccacatgctgagcatgttactgaaccaaactgggtttgtctgtccctgcatgagaggaagacgctgaagcactgggtttttgcagcaaaaaagctttattgaatgtcaagtggtgaggagcaggaggaaagactcaaatctgtctcaccacactgggggctgtaccgggctttataagcatagggtaatgaggcgtgttctgattggatcttgcagtggggtaacgccagagctgaatctgattggatcctgcttcagctttgccatgtccatttcttaatccagtccctgctcctctgcctgagcacttaggttcccccaccgtggttgcatgcttggttcatctgagtgtgctcagagtctgtagtcttcaacccgggggtccgtggcaactgaaaaacaactcacaacctacttacacacaagtcgaaccacattgtgaagcggcatttttgtctagggtaatacccaaagtttgttgtctcacgctgacgaaatcaaggacccggacacacaaggagtgaggttaagagtggaggtttaataggcgaaagagagaagagctctctcctgcagaggggtccggagtgggtttttccagtccgccacaaaatgcaaaggattttacagatgagctggaggaggcaatgtctgatttacatagggcatgaaagattggtcagaccaggtgtgccatttgcataaggcacaaaaaaccaggactggatgcgccatttgcatagcctccaaaaatctggccacccacaccctaatcttttattatgcggatgggttatctcccccgctggtgccttgttgcctgcatttttactgtacacgtggtgacaaagaaaacggaagatggagcctccatgttgaatgtgtctggccctcaggtagcccttttctgttggcacagctgccggcattcacctgtgcaagtttctagcttgcttatctatgtctgcagctcagtttttcaggctgctctttgttagaaaagaaatgatttgggagctgttttctgttaaaagggaagccttgccaaagactctcttaccctcactatctgcctaaataatttctttctagctcctgtatcaattggtcctgtgcctggtacagacaaacaaattcacagatgagaaacaacctgcaagtgaaataaaacagcttgataagaggggtccatgggggtgtcagggaagtgccgtgtggctcagccaacctgtgcctttctgcagcagatcctctcaagagagttaccgggttcagaaagtttacaggaaccacatgcatagttttgttttacttttttttttttttggagtactttcagattcataggacagttgagtagaaagttaaaagagttttgatatactctctgcccaacatgtacaaagcctctcccactatcagcatcccccaccagagtggtacctttcttatgagcagtgaacctaccttgatacatcactacccaaaatccatagtttacgtgagggttcacgcttggcactgtgcattctgtgggctttgagaagcatatggtgacatgtatcccccgttatagcctacagaagagtttccttgccctcaaaacccccatgctcctcctgttcacccctcctgactgccgacccccagcagccactggtccttttgctgtctccatagtttgaccttttccaaaatgtcatatgtagttggaatcacacaacacatggcttttccagaatgacatctttcactgaggaatgtttaatgcatgcgtgtcgtgaaaacacagcatatatatagtgaaaacagcatgaaatgtaacttcaacagctgcaattttttttttcttttttgtgacggagtctcgctcccttgccaggctggagtgcagtggtgagatctcggctcactgcaacctccgcctcccaggttcgagcaatactcctgcctcatcctcctgagtagctgggactacaggcccgcgccaccacgcccagctaatttttgtgtttttagtagaggtggggtttcatcatgttggcccggatggtctctatctcttgacctcgtgatccacccaccttggcctcccaaagtgctgggattacaggcatgaaccaccgtgcccggccaacagttgcaaatgtttgaatggctgtaaacggtggtttatggctacaaaaactaacagatatccctgtctctgggtccctgtgtaacctatccgaggcacagtgagagaccactgcactgtcccacctccttcttccccatccactcccagaaatcctctcttcaggtaggagaaactgctactctctgatccaggtttcacatatttccgtgggatataaaacccctagtgcctgaaactgctcttctggtttctcctttcacctgtgattattccctgagtgtcgggggcttcaggacagaagactttgtcattggctgtgagcatcaagacagtgtccaatgggtttaggctgagagccagctcagccaggtgcctgcgtggggggaattatccagtgaaaagatatttgtctgctcagtgaaaaccagaaaggagcataacacctgtcacgttaccagcctgcctccaggcctgccattggaggcacagcaagggtctaatgctaatcatccggggaggaagtgtcccttgaggcttagtctgagcagcgggaggccacgctgcacacttgaaaccccttttgccttgacttttctgcagcatagttggactaagcccttgtcgttggcttaagaaggggcagggttatgtaaccctcaataattaagacctttccagccataaccactcttttattttcaacactgtcaagaaggatttgccggctgtaactctttctcgcttgagggcatttttaattccattgtccacaaatttctgagtcatttctgatggcggtaatcaggacaaagagaagccgaagacctgg

SEQ ID NO: 403 - DNA, 6302 bp, Homo sapiens
aaacaaataatagtttatgacaggttaaaaaaaaaagaaataaaatctaccaagtgtgcattcaaacacatacatgtaaaatatctttggaagggtaaaaagatgctggtaatggagtttgcctctaggggaggaaactgagtagctgaaggattctatagcccccttgagatctttggtagatttgcactatgtgaattttagcaactgaaaataattaaaaaacaaagaaaaataaaaataagtacagtactcaaaaaatatttttttcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaat

SEQ ID NO: 404 - DNA, 6033 bp, Homo sapiens
tcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaat

SEQ ID NO: 405 - DNA, 7292 bp, Homo sapiens
tcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaattctctcttacatataaaagttattaaaaaatgtatctcaaaggaaatgaatgctagaaattaaacttaggcaaaatgctaataaccgaaagagaaaataatgtgtatgtccagttaaaataaatcttgacataaacagtatcccaattatgatatatgcaggaggatattactacatagaaattagataagcaaaaaatacatttatagaattaacaaacttttgtaatactatataattccttttacataaagctcaaaaacaggcacaatcatactaaagtgatagaattaccctttggcataaaaaattttataagagctctgtcagaagtaaactggaagtttacttcttcaaagtgagcaggataatctgttttgattaatttaaaggcaactgattagcgttcttaatgagatctgtaaaatgtcttcacctttgtcatatgacgtagtttaattgtgggagtgacagtgtgtattcagggtctcactcacactcaaggggaggggattgtacatgggtttgagtcattgggggccactttagacttcttcctaccaaaacagtattataacaagctaaactgaatttccgcaacttgagcctctcttcatatttattagccatttgcattttctctttggtaacaatgtttttccttacctttacatataaattacatatttatttaagaatagtgttctaaatttattttcactaacataaactgcatacatcttatagtaaatggcacagatgttaattgtacaaccagatggatttttccatggtacatacctgcgtaaccaccacccagattgagctagaactttcccagtacttcagcaggcaccctcacatcctctccaggtcaaatccctcctcacaagggtaattgaattactttagaataattgtgcctgtttctgaactttatataaaaggaatcatacagtatatatagaagtctgtgtttttttctaagtattattttgtctctgaaattcatctatgtaattgcttgtgtaatttctatgtagtaatattccctgcatatatcataattggtctctacattctaccgtttatgtcaaaatttatttaaactggacatacacattatttcttttttgattattagcattttgcctaaaggtttaatttctgagcattcagttttaaaaaatattagttaacttttatatgtaagatcgaatttaatgaaactatgattattaggttctcataaacatttt

SEQ ID NO: 406 - DNA, 1027569 bp, Homo sapiens
  misc_feature (229039)..(269038): n is a, c, g, or t
aaggccaggccagcattataatcatgcatgagaaaaatccaagacaagtatttccaatgcctgcagccaactggctctgggcttgctctgctctgcagaagaggtggtggaggcacgttggaggacacaggcccagggtcagaggctctggagctcagtccccacctatacaagagtcatcattctagtgcctcagctgaggctcactgtccgtgtctgttagcatggagctcagagaatagacctgccccggtgcagagtaaactattagatgatgagaaagaaaaagaaacattttatctgaggaatgcgagtccctttaaatgatcaggcccagagatgcattaaaatatgacagcagtcgtgtctcactccacttgagctaaacaatgacctcttgaagccacttgctatgtgggttctaaactgactgacgccaagtagccaaaaaatgccattcaccttatagttcaacaatgtatagccaatcactgaccaatgttatttctgtaaaccaacgagaattcctgaggaacaacttctgtaattgcccccttcctgagtcgtcattttttctttaaaacttgagcctctcatttgttttccaaagcacttcccagtgtgcagtgtgcacttccccattctgcggtgctcaaccttggcccaaataaactccctgtttattaactttgcctcggtttctttctttaggtcaacaatgtggactgcacttaacctcaaatccaacgcaacgtcctggccctgggatgttcacagtgaccaccatgccactgcctgggccgccctgtttgtccccaaccctctcttcaccatgatcagccttcgtgtatggtgtacccatgacataactaactccatcttagaaaaagcctccatttcttttcatagagcactctgccaacaaggagaagatattttgttgaataaataaataaataaataaaggctgcatccaaccagataaggacacgcgcacactcttccactattggttctcaccagagggccctgtgaccatacaagattaggcctgaacagctccaaatggccgtcttaactgccactttattgcagtcactcgtgatgagagcttgacatctgccgccagaagctctgctaccttcaagattttcttgtaagactgatgaatccttcggtccagactgggactccttttgtcttcttggcttcccctggactggttcattaaccctttctcctatctctttttcttcttgatgttaaatgttactttgtttgctgtggaatgtttaccttacaccatttataggttaggtatactattatgtatggtttgcaatactgactgacttatggagtggcatcagcctgtgtgcccgcagctctggctgcaaagtaatgggaaatactacggaaaattgcctccttaggagctccatgtagctcatggcttttgtgattgaatcacaatcaataaaagcctgacactgtggaaaaacacaaacatgcgtggacctagttatctctaaccttgcactactcatgacacttcggctctggggcttgtggtgcaggggttcacatgctgtccactctgtcagatgaagcccacttccaggtacttccaacggcatgtcaacccggatcttctgtcctcccagagggacatctgaagtcacttcagctgttcctaatgtgacatatttttagtccattcatcatcctagtcacttgcttcctatttttccttttatatccctttagttcttaatgtagtgattttctttaggaaaacaacaacaacaaacctgcatgtcttagctgagtcctggggaaaaagaaaagggcacccgtgtctgtccagattaaagtccgtgcatgtttgtgtctttccacaatgtcaggcttttattgattgtgattcaatcacaaaagtaaagggcctcagaacagggactggcttgggggtggggggattgcgctcaggcctcaggagacagacacaagagtacccccaccaggcttaactctgctcacagctaagaaggtcttctgttgctaggaaggaagaccctttccttctaaccaagcacacaggccagaggtttgctcacccaagcacttcggatttgtaaccagtgagggcccaagacagactgtggcagctaagcaggaggtgggaggtggagtcaatgagctcccgcagagggagaccccactctgctcttgtttctcgtgtgtattcacaggccctgcctgcattgccaggcctcagcagagagacaagaatgacattcccgtggcggcacccagggagtgctgattccacttgaagatttcttgctaattgaacagttacttacaccttagctaagtcttgaaataatttctcaaaaataagctgcgaaattcttcattggttgaccctagcattggagaaaattgttctgctcaagcagcaaagaatgagttttcttaactggggctccaggggatgtgccaatctacccagtagaatccaaaagaagtaagaatttcacacagagatgctctgccctgaaatggatgctacacagggcctcagcgatcagatttccgggggacagacagacaaatccggccataaaaggtaggcatattgttagcaaaatggagtccgaaaaacaacagacctgggcccacgcatccaagtgtctgggtcacaaaccatctgaagggtccaattctccccaatactgctgtcagcaaagactcggagactgcaatgggggggaacacagtcaggtgtgcagcgtggcctgccctcacaggtggctgtcacggattcttcttttcctaaatttccacctaggggctgaatcatgtgcgtccattggcacaggttggacttggcccgtggtctcccagggcatggtgccagccacatgctctgccctgccccctgtcctgtcaggtttgaggattttacaaataaataaaaggagcaatattatagcagcaaatcaagagtaaagatcaggtggattggaggtatatcagaaagaactgtgatcagtttagctgttcttggcaacattgatgggccactaccagtcactgcctttgaacaataacatgaaaggaaaagtcgcatcggtgaaaacagtggaactgaataataacgaggaaaacaaacatctacatttacccatgtttttcctttaagaaagaaaagttacatttgttctttatatgcttaaatgtttaatttccattagaaggagtaaaaccatcaatttcaggtacagggtgacattagagaaggccaactattttttaaaattatgtctactttaaattttgtattgcctggtgctattgtgtttttttaaattgtggtaaaacaataacataacatttaccatctgaaccatttgaaggcacagttcagtggtgttaagtgtatgcacatgtatatggttgtgcagtacatttttaggacttacccatcctacaaaactgaagctctgtgcccattacacaaccctccgttcctcctccccacagcccctggcaaccaccccactctcctttcagtgtctatgaatgtgactactctagggacctcgcataagtagaattataaaggatgtgtctttttgtgactggcttatctcacaaagcataatgtcttcaaggttcatcgaatgctgttttaaagtctgtatgttatgcaccatgaaataaccaattaccatcatgttgagtgcttgtacccagaaggctcaccatattccttcccagatttcaaaatagagatgatgatgattcttgtatgacatcaccttctacggctcccagcattcgggggtttgtcatactacctgttctactcctgcaaattaacttcagaacaccattcttttttccatcaatttaagagctgcatttgctaacccaccctcgggccatgtaggaacaagcatcgactttcacatctgagcaattctttgtaagttccatgtcatttgcatgttcagaaaagcaatatttcgccatggtacattgacatacctatcagcactgttatcacaatccagaggcgcctgtgttttttcattaacaacagcctgtgttttttcattaacaacacttaacgctgcttcactagttgttttccaaatgttctgtaagaaaaaataataaaataatgtgagagagctgcttatgaaaacccagtacatttgggaaagtaatattacttcattaacaaaatagcagtggacccctgctgtgcgcccagcactgtgctgggcaccagagaagcaacagcgaggaaagcagacagcttcatcctcccagggctcctgttctgccagaggaagccagaaagcaaacatgtagccataacagcatctgctgggggtcgtgctgcggaagaatagagctgcaggagggattcgtgcggggtcgggacggggtgggggtggggggggggggcgcggtgcttttttatacacagggtcagagaaggccgctgtgtgtgacgacatctaagcagagctggaagaggaggaatgcagagctatgccgaaggtggaggcacacctgcttcactgcaggagcagcagaagtctcgtggggctgcagccacaagtgggaaccaagagagcacaggaggtgacctcagagttacgggaggccaagtggggtcagactcaggaagtggagtttcattctgaatgagatggagggttctgagcacaagagtggcacgctccaatgcacagaagcaacagtgtggttgcggtactgaagagagcctggcaggcaggagtggcagcaggggatccactcagagggctatgaggatggcaggtcttgattgtggagtgaaggcagagggtgaacacctctgaggctatggggtggccgggctggctgctggactggaagtgagatggagcccaagagagaactcagagacaatgccactgggcttgctcggcctgtgcacactgagagcttaggtggggtgggggcattggagggcaggtgaggggtgctgggagcccatcttggtcatgaggcctctgttgaccttgcattgacctgtgcagctctccttgtgacaaaatctcaatcctggtggcaccaggaaagcagggaggtgcccacggcacaggaggaggggggacacttttggcctacgggaagctggccaccttgtttcctacacaggacgcctgtccagagacaacgccccactgtggacatgattacaaaaagcagccaccatccctcagactgagggcccagggcctcactctggctcttgagagagctgttaccagaagtagttccagccagttaagaagttagtataggttaaccaacggcccagcccctccctgggatgtgcgctccctgtgctgtgggccttttacagatttgtaactacaggacatcaggtgcttcatctttcaggagaacaacacaggaaggtgtcaagaaggccagagtgggagctgaaagatgccagctcgtgcctgagtgcatacgcctggcacctgcccctcttctgtgacgagaacagggaacccctctgtggcctcccagagcaggacctgggtagatcctggcagtttcctgaggatgtgaaacccaggggctgagacagctgcatgtacctacaacccctaaaaggcatggtgctagtgagcagcatgggagacacagggctttgcaagacactatcctataactatgcccaatcagcaaactgcccagcacgtccaggagctggtgtatggccctgtgtgaccttcgcctgagcccactggggctgtagagagcagagcggccagaatgcagcttggaaatgggtctcccagtcaaccaaaaccagagagccccctgattgcacatttcaccaggaccaagccctttgggacatgatggtcaaatcctaaaggcatcgatctatgcccaaagctgaggtcccaggtggctgaaccttggagtcacctgggtggggtggggttgaagcaccatcaccctgagccacgccacagcatgtctgttagaatcttcagaggcagggcttgtgcatggttttgtttggtttctttgacttttaagctccctaggtgattctgcatagcagatctgcaccaagtgttcaagaagcatgaggtctgtttgcccccttgtgtttggaggtgagggcactaaaagcctaaggaagtcactgtatgtggctatttacattgtgtaatgtgagaaacgcaggtaatatcacctcccctctaaaacacctctccccaacctcctgttctcagaaccatcagacgctcatcttactaaatatccttccttgggaacctaaaaatgcctccttgaactttcgctgacaaaagtgatggcagagcagagaaaagctcccaaacacaaacactgtgggttgagatcaaattcatttcaatataaactcagatggatgtgctacggagggggtggtttaataacgctgctctgcatgaggaatactgaaaaatgaactgcaggagagtctttgccaaggacagcagaggttctgggagcttcaaagagaactggcttctttaaatttgaactagaaacgcacaactctgggctgtctgtgcatgtccctttggaaccaatgcttattctgggtgaaaagcatgtctcactcagaagttttcactcttctctcggaccccacccacagatgtgagagtcactcctctcacgcttctcctccatctccagggcattgcccaggccttcagacccaagccctgttagctactctgataaacagatgcaagggaattcacaaacatccaggtagcccagtcttaattaataggggtcttcaacgagctccccacactgcgcaagttaagcagggtttcagtgctttggctgctggaagccttgtctgtgctggagccatctcggggcagctcccactccccacctgggggacagcacccactccccaccccggggatagcccccactccccgcttgaggggcagcccccactccccacctgagggctaccctcctacttcccacctgggaggcagcccctactccccacctgcagggcagcccccactccccacctgagggctacccctcactccccatctgagggctatcccctactcctctgggctgggctagccctgcctgcacttcttatatgtggaactatgctctggagctgaattaaggctttataagtcacacttgcttcattggcacaaacacacatgataggaaaacaatccctgatgaattcctgatgaaacatggaggtgctttttagctgtactgtacatgtactgtattcaggaagaaaagcctaatttccccagatccaggaataccttctgcctggaagctgatgaggatgggctctgtgattcccggtcttctgcctttccattcagagcacaccaaggacagccacacttcccatcactcataagaagcacatgattagcatagacctctagagaaaaaaaaaaaagcaaacattctgaagactgcaatgtgctgggaaggtgagaacataaagctggagaagccctaagttatacataaggtcaaagccacctgggcctaacaacgggctgatcatgaagatgcgtgtccttgggctgccgtgtcctgctgtgtgtgttttctttctatttccttgcttaaacaatgtcttaggtgtagcccacactaagcaatatgaggaaacgcacaaccaccagccacgctgataatgaatgcctgttccagaaacacccagtggtctggtcataaaataatgagggtcaaaggtcctgctcaggggtgtgtagtagagggggcaacaccacagtcggaaggagtggttggggagctgttggacaaacaggaagaccattaaagacactccaaagtttataagcaggatgttcccacccaggcaatctggccctgatggtagcacggacctggctgacgttcactcctcccatctctgagggctgaaggccgggcagtgagcggagccagtgtccacccggctgggaggctgagggccctgccacatcccatgtctgtgagagcatctggaataggatctgcgcacagctgacaactgttgccagcgatgacaggtccttgagtgtttgtgatgccattctctctactcatgcagatgtttgaaaatgtccataataaaagttaaaagaaaatatttctgctagacctggccctgcacagagccactctcagcaagaagccaggcgactgccttgggtgcaagagctgctttccctgaagcccccacccctctcatccccaggtaggaggggaaggaagtgggggtggcgggtgaagaggggactggagcaccctgctgcttttctgtcagacccgagtccctgtaaggaaacctgtttctgcctgggctctcttaaccccagtctgttattctggccagctttgctcaggctaaaaggaacccaaaggcctgcaggccgccgagagcagcaggttctccaggagctccaggccagggctgggccatcctcacaggggatgtggcttccaatccctgcaccccagcagtggtgctggcagtcagcttgcccctagcctcccaggacactctcaagtttagcctaggacaatatcaaatccagttttaacattgtgagtcaaagtcactatttactgtcaagagtccagtgtattaatatcttgtgataacaaaagctgaggaaaaatcaaaggccgtgttcctggcctaatatgtgacgtgctacaaatgccatcgagtgccattgagcacccatgcaggctggatgcaccaactgaggtatgaagtaatttcctgaactggacacatccgagaggaagaaatatttagaaaatgtttcggaataagctagaatagtcaagtgactcatatttctctgaaaccaattagtcatcaaagtcactgtgctcaaattatctggaaaaaaaagtggatatacccctgaacagaaagaaataaataaaaaatcataaaaagtacataaaattgcaaaattgaataaagtatgtcacaaaaggagaaataaactaagtgagtgaaactaatcctgaaattggcttaattgtcccacagaagtgatatttataggttttttgaataaacatggaaactgactctcctagtcttaaaacctgaaacttaacatccatctcatctgagttcttccctcaggaaaccaacccaggaaagggacccaccagatccctgcatccagccaggcccctcattcctcagattgcttcctcacccctctctaattttgttttctcgtcttccctgctatataaacccccaagttttagtcagatggggagatatatttgagactttatctcccttctcctcatctgcagcacctgataaagctttcttccctggcaatcctcgcagtcttcatgatgattatgctctgtacgtaagcagcagcagcaggatgtcaggcaaacccctggcatttaggtaacaattccacatgatcttaacataagaattgcaaaagaattggcgttgcattgtttcaacattgatgccaggcacacacccgcctcctgccccgcgcccccgcccccccactccatttaaatccgtctctttagaaattaaaaaaatttttttaaatttaattttaaaaatccgtttctcaggtctaccaaatgtgtagcctaagttgaaaactcaaaaattccttctacttaaaggaatcctggcaattacgtttcaggcaacactttagaattttcattttaaaaattaaaaacagagatactctctgtgttaaggacgaggaggaaaaccccacacctgtggccatgcagacacctcctgtaacctaagtattcccttcattgggctctgggaggccccacttacagtcttggttgttctcgaagtgtggcccccagatctcagcctcaccccagacctcctaaagcagaaagtcaggggtggggcccagtgaaggagttaaaaatataccatcctggccaggcgccgtggctcatgcctgtaatcccagcactttggaaggccgaggtgggcagatcacgaggtcaggagatggagaccatcctggctaacacggtgaaaccctgtctctaccaaaaatacaaaaaattagctgggcgtggtggcggacgcctgtagtcccagctactcaggaggctgaggcaggagaatggcgtgaacccaggaggcagagcttgcagtgagccaagatcatgccactgcactccagcctgggtgacagagtgagactccgtctcaaaaaaaaaaaaaaaaaaatatatatatatatatatatatatatatatatatgtgtgtgtaccatcctggcatgtggactatttaagttagaggcacttgcaaaacagcaggtttaagatcactctgaccttccttctgtttcttaaaagcagaaaatgaaattcccatgtggaagatgtcctgtttataccagggaaataaagcaacattcttatcatggtggccatgcctccttccccaaggccttaccgacccacaatccacctccaggagggctacagctgcacagatgaagaccccagctcttgtcagtgctcacagacagctcaccaccaaaggaaaggcagcaggcagcctggagacacctaagggaaagaaaataaccagaggaaaattaaattaagtacaatcgtttaatcacagacatcctgtgaccactcttccatccatatccatatttctgccacaaaagtattaagtacaaaattggctgccatatgaacaaaaagactcgcatctatggttcttttcacttcatatttcccaaactcagggtctgttttagaagattaactgaaatatagttcccatctgactactaaaacagcctccgaacagatccatctctcttcctgctgcctccagggcttcctgcccagatgcacagagctgaccttccagggcaaggtctggcagcttccagggctcctcttcctcctcctctcttcctgcctcatcatccccattcctgctgctcactcacagccctaagagcacattcttccagcccatggggatctggcatgctgcagaaaagaacagcatggaacccatgaccctggggagagatgccagcgcagacacagagtaggcactgcatggcatcctccctgtttatttccacaacagacttgagaggttccgtgcagttactttttcagatgctggtatcattttggtatttgtccctgtgcaaatctcatgttgaattgtaatccccagtgctagaggtgaggcctggtgggaggtgtttggatcacgggggcagatctctcatggcttggtgctgtctttgtgagttctccgagatctggtcatttaaaagtgtgtggtatctcctcccctcctcttgctcctgctgtcgccatgtgatgcacctgctcccccttcaccttccaccatgattgtaagcttcctgaggcctccccagtagcagacgccagcattatgcttcctgtactggctgcagaaccgtgagccaattaaacttcctttctcagtctcaggtatttctttatagcaatgcaagaatagcctaatgcagatgggatcatgaaggcccagcaaaacaaattaactcagcgaagctcacaccatcagtgagaggcagagccaacgtttaaacctggttctcagcacacccaaagccgatgccaattctatggcaccttccttcaaagctctctacaggtgtgcctccagagctcaagctgcagctgaagtcagccccaaagctctgccccttggcacagctggtgactttccctctggactccctaggccttgacagctgtctgctgctctcatgtttgtcagcagagatcatcgtgggtcatcatctggtccctggtcattccctttcagcctgtagctccttgggtcctgaggtatctgtgtctggcaccaatcgacttgagaaagatcaagtgcagcgagtgaaatagtcctgaactaaggtgcgggtttcctgggttctggtcttgattcagccagaaatggatggtgtgatttgggtttctcctccatgcccattcccagcgacagggcaatgggaaccgttgccaagttcccagctccatataggctgctgtgctaaggagaagggcaggctctacatccacttcttctagacacaggcagtcaccttgcctctctgtgtcagtctccttctctgtttgagaggaacgacacagacctacttcacggggctgctgccaggactgtcattctagaaagggccgccctgtattagctaaatgcttggtaaccagctgctaaaggtgttcgcctttgttctttcccctgaaaaatgcattcagctctttagaattctcttttttacctgtcttggatgtctataaagtctagaggatatctactttatcttaagcaaggtttctacaaagataaaactggatagtttcacccaatttttacaagcctggttcttgatgcccaagaagccgccaccagagggcagacgaggacaatatttatagttgaggaaagtgtgcagggaggtgaaaagctgttattttgaagatgaagatggtcactaggtcaaaggcctcaaactgttgaataattccaaggatttccttgcctactctcaactatgcttgtcttccaaaggccagagaaatgaaaaaataaaaaataacaataatagaaaaggggacaactttggaatcatacagaccagaccagatcagacttagaggatttctgcaatgatctagcgggcaaataaaattaaggaaaggacgaacctaacctctgtccaccacgtgcgccccacagtccacagctgtgagactgcccaccactctgggcccacacaaggttagatagccctggcacccaccaagttccgagaccctcccagacacccccacaacaggataacttccaagtgctacacacagaaaacaccagccctggttcctgggacatagttggcccttgagaagtaattttctgtctcagaaggtgagaaacacatccccaacaggtgtgtcctccactcacagaggcgccaaggatagtgctgcaaagctaattttccttgagatttcagaggtcttttcaaataaaaaaaatggaagggggagataatttaaatacaagggaggctctttttcctggtgttgtgaggaggcaggtccccaggccctggcacagaatcagcaccattttcacagaggtacctggcttcctcttagttaactgtgactgtcggggaacaggatgatactgatggctcaaacacagtctctgaggcatcatgtgcctcaagggaactagtcgagccatttgtttgaattacatgacagatctcttagaatcccttaagagtgagtgtttttcggggcctgtcaggggctggggggcaaggggagggagagcattaggacaaatacctaccacacaaacacacaccacacactcacaccacaccacactcacaccacacaaacacaccacacagcatcacacacaatatacacacaccacacagcacatacccacccaccacacacacatcgcacacaccacacaccacgcaccacacaaacacaccatacacacaaacaccacacacacaccaacacattacacacacatcacacagcacacaccatgtatcacacacacaccataccccactcataccataccacacatacaccacacactacacacagaccacacaccacaccacccacacacatgtcctataccacacacacacacacagacactacaggcctaactccatgaaatgagggctacaggagagtcaagaaacctcttctgtttctatgaacaagatcagtcactgtcttgctttaggtgactcaggaaaccccaaaaggctatgacttcagaaatggggcctcgacaccaattacaatggctagtgcgtgcatgaactagttggtctgcaagtacaagatgtataaatatacaggggaaaaaacatcaagtcagcgacttccgctcctcagcttttctttcctttctaagggcaaaggggtaattccttgcaattccctgactgataagagtgaaggtcaaattgggccaacatcaaggctctgggagtctgcaggagcatgggcatttggaataaaagaaacatgaggtaaccagaaaaaataagggaaaaaattgtagccaaaatcagacaatgcttggcagcagtgagtgacataaggcaaagaaatttccaagcatgaatgtgaccaaccccgtcaacacgtgcagcctcattttctcatcctggtttgctttgggtttctttgataaaatgatggtgatggcacaaagacagtaagctaacaaaggcagaaatgctgacagcaagcattcatcaaggatactgatttttataacgaccctctggagtttacagatgtgacaacaggggtactcagattttcaggatgagaaatctgggggtgaggaggtaaagtgacctgcagtggcggggtaccccactgggcaagatctgcaggcacaggctcccatcatgccaggccaggggacagcggtgacccacctgggtccttaccacatcccacaggcaggtcaccttgctggcctcacgcccaggaaagggggcatggaggtttgcaccatgtcacactgccatgagacagtcaacagcagagcacacaggctgcccagcctcaacaacacatgggtgctggcgcgcacagagcatggggaagagggtttagaaataagacccatggaggctgggtgcggtggcttatgcctgtaatcccagtactttgggaggccaaggcgggcagatcacaaggtcaggagatcgagaccatcctggctaacacagtgaaaccccgtctctactaaaaatacaaaaaattagtcgggcgtggtggtgggcgcctgtggtcccagctacttgggaggctgaggcaggataaatggcatgaacccaggaggcagagcttgcagtgagccaagatcgcacctctgcactcgagcctgggcaacagagagagactccgtctcaaaaaaaaagaaataagacccctgggccaagaccccatgatctcttcctgtgccaggtttctcctggtctccatgcaagggacctagcagacaagcagatagcttaactttgtctactaccaggcagcagaaagtcctcgaacttggaaggtatcctgcatttgcaggaagagcaatcagcacttctcatggctgaaggcatccgcttggaggagtcttctcaaaagccttcaggaaaaaactccattctcaacaccaactccaacctctgaactgaccccgccggccaaatgcaccctcctggtacagggcctccactcgtgccagagtgagcccacatcctagaggtgatgacttttgaaagaaaatttctgaatgcatactttaaaatcaagcttaccaaaccctctgagaacagtgataactcacctttcctggtcatcagaaatgttctgggctgcctcctcggccatgtcctgtgcaagctggtcacaagtatgacagtcagcagaccagcttcttcctacatcctctggaagacaaagaaatagagcttaatgcttccagcttctgtacttgtgacctcttatcaggacacacatcaaacacagagggaaaaatccaaactccagtaacattttcccaagcagaaacagcttttgttttcctaacactgtcagacaaattccttcctaagaagtgtgcttttgacagacgtggtggctcatgtctgtaatcccagcaatttgggaggccaaggtgggtggatcacttgaggccagaagtttgagaccagcctggccaatatggtgaaaccccgtctctactaaaaatacaaaaatagccaagtgtggtggcacacatctgtaatcccagttacccaggaggctcaggcgagagaattgcttgaacctaggaggtggaggttgcagtgagacgagattgcaccactgtgcaatagagtgagactctgcctcaaaaacaaaatgaaacaaaacaaaacaaaacaaaagtgtgttttaggtagggatctttgtggctgcctgaaacagatcactactcaagggagagactgtacatggaagctgagagaagtctgagaataaaaagctgtaactgttggctgggcgcggtggctcacgcctataatcccaacactttgggaggtcgaggtgggcggatcacgaggtcaggagctcgagaccagcctggccagcatagtgaaaccccgtctctactaaaaatacaaaaattagccaggcatggtggcacgcacctgtagtcccagctactcgggaggctgaggcaggagaattgctcgaaaccgagaggcggaggttgcagtgagccgagatcgtgccaccacactccagcctgggcaacagagcgaggctctgtctcaaaaaaaaaaaaaaaaaaaaaaagctgtaactgtccacaactgcactggggaacaggataccttccacaagagcagaagagcattcctaaggaaggctggcaaggcacacactaggcgcactctgtcttacggcagaacctaggaatgatctggttccgaacctcctgcacctctccttgtttgcaactggcgggtcagactgagttctctccattacgaaacattttctcttatatttttaaagcacttgttagttgtcttagttctttataccaacatttaaaccttcagagattttagaaaacttaatgttttactcagaacactagatattttttctctccactctgaagagagtgataccaagaagagtgggaacgttttcaggcacaagctctttctcagatgggaacacagaccccttgaacaatgatgaaccaagctacgggtgtccggccttggatcctgtgttttctggaactttgctgccaatgaggtgagtaaccagagccctgtggtgggttaaggggcctgctgttgacctaacacacctgtctcctggggcctgctgccacctctgctcttctcacactgccttgtcagtgcctctggctttgtccccactgtgcttgttgtgagtaaatctcagatttgggggaaatgcatactttccaatttcattagcaatacactttcaaatgcgcctgtgaccaagaaaaggataaactgcaaactgcagtttgtaaacgaacaaaatcccttctttctgaagcccctgtgatttgctctgacaccttcctgtcaaatctaaacagagtccactgggtaaagacacctgtgcaaccctgcctgctgggctggcatccatacccacacgcacacctggatgctctgaccttgctgctgcctgttccttccttgtggggctggacatcctgagaacagggcctacatttaaagtttgtgatgtttttgaagccagcagtgctaaccaaagatgccaggaaatgaggaggagcaaagaaagtgacataattgagggaagaaatatgcctgcactgccctacgtgggaggcactctcatagccactctcatagccactctcagctactggagcttaagttacttacaattaaatagaattaagaattagctggagaaaccccgtctctactaaaaatacaaaaaaattagccaggtgtggtgatgcacgcctgtaatcccagctatccaggaggctgaggcaggagaatcgcttgaaccggggaggcagaggttgtggtgagccaacttcgtgccattgcactccagcctgggcaatgagcgaaactcttgtctcaaaaaaaaaaaaagaattagctttagcttctccatcattagccatatttcaagggctcagtagccaagatacaaactatacaatgtttccatcattgcagaacaccctcggggccagcgctgggctgggcagcctcgcctttttccgggcagtgcggccagcattgtttcctcagagcagctgcatccagacaagggaggggttcccagttcatctacattcttgggccatactcctccacctggggtttgccgagcactgcactggtacaacagggagcacaacacagaaccaaactcactgcttccctcccgaggacggaggggtgtgctgcttaaggtgagacgtggatgcagccaagcaaactggaaaacgtcgagttttgaaaactgctttaagtaaaaatattctgaataaaattaggtaaatggcttccaaatatggcccattttaagaaatcactatctaagctcctcatttagaaacaaagactcgatcaggattttgactctccttatgaccttgctgaaaggaggaaaaaacacaagaaaaatcatttctttgcatgaaatcaatgtgcaaggacggaaccccctggctggaagagatcctgggaggtctttccctttgtcttcattgttttaaacaaaagccacctccttagaatttgtttttaagccacattctgtatttcagatttaatacttagtttctaaaactgcttcttaggtaatagttcacttagtcaacccctgccttactccacagacttaaggtgtttagtatgcacatagttcagaatgaatacctgaaagtaggtagcactgcctgaagactttcagtagtcaaagtagaaaagcaaacacaggtgtttacacagttcacagtgtaaaaaggcacagagctgcagtttacacagcacagggttcctcctcagatggaaacttcagcaattgttctcacatgggttttcatacttgaagatgtaatagatggcatttaatgatactaagtttcagatttggggaaatattacatttgcaactcaggcaagtgtatacataaaatatacaaggaaaaataacactagaatgatggttatcatgagcaaccaacttcgtttctcaggtttcaatgcaagcccaggttctgatcattatcatctcatcttctgcctgcttcagtttctcacctccaaatggagcttcccgggaaagcacctggcccaccagcatcacttgaccttcttctctttggatgagcagtagcacatgctgacatgtcccttcctagcaagactgccagtcactgtcatttccattctgttccttgaggcagcttgtggacctctactcatttacctttagatattctacatctttttttaattaacaccctatccccactcccagcccacgctctgggtcccatcacactcacggagacaaacacagtgcttgggcaaatttttgtaattagttgtggtgaaaagaaagaaaaattgataagatcttggtagaatgtcaaacttaccatcctttgagctggttcccagagcaggctgcaccaaggagagcaggggcaaggctgcgatcagccccctccaccccatttgcaagcaggctgctccaatggggctgctgatcagcattcaaatcaggggtggctttggggaagtgagcacaggtagaaagcccataaatggaacccgaagcaacagggactggccttgctccgccccatgggctggagcagtgagccttccctgcctccattagcatcttgggacaagcagccaatcataagcaccccctgagaaagaaatctcatgcccagaagagctctggggccttagcctcccttcaccccaatatgcttctgggccgttttctctgagataagtatgtcctaagtgatgttaatttgcagggaaatatgtgtcaatcatctgtgaggctcaatagtagctccactaaagaaaaacaacatagttattgaagtatcatgattttgtgaaaaatagctgagtgccctgtaatttgcagtggaagggcatcatggtacacttttaaagccattgtcaagttagaaaagacaaatttgctatacctgggactaaaagtaggtactctgtcttatataaaatcctcaataatttgaattataaatggcacctctctcttctgtagttttccgtgctttccattggcttcaaaataaaattaaatatcatggcttgatatttaaataccttgataggctgcccccaaatgccttgggtcctttggccacttggagtgtaggggaacataaccataccctaactgttctctctgcaaagtcacatgcagcaattccactgaaggaatgcgatgatcacagtaggaatcatctttcagcactacagtttggtgatcactttgatttttctgtctcaaaagtacattacaaatagggaattgccataaccacctctgcatttatcttgttccaatgcaattgttaagaaaagcataacacatgtattacatggggtaatgttttaggccctcaagcacttattttgagtagtatacaattatccgtatcatctcagcttcctcaccctcacctgcccaccttgtttccatcaaggtgtcctttcgtctggagtggtttctccacactgattatttgatatagacaactggtatttcatgaagtatgaatagaatcctcttaggaaaggactgctacttatgtgagcccagatcgtatgatggtacatgccaaggcagacccaggacaagtcccatggtccctctcagcttccccatggagctgagttggagcaccactgtttctcttggttatttcagacctgtccagtgtgaagggaggcccacctgtcatttgggacaggttaagccaccaaacatctaagaatcacactgggcatttctttctagatttaagactgcatgctccaaaaactggtaaagccccaggtaggagctgctgtgggaaggccaaatttgaactaggtgaagtgttaatgaggaagtccagcatcccatcaagcacttccctcacgagggccccttatgtgctctgcctccttggcagggtttatttgcaaacagtgaaagaagtgaacagagaaaagacaaaaacacaaggtagatgccctccactctgttctggttctcacttctgtctggtcatgtttttcttcccctgtaaggggaggatcctcccccagaaggcttcactagaattttctctcagcaaggaagataaccaaaaagataattttaaattgaaactagtatggtaaaaagtggttagtgtatatatgtagcctcctttaaatttttaaatagcttgaggttagaaacacagggctgtctggtcacaaggtttgagccctaaggtcactggatgatgtcatggtgcgctaagacacgccaaccaaacctctatgagcctcggaagagccatggaagtcacccagtctgcactgtgtgctgccgtgaactggcagcctctggttagcagcgtattttcactgagaaaaaagccaatttttgcttgttttgtttggtaaggcttatgttatggtttaagtgtgtcccctaaattcataagttagaagcttggtcctctgcagtggtgttgggaggcagagcctgatgagaagtgatgaagtcacaaggactctgctctcatgatggcttaatgctgttaccaggagaatgagttgttatcaaagatggtctgcccctcttgcctcctttctgtctcctgcacccacttctgccttgtgcccttctgccaggggacaatacagcaaggaggccttcaccagatgcatccccttaccttactttggacaccccagcccctaaaactgtaattactcttttctttataaatgactcagtctgtgggaatcagctatagccacacaacacagactaagaccgcttataaatgctcacattttacgcttcccaatttagaaacctgccaatgagtaatgctattttctcttattccaaccaccacaggtggtcagcatgtttagtcactgttagagaaactgtctcaagaggctgaatgacttgccccagactaggacgctggaaagagccaaaatccattcccagatcttagggtgtggaattcagcatctttccaagctacatatgctggttatggttgtaagattggttcatttggtgctacaggcgaataggaactagattccaggaaggcggctacattttctcgtgctacccacagggtcatcttccttactgtccagtgatttgtgaagtcctgtgcgtggctggtctctcccaggatcttttagcctacaacttaataactggtcactctgccctcactgcaaagactgttacagacactgattgatcctcatccatgttgggcccatggtaaaaagagatgattctgcaatgtggtgccaccttattgatcgagactccagtattctaaacctggcataacatcaaaatgacaaataaaaagtttaattttctatttatgaaaataaggatgtgctgtgaaaagagtctgaagtccaatgttcgggaaactgtaattgccgagtgaatgtgtaaggcactcaagtaacaaatatttattatttagtcccttaaaaataatttactttattacaaagatagtaatacaatttctagaaaatacatgcatgtacaaagattgaaataaaaaaaacactcataaatatccagatttaaatgtcagcatataccttcctgatctttttctatcatactgtatctatcaacatctaacctgcttttttaactataagtcatacattttgccatatcagtacacttttttctgtaacattatttttagagcatatcaaaccatagtttatttaaccaatccccaattaattcataattagaatatttcgtgtttttccagtataacagttctataatctttgattataacctttgtgtaaattcctataagtattgagtcaaaggagacacacatcttttcaggcattacatataaaataaatactaaactagactccaggaaagtggtatcaattcacattcccaatagcactgtcccaatggggctaatttatctcctttttaatctcagcgtatttccagttataacataccatttttacctcttgattcaacaattgtacttagaagaagctctaaaaatccaaaactgaagcttccttttagaccctccctattacaatccgtatgaaagtacagaattcgagagtgacatcagccaaacggagaagtgaagcttactggcttctctccctaccacataatttcaactagcaaatacccagtggcaagattattgccctgaatatcccagaaattgggagtgaagctgtgacaactcactggaccacagagccaagaaaaaccatgaacagagggtaaagagaatggttctgtttgatcataacacctctcccgcaagcccacatagcaccgcacttggagaatttctctggaatcagtttctacagtgggaaaagagagcgggaggtgggcattcaccttccgcaccattctgagactcttcacaggggcacactatggtcctttccccctggaagcactgcaggtgccagcagggttagcctgctaggtgtaaattagaaacaaagaatgggggtggggctcacagcagtcaacaaacaaatcacagagtggactgcagggaacctgggcttagggcaccatttggcactacacgggctgtagcgttcacgggcttaaagaccaaaaaagacagtatgcttacaatttctggacagacctactatacaaggacaatcacagacaaagccagattgcaaagactgtttataaatacctacatattcaatgcacagatatcaatgtataactacaaagatgaagaacagtcagggaaacatgatgtcaccaaacagacaaagtgccagtgactgactctaaagaggcagagatatatgacattcctgagataattcaaaatagctgtctaaaggtataaaactccctggtaaaaataactcaggaactgataaccaaatgatgatgatgatgatgatcaacccagaggactggttgaattcgttgctcaaaccagagaaaaacactgtcctactaaatgatactattttaaataaattgattggtcattactgtcaagcaattgaagtaatttgtccagatacatataaagatgaaggttttgctcaaattcaagtgagattcaacagctgaattaaagctattcaagagccagatgatgtataagtggctatagcaaactgcaagacatttgcttttgtgcatatatcttctgcacagtttgaaatgtctcaaggtaatttcaaaaaaagtaaacaccttcttcataaagctgtaaaatgtggagcagtaccactagaaatgctgcaaattgccacgcagaattgaaacctccaacaaagtagctgctttcagcgaaggaaaagagttcatcaacattgacaatattaactacccaagaatcattctctagttcattgaacatttacagaataggaacatgctgtaattaggcaattaggcaagagaaagaaaaggcatctaaatcggaaaggaggaagttaactgtctctgtttacagatgacacgatcataagtagagaaaatcctaaagactccaccaaaaaaactgttcgaactaaaaaacattcagtaaagtttcaggatacaaaatctacaaacaaaaactagtattatttcttttttttgagacaagatctcactctgttgcccacgctgaagtgcagtgttgcaatcacagctcactgcagcctcaactccctgggctcaaccaatcctcccacctcagcctcccaagtagttgggaccaccacacctggctaacttttgtattttttgtagagaaagggttttgccatgttgctcaggctggtggcaaactcgcgagctcaagcaactcacctgccttggcctcccaaagtgctgggattacagccataaaccagtatcatttctatacattaatggtgaactatatgaaaaagaaatcaagaaaatcccatttacaatacaattaaaaaaaaatatatatatatatatctagaaataaacttaaccatggtgaaaaatctctaggatgaaaactataaaacactgatgaaagaaactgaagacacaaataaatggaaagttatcctgtgttcatggattgaaagaattatttcttaaatgttcataccgtccaaagcaatctgcagattcagtgcaattcctatcaaaataccaatgacattcttcacagatagaaaaaaaaatcctaaaattcgtatgtaaccacaaaagaccttgaatagccaaagcaatcttgagcaaaaagaacaaagctggaggcatcataatacctgacttcaaaatatgccataaaactaaagttataaaaacagcatggtactggtataaaaacagatagatcaatggaacagagaacccaggaataaatccacacatttacagccaactgatattcaacaaaggcaccaagaacacacatttattgaaaagaaagtacagtctttcaataaacgatgctgggaaaactgaaaatccacatgcagaagaatgaattaaacccttatctcccaccatatacacaaatcaactcaagatgaattaaagacatagatttaagacctgaaactatgaaactgctagaggaaacacaggagaaatgcttcattacatttatatgggcaagaagtttatgaacaagacttcaaaagcacaggcaacaaaagcaaacaatgggcaaatcaaactacatcaaactaaaaagcttctgcacagcaaaggaaacaaccgatagtgaagcgacaacctatagaatgggagaaaatattatatttgcaaagtatacatccaacaaaggtttaatatctaaaatataaaaggaactcaacttaatagtaagaaaacaaataaccctgtttaaaaatggtcaaaagccctctccctctccctctccctctccccacggtctccctctccccacggtctccctctccctctctttccacggtctcccactgatgccgagccgaagctggactgtactgctgccatctcggctcactgcagcctccctgcctgattctcctgcctcagcctgccgagtgcctgcgattgcaggcgcgcgccaccatgcctgactggttttcgtatttttttggtggagacggggtttcgctgtgttggccgggctggtctccagctcctaactgcgagtgatccgccagcctcggcctcccgaggtgccgggattgcagatggagtctggttcactcagtgctcaatggtgcccaggctggagtgcagtggcgtgatctcggctcgctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcctggctacccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccccgccgccccgtctgggatgtgaggagcgcctctacccggccgcgaccccgtctgggaggtgaggagcgtctctgcccagccgccccgtctgagaagtgaggagaccctccgcctggcaactgccccatatgagaagtgaggagcccctccgcccggcagccaccccatccgggagggaggtgggggtcagcccccgccaggccagccgccccgtccgggagggaggtgggggggtcagccccccgcccagccagccgccccgtccgggagggaggtggaggggtcagccccccgcccggccagccgccccgtccgggaggtgaggggcgcctctgcccggccgcccctactgggaagtgaggagcccctctgcccagccaccaccccgtctgggaggtgtacccaacagctcattgagaacgggccatgatgacaatggcggttttgtggaatagaaaggggggaaaggcggggaaaggattgagaaatcggatggttgccatgtctgtgtagaaagaggtggacacgggagacttttcattttgttctgtactaagaaaaattattctgccttgtgatcctgttgatcagtgaccctatccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcataggaaaaccagagacctttgttcacttgtttatctgctgaccctccctccactattgtcctatgaccctgccaaatccccctctgtgagaaacacccaagaatgatcaataaaaaaaaattaaaaaaaaaaaaaaaaactgtaaaaaagaaaaaaaaagagctccatatttacagctgtaatatcaaataaagtgattattttttacaacccccttaacaccttttggagatggcgtttctgttttcagaaattaacgtaaaatcaagaagcaagattccataagctcagaactctggacagctgatcaggtttacctatggtgctttgcctttaactagagtgtgtgacggtagattatttcagatatgtatgtaagactgtttcctgaacaataagatgtatgaaaggagcagaaataaataatttttctaattaaaaaaaaaaaaaacatggtcaaaagacctgaatagacttctcaaaagaagacaagcaaatggccaacaggtatatgaaaaaatgttcaacatcactaatcattaagaaaatgaaaatcaaaatcacaatgaaatatcacctcagtcacctcataccagttaaaatggccattaccaaaaagacaaaagattagctttgtttgggcctttcttggaaaaaaaaaaaaaaagacagaaggtaagtgttggcaaggatgcggagaaaaaaaaagcttttgtatgctattggaggaaatgtaaattagtatccccattaaggcaaacagtatggaggttcttcaaaatattaaaaatagaactagcatatgatccagcaatcccactactgggtatttacccaaaggaaatgaaatcagtacatcaaaaaggcatcttgcactcccacgttcactgtagcattattcattatagccaagttatggaagcaacctaagtgaccatcaagagatgaatggataagcaaaatggacatatacacaatggagtactattcagcaataaaaaagaacaaaatcttgtcatttgcaaccacatggatgaacccctggagaatattatgttaagtgaaataagccgggtacagacagtacacgatctcacttatatttagaatctataaaagcaaatctcataggagatagtagaatggtggttaccagatgcttaagtgtttgggggcagcggggaaggcagatcctggtcaacgatatatagttacagttagataaaaagaactgctgggtgtggtggctcatgcctgtgctcctagcactttgggaggccgaggcaggcagatttcttgagcccaggagtttgagaccagcctgggcaatgtggcaaaacctcatctctacaaaaaatacaaaaattagttgggcgcagtggcacacacctgtggttccagctacttgagagggtgaggcaggaggattggttgagcccaggagtttgagactgcagtgagccataattgtactactacactccagcctggggcacagagccagaccctgtctcccccaagaaaaaaaaaagagctaaaaaccagaataggcaaatatatagagacagatattagacaagtaattgcctggggccaggaggtatatggtgggggagagcagaataagggagaagagaaaaatgaaaaatgattacttatggttaagaagtttctttactgggtgatgaaaatgttctaaaattgatagtggtgatggttgtacaactctgagaacatactaaaaaccactagacagtctattttaaatggttgaattgtgtgatatgtgaattatatctcaatacagctgttttaaaaagttctgaattgttatttcttcaaaacgatggatgctttgctaaattggcaacatacactaagaacatgaatgtcattaaatacctttgcctagtggctgaaccagaatcccaaccccaggactactgttgaggccacattctaggtccccaagagtgggctccttcacaccaggcacagtacctcactataaactcagcctacagacctgatggccaagcagttccctgctgggccaaggaagggctggaggaggatggcagggccacttggatgctagccaggagcaactggaatgggaaattcttaagtgtctctgatatggcacagaatgacctcaaaactcaggtgataaaattcttggataaaaagaattgctgggtgtggtggctcacagctgtgatccaagcactttgggaggctgaggcgggcagactgcttaagcccaggagtcctgggcaacgtacaaaacctcatatctacaaaacaatataaaaattagctgggcgcagtggcacacacctgtagttccagctacttgggagggtgaggcaggaggactgcttaagcccaggagtttgagactgcagtgagccatgactgtaccactgcactccagcatgggggacaaagccagaccctgtctccctcaggaaaaaaaaaaaaaaagctaaaagccagaataggcaaatatatagagatagatattagacaagtaattgcctggggctaggaggtatatgctgcgggagagcagaacaagggagaagagaaaagatgtgcgtaccaaaaggatgtgaggccctgagcccagggcaggtaaggcatgggactgccttattttaccctggcatttaggacagtactccacaaaccacaaattcttataaatcacagccagtgaaagtatgctcaaaatccagaaagctcttttaaaaaaggtctcaacactttgagatgttagtcttgaaataagttaatgtttcaaattatattcattcctttaaatggattaaattgctatttcttgacccggcaaaattttaccttggtagatcattcaataaagcagcactgtgcccttctctaagtctgtggtgttgtaccggctcctgccatcatttttcacagctctttgaggagcaaagaggtggaggacttggtagacactaagtagcaagttgtgataagaatcagaaacagacaccaacttcttgaatctcaactaaggtttctttagccacattctacacaaagataaaatcttaagccattcattaaaatcttcaaaattatatgtatttgataataaacatcacatagagcaaatggttaagtcactaacacattctctttaacagcaatttcagttttataaaactactttcagatattgtttcattttgtatcatgatttttaagttttctcactgcagctggaattaatttcgttacaatgagaggaggaagggtttaaaaattaaaacggtgtcttctaattttaaaatgttaatttaacaaaatattccatcctatttcaacattattaaacataggccaggcgtggtggctcacgcctgtaatcccagcactttgagaggccaaggtgggtgatcacgaggtcgagatcgagaccatcctggccaacacagtgaaactccgtctctactaaaaatacaaaaattagccgggcgtggtggcatgcgcctgtagtcccagctactcgggaggctgaggcaggagaatcgcttgaacttgggaagtggaggctgcagtaagccaagatcgcgccactagcactccagactggcgacagagtgagactccgtctcaaaaaaaaaaaccaaaaaacaaacaaaaaaccattactaaacatcaaaagaatcattcaaatacactggttttatcaaaaaacatgaaaaagccaaaatataaattttcatgttagctagtcttccaatttcattttatcctaagcaacttaggtctcagttttgtaatgtgacattaatataatgtttatggatgggtgtgatggctgatgcctgtaatcccagcactttgggaggcccaggtgggcgggtggcttgagcccaggagttcaagaccagcctggacaacacagtgagaccctgtctctatgaaaaattgaaaattagctgggtgtggtggtgcacaccagtagtcccagctagtcaggaagctgaggtgggaggatgccttgagccaaggaggtcaatgcggtgagccatgattgtggcactgcactccagtctgggtgacagaatgagaccgtctcaaacaaaacaaaacaagaaaacaaaagataatgtttatcatgtccacctccacaggacaatgagatgtaattataataggaaatatgatgggtatgtttcagggagaatgagcacatctaccagtactgaatcagctttgatgttcagaaacatcaaagaaatatggtctcatcacttaacacagatgataccttagaagtttcgtttgtttctactctaaatagaagggtcttctttccagaacgacagatccgatacactgtggaagaaagaaatataaggaattacaacctaaacccaaaactggccccaggaagaaactagttggaatggcagaaggagctcccagctaagagctgtgttggctgggccagctctctaggcatcaagaggggagtggactcaggtgggcttgagtcctcagcaagagagagactccaaatgctgcagctgtgacaccccacagtgctctgagtaaccaaggcagtggcggcggggtgacagaggctgttctttctgtcactgggctccaaggggcaggagcagcggggtgaacacactgaaatgcaagactgactgtgcgctacaggccgtgctgagctagagcctctgcctggagggaaagtaccaagctcccaggcaacagctttacgaattctggctactacaccaagtctaaatacatgacgattttcacaacatcaatgagaaattgttctttaaagtctgaataaataaattctagcttttcttttcagtgtcttaaaaacaaagcaaaacagacatgagcaacatgaagtgatatgtttatccaactgtgtgttgttgaatcaacttttagttaaaatgttagagagggacaaataagtacagtgtgtcgatgtgcggtgctgtgagggcacagaccagtgatcagaacacaacacctgcggcctctcccatcctgacaaagtctctgcatgccaactccagcgacagggtgctaggacagcgcagggatgaaatactgaagggacacgtcttcatgaagcagatcaaaatgcaccatcttgttattcacaatatctgggaagagaaaagccatgattttagagacctagtgcagcacacacattttgatctctactttttcagaacagccttcccagcctgcacctcctgttttaggcatctgtcttccctgaggcagctgcagagaccacagtctctcactctcactgccacagctgaggctacatcacggccccagcactggcggctccctgtgcgaggagaggaaaagtgaagcggcccaagcccttggcaaaacacccagcaggctggcttcctggcaaaccacattcacccacatgagcatccttctgcagcgaagagcagctcctcaccagtgagtggaggaactgtgctgagaagagccaagagccaggatcccccaacacctggggcaggctgtgtcacacactgctacatgggatggatccctgcatctcaacggtcctgccaatcccgtgagggccatgggtgatggctaaaatccaaggcatcaggcatgcaaccaagcagggaagtaaagagcacatgagggtgggcaggagcacacagtgtgacaaccaccgagagctcggggagctgcagcacagcagccgaggaaagctctccagcagatatgagtgagtgacaagaaaccatgtgtgagcaggctgcagagaggccaatcccaggagatgggaggttggggaaaggaccagaaaggacaagcaggagacaaacattctttaggagaggtggtgcaagggcacaggagaggcagagactgagggtggcaggacctagctagaggaggggacaattgagccgacacctgaaggagactaacagagacagaaaaggggctttgggaagttaagaaggtatgagaagttcaacccacggtgttttaaaaaaaatttttgctacatcacaatttgctggtcttcctttctctgctacacgtggagacaccaaagtgaatgttgggaagacacttggcttagtcaaccacctttgataagaactcttccatgttcctcaacagccttggattcagaaagtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatcgaggttctcagaagcacctttaaggaccctgcactgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaaagggctggtccttgacattgccacctagaatcttctgttccttctctacagcacactgcagatctgaaggggatgaggtgcagtgttggctcaacctccctctcagctcagcctgggagctatgctacaaaacgtggaacttcaaatccaggatgcagtcgcttttaggttgctgtgatttcagtagtaaggtgacaaaaatgccttgaaaagctcttggcaggtaatgcctttctcatgtgtggtcagtagatgaagagtgctggagcaggtgtgtgacctcacaagatggggcccagccagaatcaagaggcaactgttaacaaccagcagccaagggacagatatggggcagcgaatgcaggccagcatagccacagaaaggaaacaagacatcacaagggaaaacttaaatccaagccaaaccgtgtctggcactctgagcaggtcaaattagatgaccatggagaaggtgggatgatctgcacccattctcccgatggcatctccaggtgtgctggccaactgaggcagcacacaacccacctaccaaccagtgtggctgcaggtttcaggccctaacagagtgcccaggggttgtttctctgctgccaccttaggtacttctgaatctaggaaaatttaaaaaaccccactgttctaggaagttaaagtccacataattgagcttttttttttttttttggatttatgagactatatgcaatctgttagactagagttgactgcagtatttagaatatgaaagaatatgaaaaacaaaacagagaagcacactcactgcataaggcctttgtgggatttacttgttgtccagcaagaaactgtaggagcttcctaatatctatgtgcacttcagccatgtgttccacgtttctgtcctcatgggtgctttcagaggctaaaatgataggaatgcatttaaatacaacatcttcccacgtaacaggaaacctggagatactcaatgcattttacttaaataaatgattcactttagcactgattttagcatcctgaagaaatattgcaacttgtaaatgttgtcattcattaagcattaggtcctaactatttaaaatactatgataatttccaaggcatctttatttacaggggacttgaaatataactcaatctccctcttcaggtcaaagaaaattttatttatttgtacttactatgtattttaagagtgaaaatatatacattaactaatacaaggcctgtcattctggagtggaattaaaaaaaaaaagaaaacatcctttctacctctgagaaagtaccaaagataagtcccaccttatgtttattaaaagaaacaaaatgagtgacatcagaatgaatcgctttacacaatattatcaaaggcataaccgtatggatttcactctgctggagcaggatgctcttaactagaaagtaaaaattccttccaactctatgctaaaatctgtgtttatattcaagcagactcgtagtaacttaaatgtgactagggccgattttattggttctggcacacttatgtatcataaaatgattttctcatcatccccaggtgtttctcccctggtcctttacctgctttcctgctcaggcagcccctgctactgtgcagctgccactttccagccatgattctaaccccctcttggcttataactcaccaaactgtccaaccgtcccctctctccccacttgctgaactgactctatcgtcccttattaccttgtatgagataagaaatgtgatcaagtgaaacagttttgcatctgctacactaatttcatacatatggaagtaactgaaggaggagaatataagaacaaatgtatctacctttctgaatccatgccaggtgagaaatagaaatctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacatagtccagtctcaattcctttgttcttcacccaagcatgaaacaaagtcaactgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccatgggcaacagctttcacacaaccagatgacaaagtaccctacaaaacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcacagcaggagagagtcctgcactgagaaggaaccacgggaagtaagagcctcaactaagcagaatgggcaccttgggcaaaaaaaagggaatgaaactttaaatgaaggaaaaagagggacagatctcagaaagtcctggggatgtggtgaggatgcatgttttaatattttgtggttacaaagaatagagaattctagagtcattaaattagaaaactattttggtccactttcactcctacaatgaaacttcctcctaaaagaaccagaaaaaccagccgggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggcggaacttgcagtgagccgagattgcgccactgcactccagcctgggtgaaagagcgagactctgtctcaaaaaaaaaaaaaaaaaaaaaagagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactgggatggaaaggagaaagataaaatttaccaaacagaaacaaagagttaaaaggatctgacagaaaataataaagacagtggagaagatccaagccctctgagtcccagaagaaaaacaaagcactggaaaagaaatgctatcaactacagctcaaaactttcctgaagtgaatgaagagttcggcccacatattgaaaggacacaccacacacctgggaaaactgaccccggatggtcaagacaattggattgaaagaaaaatgggaaaaatccccagggtatttagtccccactttcaaatgaataaatccaagctgtgaaacaaaatcagaatggagtcattctttttgatagcaataatatacaccagcagacaatgcagtgcagtgagccaaactgacattataaacacatgataaccaatgaaatcctattcctgtgagtccttcttgagtgatatgctagagaataggcttttaataaccaaaaaaatcattggagaagttacagcataaacagtgtgagccttattttgacctttagaaccaaaactaaacaacaggaatgaagaggacagaataacgtgtagtaataaaattttatgctctgatgatgtagacataatataaccattacaaaacaggaagggggaaaatgagaagaatgtggaaatcagtgtcttatttttataaaatataaatcaaccatttgtcataaacacacatttaatatgactataaggccttcagaatctcatgagaacatagccatttatttagaaaataaactcacatgttggaaaatgaaatgtccaaatccagaagggtctggggctgctgttgggttaccaggactgaggatggctgagccaaactccacacgcccaggctaccagacttctgccatcccctcatataccatcgggcacccctcttctactcctgctcttgctgcccggggactgtctccacaggtcacaagggactcctttcctttgaagctcctctacccaccccaacaaccaatcagttcttttaattggatggaacctagaagtgaagcatatgccacagtatggtttgaggttttgctaacctatcctggtccactcccgcacctacaatgaaatttcctcctaaaagaaccagtacctgttatttctctttttgatgttgatatctgcccaatgttaaagcctaggaggtctctggaaagccagtgtgtagtctgctggatagcattttgccatctagtactagaaaagtgccacctagcaactggtcttatttagggccattccatcctcacagtgtcacagaaagaaaacagagaaggcactctgtctgcacggctctgtatcagtgttcatgtttactgaatacaatttagtgttccttgttcttattccttaaaattggtgaactctgaatagttttcattccagaaacaaagtttttctaatttgggtgagctcttatttctgagcttttcacattaatagaaaaatagtgccccaaacttacctgttgtataatctactttgaatgagaaatactcattttcaacccttttctttcattaatccaaaaaaatatattgttatatttcctaacccgttttcctacaatctggaacaatagttgactgaaataaaatatataaaacaatctttgtgaatatgctagactgcttagtggggctaaggctaacacatgaccttagctcatttgttccaaacaaccacacacccaagatctgtaaattcccattgttttgaaaagcaatggttttagatataaataaataaatacttacttaaaaatgcaacttgcaatgggcctagatgcacttcaggcttaaatgttctcttgtgttttcttcaaattcctaagaatctcagtaacagaacattagattccaactccctcctaaccattaacacctggtgcctagcacatggtggccttaagtcaatacttactgaagaaactaacaaacaactaattctctgaacactggtcactcatgtctattttaagattcagttatttgggatattatacacaacaacacacttgatttcttaagtatcagggtaagatctttcaatgatttccttaaaatagtcaactattgtttatagaatgctgactatactgggcacctagtaaaaattatctctaaatttttaaaaactgacgaagcccctgtcatagctgcactgttatccccatttggggtagtatccagcactagggtactcactgcacagcgcagcctggagctgaacccaggtatgtggctccaatgactcccctcttccatatcatgactcctaaacatagactctggtttctatcattaggtgaccctgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggggcagcttttcccatgctgttctcttgatagtgagggagttctcatgagatctgatggttttaaaaatggcagtttttcctgtgttcttctctctccagctgccatgttaagacgtgccttgcttcccctttgccttctgtcatgactgtaagtttcctgaggcctcctcagctatacaggactgtgagtcaattaaacctcttttgtttataaattacctggtctcaggtaatatctttttagcagcgtgaaaacggagtaatacaggcacacatcacaaagtactgctacatgatgtggtctgaagacaggcagcatcgacatctcccaggagctggtcagaaacagagcctcaggctccagctcagacctcccaaatcagaacctgcactttaaccagattccaggggattcacacgcatggtagaacttagaagcaatgtcttagaacatgatgtcaattccctccagttcttgcttctttttctgctcctgcatgagtcacatacaacccaccccatcagtcacacctcgcatttaatgaaaggaagtaactgggcatctctaatgggaaggtgggcatttttagtgtgttaagtctacccattttccttaattctactgcctgtaatattcagatacagaattctggatacccaggaagacctcattatgtactttgctacagtaacttgataactttccatttagtaattccagatcgtagtagcctctccacaatatttctatgtttttttaaactccaaaaaagagaaaacaaaacacctctgatgattctaagctacccttctacctctctaccttgctgactcattttcattgaacagaaagaacaaacaaatgccatccttcaattaacagccctgtcttttctctcctgggcctctctgaatttctctggaagtccccagggtatccccagatgaagccagcctgacaactggatcagcatcactgcagtcacaggtgacaccaacgtcagcacagtgcacactgcttcatggaaaacagattttatagattaagttatgaaggaaaagctttgagttacccaggtccaatgacagcattgctcttagtgtgcagaactctagaaaaaaacagtcaaatgtacattttctaggcttcaaaatacttttgtgatttcaaagacctcttgaagctaaattttgttccagatccatgcaacacttattgctgcctactgagtggcaatcccacactgggcagctgggacacaaagatgattaagatggggtttcctttatcaagaagctggtggttcacgagaccttcagagatcttagcaggtgatttaccatgtacactggacagctcagctccatggaggagcttccagaggggtggtggggaaaggtctgtgatgaagcatgagaatggctaagtgccttccagggagatggagagaagaagccatgtgtcaaatggcaaagaaactgaacaaaaaagaagaggcattgtgggggaataccagaacccagcctcgttctgcagggagggtgtggcaatacaacagagatgtggctataaaggtggcctggtacactgtcaagatcaaaagtttatgcttcatcaggtggacagtggtttttagaagattcagggacataaccaagggtgttttttggagcaggataggagggagcagggggaggagggaggggcagtgagtgaaggaagaattcacaataaccccaggtatgaatgaggataacctacacatttcccaccactgtcacacactgtaacatttcgagccatgtggccataggagacttccacaaaataaacagaaaataaacagaaatataaaagtgccccctagcttggtgtgaggtgtgcttggaataaaggctgctatggtgtggcatatctttgtccctggctcactgaaagacacttggcacgcagacaggaaactccaaactcactgtcagtcatatcagtgactcacagaaaaatacgggcacgttagcaggtaaaagatacaatgttccagccgggcgcggtggctcacgcctgtaatcccagtactttgggaggcctaggcgggcggaccacgaggtcaggagatcgagaccatcctggctaacacggtgaaaccccgtctgtactaaaaatacgaaacaaaaaattagccaggcatggtggcaggcgcctgtagtcccagctactcgggaggctgaggtgggagaatggcatgaacccgggaggcggagcttacagtgaggtgagatggcgccattgcactccagcctgggcgacagagtgagactctgtctcaaaaaaaaaaaaaaaaaagaaagatacaatgtttcatacaaaatataagaggaaaaacaggcagattaaaggcaaatataaaagctttcctcaaagaattagagttgaaaagtattggaataggtttctaaatccaactagcaatctgcaggttctcagcaccaggccaggtcctcataagtgggaactcggttaggaggtgcccacctgcatggactgctgcagggtgagctggagaacccacgccgtcccaccaaatacttcagagttcttttctaaagaagttgtgacttacaaggtgattgctgatgtttttcattttttccacaacactcttcatagtcttcaagactggtaaataaatactaacctacaaaaccaatgagaaaaaagcacaagtattaaaaatattaatatactctagtaatgacaagggccccataactaactctagaacacatgcatgctcaaaaactatgggatactattttacaattttctgaataaagttcttttaaaaatataaaaagaaaaccaattctatttcactaactcaaggatgctcaagcaaaattaaagaatggaatgcctgcctctggttacctcagcaaccatgtccctgtgggcattcttttggctcaagaaggaatagggtacttcagctgagatgcccctatattggtccagggggaatataactcaggcaatcagcaggaggccctcctctaagggacatttacacctatgattcaagggccttttccatgctctgtacaaaaacatggcagacagtcactgcatcacatctgagactgttaccaagagtgctctataaaacacaggctttttcaaaatcagtgtaggtgccatctagtaaaagtcaagtaattattttacccagcatatttctgtactttcttcttaaacaaattgtgagcaagaggaaatgggccctttggcatcatctttactttcaggagctctagggttaaccatcggcatgaccgttaccccatgttagccctaagccatgaaattcttctcttcttggctttcgtgcacatccagatatcgctcctgaccggctgaggaaaagatcaagtcctgtgaaacccaaattggtgtctaaggccaagaatactaataaatactaattgtcctccaaaagtatcatttgtgttttaagtgatgttactgagcgagacattttctacatataggatggcatgacatttctatcatatgcaacatttttaagatgctttatgtaaataacaaaaggcaaataatctaatgttttcgttaagtatcctttaaaaataaaatatactgcaagactacaactaaaactagagaattcaagtcatgccatttaatgtggggtgtacagcaggactgcaggcatcacctacatcaggatctgggaccaccggttcttgtaagtccttccacaatttcctaggaatcacctttatggggatgtcatgggtcacaatgcggctactgcttgacatagataactgccaagaaaagaatttaaaaatatttttatgttgttaatattaagcaacaacaaaacaaacccgaagacccgggacaaaaaagttgaaataccaaatctaagtggaatgctgtcagtttattcactcaaaagccattcgaccaatattgatggtgccaatatttatggaacagactctgggtacttccaggaactgggaagtgtggtgataagacaaaaaggtccttagtgttccagtggaacaaacagatcaataaaaatgcaaacaaatgaaactgtatgaaatgctcattatagccgtgagaaagcactccacagagaccagggtgagtgtgggggagtttccttagactgaggaggtgacatttcagataccaccaaaagcaggagaagcagcagccatgggaagacaagaacaaggggacagggtttcaggctggggaaacagcacatgtaaagccgtgaggcagaaagaagcaagcctgctatgttgacgcaaccaagagaaggccattctttgggcataggacactcagagtgctgcagtttctaacagttaaaaggcaaactatatttatttctaggggctcctatgagactcacagaccaaaatatcttgcacttttggacaaaaagtattatacgttactatcttgcttttccttaagcaatagaaaaaacataccaaacttatactgtgacatgaaatgccctaattagctctgagaactgcctgactgcaaagagttgagagttatgaagaaaagctgggctgggcgccgtggctcatgcctacaatcgcagcactttgggaggccgaggtaggtggatcacttgacgtcaggagttcgagaccagcctggccaatatggtgataccccgactctactaaaaaaatacaaaaattagctgggtgtggtggtgggtgcctgtaattccagctactcaggaggctgaggcatgagaatcgcttgaacccgggagatggaggttgcagtgagccgagatcgcgccactgcactccagcctgggtgatagagagactccgtctcaaaaaaaaggaaatacgaacctcattctatgagtaggaagagcaactctggattgtatgtatgcgcatgagtttgtgtatttgtgtgtttggaggacagctgtgcactaaattcatctggcagtagcatataaaacatacgtgtactgaagaacgaggggccatttaaaggttattatagcagatgaggcagggtgggagtggggagaaaacatgtcaaaggtgaaaatggatagagaaaccatgatttctagacaaggtgacaataccactacaagaaacagagaggctggaagtttcacggcttggaaaaagcagcattctagctgaatgcatatgataacaacacaattttaaaatgaggaggaactgactctaatgcaaaatatagttatggaccagatctttaaatttaaataaaccaaacagctttcaacagtatttattgttaaaaaggctaggctaactatgtctattccttcgaggccaagacttctgtgttagaaaccctgactctcctactcaccagctccacggagaccgtgaggcagggaaagtgtttattagtcagtttgattttcaaagccctggcattctgggcagtcttcaaggctcgagataagttttccgatgttagctctaaataaatctcattgttttctgcagagacaccctccatttgaaattcgttgaagaagttctcctaagggaaaaaaaatgagggatgagggagggtatatgtgatctttccagtgacaatctgcagagtgtgcaggcctctcagaagcttttgctcacctgttccagctcacaccacatgctcactcctccattagccagcttgtcacaaaggatgaagttaagcttatcagggctgatgcggagggtgcaggttttggcaagcttggctatcatgttactgattcctaaagcaggggttaaaataaggaattactaaaatgcacattatgtatcctagagaccaacttattttgcagaatttcttgttcatcaacttctcggtggaaaaataaccacttaacgttggtatcacactggaaagtactttaatacccctgatgtcacgcaattctcccaacaaactaggggagatgtacagcacacatcatcagtgttcaaataagaaaacaggcacctaccagtcattcattcattcaacatggatttattgactactaggtactgcaatacacagttaaatgcaaggttaggcactgtcagggtggagggacgaatggggccttgaaggtatgtcaatgcctgataaagccgtctatgggagcagtggccgcttttttttaaagccacgtgatcggaatcaagtttcagaaacgtcccttgaaagccgccttcatccccacaagtgccctccgacccgccccgcgccctcccggccccaccctcccgcggcctacaccagcacccccatcccggccccatcctcccgcggccccttccggcgcccatccccgttctgatcctcctgcgcggtccccaccgcgcgctcactgcttccttccgttcctccctcgctcctctccggcctccctgctcacgtgtgaagtggttcagacaggccccgtccacgatcttggcccgaaacttcatggccgcggatggcgcagccgcggcgggcctctgtgggtaacagaaaagcgtcgcgccctgagtgtccccgcccggaaacacggcagcgcgaacagtggttccgcccggctcgggctacgcgactcttaccagggttatctccgggccacgccccggaggaggtggggctagggggtcacgccctagaggaggtggggtcacgggtcaaggatcacaggtcacgccccgggggaggtgggggtcccagtctccgggtatgcctccgcgctgccgggtaatggtgggatctacttttagtgaggcggaggcttcaagccccagattcggggaggttgttctgagaattcacgttttgaaagaattttgtgacacctatttcaagtgttattttaaaatatccaaataaaattaatcgtttataaaggttaaacaatattatcttaaatatacctaaggtagagcagctttaaaccctccagcctcagatgacggtactggtactttggtattgaagcatcttggtggattaaggttctgaaaattgtttcaaatgacttctaaaaaaattgaacatattactggctagttggtaaagtcgggaagcttaaagaacactgacgttaagtgataattctgcagtttgcctcaagacgaactttattacatccgataaaattcttattagcataaataatgtcattaggattttttttaaaggaaaaattttaaagggggaaatgaagcaacaattgtatctaatttggtttttcaaagactaaagattatctgtgttaacaattgttatttttaatgtcctttgcaaatagactagaaccttgtctttaacttgacacatagaatcaagataatgataatgcagatgatgatgatgatgattttgagacggagtctggctctgtcgccctggctggagtgcaatggcgtgatcttggcccactgcaacctccacctcccgggttcgagggattctcctgcctcagcttcccaagtagttgggattacaggcacaagctaccatgcccggctaatttttgtattattagtagagacggggtttcgccatgttggccaggctggtctcgaactcctgacctcaggtgatctgcccacctcggcctcccaaagtgctgggattataggcgtgagccaccgcgccaggcccagataattttcaaagacacatgcacacatatgtttattgtggcactattcacaatagcaaagacttggaaccatcccaaatgtccatcaataatagactggataaggaaaatgtggcacatatacaccatggaatactatgcagccataaaaaaggatgagttcatgtcctttgcagggacatggatgaagctggaaaccatcattctcagcaaaatatcacaaggacagaaaaccaaacaccgcatgttctcactcataagtgggagttgaacaatgagaacacatggacacagggaggggaatatcacacactggggcctgttggggggtggaggcctgggggagggatagcgttaggagaaatacctaatgtaaatgatgagttgatgggtgcagcacaccaacatggcacatgcatacctatgtaacaaatctgcacgttgtgcacatgtaccctagaacttaaagtgtaataataataaaaaggtgcaaaatacaaaaattgcagtttttgcctattttaagactataacatgaagcaaaattctaatcttcattgtcatatgcgagtgtttgccaaaccaaacttaatagatcactttcaaagttatgccaacaggcagggcaggatggctctctcctgtaatcccagcattctgggaggccgaggcgggtggatcatctgaggtcaggagtctgagatcagcctggccaacatgatgaaaccccgtctctactaaaaatacaaaaattagcccggcgtgatagcttgtgcctgtaatcccaactactcaggaatctgaggcaggagaatcacttgaacccaggaggcggagatttcagtgaacagaggtctgccactgcactccagcctgggcgacagagcgagactccgtctcaaaaaaaaaaaaaaatgttggcataactctttttttttttggagacggaatctcgctctgtcgcccaggctggagtgcagtggcgcaatctcggctcactgcaagttccgcctcccgggttcacgccattctcctacctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaagcgtgagccactgagcccggccatgccaacattttttatttgccccatatgatctgcaggaaaaagcctgttttttaatttcctcatgaatgagttttgaagagttgagcatcacattaaataaagtggctgctagtagataaatgaatataattaaagaatgtatctaaataaactttgtaaacaatgttttgtaacatcttgatctttagtgtaaattgcttaattttatgtcataaaaactgataaagcaattttttaaacttcctaagaagatgtgatatgatacattctgcatggacaaaagcccaaataatataggaatttgactcaagaaatagaaaataaagctgcaattatcttttcttggaagaagaaaggaatcttttatgtgctcttgcaattttcttaaacaggtttagcaaattaattcattaacttcagaattgacaattaagtatattgacactacttctctactttccaaatgattttgaggcaaggaatgtgatctctagagatttctagaagccccatgtaccactgagttttctaatgcaatgtatattcatgttctcatctagctacagtaaattgccttctgacttaagaactgccaaatgtcagggattagtaattcagtcacacaatgatttgggaaacagtgttcacgctgttcattaagtttgtttagtggggaggtaaatgccttaatcttgtcttagaaactgaaataaacagtggtgcaaataaaatgtcattcaggatgcatatagttggaagtaagggaaataacctctctacagctgcagatggtaaactctgtctaggtaagtatttggccagtctctttcaggtacttactcatcttctctagtccctgggggaagagacagcaatttgcagccctgttgttagcagttaatgttggaaaaattacccaagggaaacaacgtgactagctcacatgttacgcatcaaatttgaaaggcagtatttgtcttctttttttaacatgagaaaactgtaaaatgaaggaaagcataccctagaggtggcatgagtgaatgtcttttgacaactgtacttgttctaagagatgggtttttgcttaagcagctcttcaaagactcttctcctcttttaggtgtcaaaaaaattcttcaataaattccatagatacttttctaaatgaagatttgtggagcacatgagaagtgtcaggcatggtggtgagtgatggggattaaggaaggggaccagcccctactcaagaggagggtgatcaacatttattggatgcctttaaagcactatttaaatattattgatcagtagggtgagatagatagctctcattttatagcactctgcactgatatcatcacttagataatataaacacacgtaaaataagtatgattattcccattttattttattttattttattttagatggagtcttgctcttgttgcccaagctggagtgcaatggtgcaatctcgactcactgcaacctctgagtcctgggttcaagtgattcttttgcctcagtctaccgagtagctgggattacaggcacctgccactacacccagaccattttttgtatttttagtagagatggggtttcactgtgttggccaggctggtctcaaactcatgacatcaggtgagctgcctgcttcagcctcccaaagtgctgggattacaggtgtgagccacaatgctcggcctattattcccattttaaagatggggacagatagaattggcaatgttggccatggcatgccctacctcacactcttgatgagaatctgcatcactggattgctgagtgtccagtgacccacatgctcctgctgactggaccagctctatttacacttgaccttcaggaaaacaattgatagtgtggaaataaatgaagaccaaccaaatggaacaggcaaagcctatttattcagagtcagccattatcacttgcatttcagcagagactcaaaggcaggcagagaggtaggaacgcttcatagtggaaaaggaaggagagtatagtgaagtaacagaagaggttacagagcatgtttatttaccagctaaagctaaagtggcaaaggaaggagaggttcatccctacccttctgcacccccttatttcctcctgggaaatattactgatgaataacattttatatacggcattttgcacatggtaagttttttagtcaaaggatatattcatctcgatttttatagataggccaagttccctccataaatgttatacctatttgcatttcttccagcaacgtgtgagagatcctgtttccccaaagccttggaataaaacattatcaaacttttggatctttctaatttcatcagtgaaacatggtacagtataatttttgccatttttcttaagtaaataagcttgaatatctttcatgtgcgtctctagatgatctgtttactggccatttttctattgggttattgatattataattgctttcttgggactgtgtatatattggaaagattggtccttataatgtcagttgtgaatattttttgcattttaagttttgttggccatgcagaggttcttgatttttatatagtggaattttttttcttttgtggcttctaaattttgagtcatatttaggaagaccttcctctattcaataccatacaggaattatcccaagtttccttgttaatatttttatggttttattacctacttgtatatattttaccatactgggagtttgtcatattgtaaagtgagaaatatggatggaattttattttcttaatgactggataattgtcccaagccatttgtttttttcccccatactcttttgagatgctaccattatcatacacccaacttccacatacatgtaaatatatttttggacttgtctgttgttgggaacaggccccccaaaatctggccataaagtggccccaaaactggccataaacaaaacctctgcagcactgtgacatgttcatgatggccataacgcccacgctggaaggtggtgggcttaccggaatgagggcaaggaacacctggcccacccagggcggaaaactgcttaaaggcattcttaagccacaaacaatagcatgagctatctgtgccttaaggacatgctcctgctgccattaactagcccaacctattcctttaattcagcccatccctttgttccccataaggaatacttttagttaacttaagatctatagaaacaatgctaatgactggcttgctgttaataaatatgtggataaatctctgttcggggctctcagctctgaaggctgtgagacccgtgatttcccacttcacacctctatatttctgtgtgtgtgtctttaattcctctagcgccgctgggttagggtctccccgaccaagctggtctcggcagtctgttccattggtctatctgtttgccagtatcatacagttttaactattgttttatacctatgtcatagagctatttctttttgttgattttttttcagagatttttctggctgtccttttgctaagtttatatttccatatgaactttagaatcaattttatttaaaacatacccccctttgggtttttaaaaatatatacatgtcttaatttttaaaaaactttttaattgaaaatatcgaacatatataaatctagacagaataatataatgaagctccatggactggcagcattcaacttcaatgatcatttcatggccaatctttttcatgaattttcttatccatttcttcctcttatgttattatggaaaagatcccacatatatcatttcaactttaaatatttaaatatgtaaataaaaagatttattttaaaatcatcattttagtaccattatcatacagacacctataatttatttttttcagacagggtcttgctctgccgcccaggcaggagcacagtgatcatggctcactgcagcctcaaattcttgggctcaagtgatcctcccacctcagccttccaagtagctggaactgcaggtgtgcactgccatgcccagctaatttttttatttttaatagagacagggtctcactatgtcacccaggctcatcttgaactcctggagtcaagcagtccttctaccttggcctcccaaagtgctgagattataggtgtgagccaccgtgcccagcccaaattattttttttaacgataattctttaatatctcataactgtcccataaagtccatatttttctgctttttaactgagatcaagttacatttataaattaacttagaactgacatcttgacagttgagttttcccattgaaggatacagtatatggtacatctatttttccatttattttactgaagtcttctttttttttttttctccagacagggtcgcccaggctggagcgtagtggctcgaacacagctcacttgaagcttcaacctcccgggctcaagtgatcctcccacctgtctcctgagtagctgcaactacaggcatgtgccaagacgtctggctaatttttaaattttttgtagggatggggtcttgctgtgttgcccagactggtctcaaactcctgggctcaagtgatcccccaacccttggcctcccaaagtgctaagattacagttgtgagccactgtgcctggccttaagtcttcttttagtcattcactgctgtttgggatttttttcacatagatattttactttcttcttttatttgatgtttattatctaaagataataatggattttgtaagttataccctgttgtttttatgaatgatattgatttatatatgggaattttgcatccacgaacttacaacagtttttccttgtttctaattcttttaaaatagactctattgcatttcaaggaattcatcaaattatctgcaaatggtcatggtcagaactcctcactaatttttacctccaatttaaaaattactggtttcctatctaattgcgctgaccagtgcctccagatcagcactaaatgatagtagtgatagtggacatccatgcctggtgtaaataaatgagtccgtgaaggcaaagatgctattatgggaaagactgatgatgagactatcttcttctaaatacaaaatgagttttcaatgctctaacaacatgaagcatccttaaagactaaactatggcaaggatatttaatttacttccatatttttttattagtaaaatgcatttactttttacaggcaagtatgaaccactttgaggttttcttcccactcccaattctcaattcctatgggtgcggtatcatctaagagaataagcattcttgaatattctggacatgtggcatggccttctgtaccaactcttctagatgtgcttgcctggtgtgccatggaccctgaatcgatataaacaagtatacttcgggtgtccccagttgctaaagatattaagtttcacacataataaatattcagaaactgcatgctgaaaataaagaaaagaaaatcaatgccttataacgaaattcatctcaaagaatcccaatgaatactgatataattttaaattatatactttttttttttcgagataggatctggctctgtcacacaggctggaatgcagtggcatgatcatggctcattgccacctctacctcctgggctcaagtcatcctcccagctcagacccccgagtagctggaactacaggcacacgccaccgcacctagctaatttattaattttttgtagagacagggttttgccatgttgcccaggctggtcttgaactccagggctcaaatgatttacctgcctaggcctccaaaagtgatgggattacaggtgtaagccaccacgcctggcctatatactttttcttttctaacataactattttcaaatatcagtctaatgaatgagaaaataagctactggaataaagagcttatgaaaagataagtagagggagaggaggataatatggcggccaagtgacctctctattccgctgtttcccccctctacactccttgctggctgtgccgaggagcaggggcaagagggcttgttgtctaaaaaccagaactatgaagccaactataagaacagataatatgagcccaaatgcatatgaatacataatcaaatatgaagctctacaaatatgctcatttctaacatatatgtattgttttacctttattttctcactatttggccaaaaagtgtcataaaacacttgtttttacatgatataaaatgtcttctacatctcttcagttactccctgtggctaatttaaaaaatgaggatatatttcatttgccttggtgagtttcaggggatttataagctaacagttgatattttctcccactgggttaggagttttacttgtattatctgatattaaatctttatcctctattcctttgagcttctctctgcctctgtccacttcatattgtaccatcatcttcctcccctatactcaagcaaggtgaggtagtaactattacacttaatagtattcagggaatggaatagttaagaaagaaccaagaaattaaatatatatattataaaaaagtgatagcagatgaggaagaatttgacttagaaactgcttttgcatttgtctgtcttttgcattaaaatcctcgtaagcacttcgagctcagaattgaagatcagataagccttgtgtaactcacgcttttgtcataattattctcatacgtcactttacatgaagcaatcccaacaaatttctcccagtgatagagctactcatatcatttcccagagcatacattacctggagttcaaatgtttgaacggtggttcctgttttgttatatataaactgacctaggaaaatttcttctccttcacatttttttgtgatgccctataaagaaagcaacagatatagagattgtaatgaatggatgcagttgtgttttcaaaaagaaccaacaattcaccaaatatctctgtgtgtccaccaggggcacagtgctgtgatcatgccagtactaacctatacacccagaggatatttaacaaggggtcaatgaggcccaaggctgatcacgggactgactaaaaggatagaagatggatggacacacagacagatagatagatagatagagagctagatagatagatccatagatagatagttagaagatagatgattgacaaacagctgatagatggaagacagatacatacatatagagcaaatcccaacattaactttgacctgataactatatttgcaataagcatactttgaataaaataaaaatgcgtcgccatactgaactgatgtttaccaaaatgagataaacataagcccattgccagattttgatcacacaaataatttcctctgaaaagtaagctcccgttgactgacaaaaacactgatttttttctttgtatgcaatttctcttgtgctttttgttcttctctacccttcaaattgaagatttgtgagaggataacgcactggtgcaaactaatttattttgtgaatctgaagtttattgttaggttccttaaattgtaacacagcaaaataaacagtacattcattaaatcattttataataaaaatattaatatcaaactataacatttttattaaaagagttggatacatcatggttacataatgtactcacaattatatatgtatgtggggaaaagagagatcagactgttactgtctctacgtagaaagaagtaggcataagagactccattttgttctgtactaagaaaaattcttctaccttgagatgctgttaatttgtaaccctaccccaaccctgtgctggctgaaacatgtgctgtgtcaactcaaggttaaatggattaagggctgtgcaggatgtgctttgtcaaacaaatgcttgaaggcagcatgcttgttaagtcatcaccactccctactctcaagtacccagggacacaaaacactgcggaaggccgcagggacctctgtctaggaaagccaggtattgtccaaggtttctccccatgtgatagtctgaaatatggcctcacgggaagggaaagacctgaccatcccccagcccgacacccgtaaagggtctgtgctgaggaggatcagtaaaagaggaaggcctctttgcagctgagatcagaggaaggcatctgtctcctgctcgtccctgggcaatggaatgtctcggtgtaaaacccgattgaatatcccatctcctgagataggagaaaaccgccttagggctggaggtaagacatgctggcagcaatattgctctttaaggcattgagatgtttatgtatatgcacatcaaaagcacagcacttttttctttaccttatgatgcagagacatttgttcacatgttttcctgctgaccctctctccactattaccctattgtcctgccacatcccccctctccgagaaacaccccataatgatcaataaatactaagggaactcagagactggtgccggcgcgggtcctccgtatgctgagcgctggtcccctgggcccactcttctttctctatactttgtctctttgtctctttcttttctcaagtctctcgttccacctgacgagaaacgcccacaggtggggaggggcaggccaccccttcatatgtacacatgactcaagcctcatatattctctttagcttaagacaggagtgctagttttatttctacctcctttatcaccttgttgggtttttttaagaaacaggatctgatggaatactatgcagccataaaaaagaacaagatcgtgtcctttgcagggacatggatggagctggaggccgttatccacagcaaactaacacaggaacagaaaaacaaatactctatgttctcacttgtaagtgggagctaaataatgagaacacatgaacacaaagcggagcaacagacactgagatctacttgagggtggggggtgggaggagggagaggagcagagaaatacctgttgggtattactacttaccgcctgtataacaaacctgcacatatacctctgaacctaaaataaaagttaaaataaaaaacaaataaacaacaaaacaaaacaaaccaaaaaaacggggtctggccatgctgcccaggctggcctcgaattcctgggctccagtgatcctcctgctttagccttttaaggagctgggatcacaggagcagatactgcgcccagtccttttatcaccttgttttaattttacttggttcataaattctttaatgtagaagaaaatgatgagaagcagtttttattactaaaggattcctgcctttgggattcacccataatttgtctaaataatgaacgtgttcacctttctgagatggaacttagctgctcaaactcaacttttcagagacaccacttgcaggtggtgtgggcttctatgaaaggacagcagccctttgttttgaaactccagatatggaatgtagaggcatttgggtgacatataaggcaggctgtttaacccagggccctcctccagatgggaagatcataattgaaggcataaacctatataaggcaaaagtgggagtagacagtaaaaccaaaaaacaaaacaaaacaaaacaaaacaaaccccaaaacaaacaaacagaaaaaccaaaaagtgaagatggccaaatggcgcctggagagaaagaacacaaactactcgggctgtacgtggacccagcagcgcaggacttaagcggcaggttcccaggaaggccggaggagggtgtccatgtggggagcgtgtgggtgaaagcgtgagggggagtgtgggggaaaggagcccaaatctgcggcttagctaacagtcatttcaaaaagcagttacaacgcctccacgcccctccagccccgcctggcccagcagagggctctcttcttcctcccatctctaagaccactgccggcgccgccccagaaccgcccacaagagcatggcctctgcacaaagtggtgaccccgcggccctcctctccccagcagctcatggtgtggtgggccaggctggcacctcctgtgcactgcaggagtcctctcagggtcagctctcctgatagcacacttgtgactcccgacgaaatggcccgaccagatgattcccgctgcaaactcacgacggatgagccccaccgtgcgcgcaaagcttcctgccggctttgcaccgcctagcaattcatgtgacaagcatcacagacatgggagaaaagtgttgtacaggaaacagagagacgctacccgcaagggggaaaagtggggctaggaaatccagacccggaagcgagcagaagaaaatgagacaagcctacagttaatatattcagaagcataagagaaggtactgccttcataaaagaaaaaaatataggctctaaaaaagggaatatgtatagaaacaagaagtctcagaaagtataatcatgacagcaggaatgaaaatttccgtagaggggttaaaatgtgaattgatatgatcttccagaaggtggaacaaaaagcagaaaagggaaagaagaaacactttttaaaaataataaattagacagtaagttgaatcctcaggatgcatgagtgaaatcccacgacaacagttgtgcatcaggcctacctaacaaggctggagcaaaatgctgagggcgccagagggatatcttgggaaaaaaaaaagaaaataaatgaaaagaaagtgaaggaaggaataaagaaaggaagaaatttataagttatctgatgtgaatcaacataatgggggaatatttgtacttctgaagaagaatttgggaaagttttagtaataggaatgcagaaaactaagcaaattaaagaaaaataggctgggcaccagtggctcacgtctgtaatcccagcactgtgggaggccaaggcgggaggatcctgagccctggagtttgagaccagcctgggcaacataataagacccttatctctactaaaaaatttaaaaaacaatcccacgagtttgaagttgcagtgagctgtgattgttctccaacctgggcaacagagctgagaccctgtctcaagaaaaaaaaaatgtaaagcaattattacactcagaaacatttaaaaaaatggaagaaagtagtatttaagtacactaaatagctcaactgagagctgttttgttcacatagtcactgtgaaaacattgagtattgcttgaacaaaaagataatacagtcttctagcagtgcctcaaatgttaaacctacatttaccatgctatctaggaattccagtcttaggtatacacccaaggaaaacaaaaactcatgtccacacaaaaacttgtacatgaatgtttgttgaagcattatacataatgaccaaaaaaatgaaaataattcaaatgtccatcaactgatgaatagataaataaaatgtcatatatccatacaatgaaatgttattcagcaataaaaaataaatgaaatattgagacatactacatcataaatgaaccttgaaaacagtatgcaaagttaaagaagccattcacaaaagatcacacattataaatgattcaatttatatgaaatgtatagaataggtaaatttattgagacaaagtagaccagtggttgccaggggctggaggagtacactaggggaataggaggtgacggctaaggggtatggggtttctttttagggtaagaaaaatgttctaaaattgattatggtgatggatacacaactctgtgaatacactaaaagccactgaagggtgtactttaaatgggtgaattaattgttatgggaattacatctccagaaacctgttttgttttttaaattaagacataaatattttgggaagatggaagtgccatggaaaagagttaatcttcattttcaatgagaggatgtcataatcaaaactgaaaaatcaggaaataatggcaaaagccaacatggaggcaagtacccaaataaacatctaaaattgttgcaagtagaagctttgggataatgagaattggagatgtggagaagtgggacaaggaattactgtttctttacaaactttatggaaatatttgatttttacttatacatgtataactttgataaaagtaaaaataataatataaatcatttggtccaactctctctctttgtaggtgagaaagcagaagtccaggaaataagtgacacaactagttatctgtcctagttcagaggacagcccctaattcctagccaaccaccttctatcaggccaatctgaatgacaaatttagatagcttcttacatagacagaaaattccttgggtgcactggagatgtttcctgacggagacaccttctctgagatgtgctccatggtaacagcagttggtatgatctttgtagcaagcttgattagggtatgaccctgggaacctggaaaagcccagcactttccagggtagacatccggctggaaagaaaacactgaattaatctcttaactagttatgtgaatccattcccacaatactggtcagctaatcactattgactgcagatctctcttatgcctatcaaataggaaaactcccaaggcacctctagtgtggttgttcttccagagcactgtatgcttatatcaatcagagccctttatcatatgagcatgttttctttcattgctctaactagactgtaagctgttataaggcagctagagggcatgagtggtggtgctggtaaggctagtgatggtggtagtgaggatgatgatggtgaccattgtgatcattgtggtgatgatggtggtaataatggtggcagtggaggtgacagtgatggtggtggtggtagtggtgatggtgattgcaatggtggtcatggcaatggtatcacctaaaaaggtggtggtagaggtaatggtgatggtagtaatggtagtggtggttgtagtgatggtgataattgaagtggtagtggtgatggtgattgcaatagtggtcatggcaatggtatcacctaaaaaggtggtggtagaggtaatggtgatggtagtaatggtagtggtggtgatagtgatggtgataattgaagtggtagtggtgatggtggtgatgaaggtagtggtggtggtggcagtgatggtggtggtggtggtgacagtgatagtggtggtggtgatgatgatggacatgggggtggtgatgaagaaagatggtgaggtggtggtggtggtggcagtgatggtggctgtggtggcagtgatggtggtggcggtgatggtgatggacatggaggttgtgatgaagaaagatggtgctggtggtggtgatgaagatgagggttttgatggagatgggggtggtggtggtggttatggtggtagagaagaaaaatgaggtctactactttgtagatataaactacagcctggaataagatcagtgggttttacccctgaaagttctaaatttgcaactaacttcaggtgtatggatcaaagttgagaggtgctctgctgtctattgatggctactgcctttagactgtaactgaaaagtttggtggggatcttacttggagatttctcctgttataattagacttaagaacatgtggtctgaatagcacttaacatagtacagtactggcacttaggagacaagtactttcaacaaatgtttgttgaatgactgaagttttcaatggaaaaggatggtcacagaatcaacttacagaaaagacatggaatgtatatgttttacttgaaaataaaataatctagtttactaatcttaaaatgataaataagtaaataattaatcatagtttactgaccataaaataagacataattcatgcagtgtactgactataaaaatataatgagatgatttcagattctgtgacaagttcagacactcttatattgcctccatttttaaaattaacattttcatgataaataataagaacaaaattctaaaatagaaataagtgattcttaatttagctttacctgaagaataatatctggaggcatttcatgatttaggaaacctatcccatgccagtacaattttgctttattatttttataactttctgaggtcccagcttcaatgatggaggctcctaaaattataaagtaagttgtaaaataaagaaacaacatacacaattcaaaacacatcatttgaattttaacaatgtctctagaaaattattactgggcaaattataagcgaggtaaaattcatactcaggaattgataggaaaagtatgacagttttcactaccactgaaattttgtcattttgaagaaaactagtttgttctgtttagtttcacaaaatgtatgattaaaaaaattgaattttgaggcaagtaaattagagatgagaatattatatggattctgtatcacctaaaaacgtatatagatctttatattttaacagctcatgtgataaatgagacttcctgtcattcccattcactcaataacaaaaaaagcagaaaaccaacaatgctccaaatgtccttcaagttacatttgtagcaattatgcagattcattgaactctattttaatcaaagaaatatgaaatatactcatcaaacattatcccttcaggttacttcattttagaagcaaaatgtattttatacagaataaataaagaaaatgcaaattgcttttacaaattgcatttgcataacacaccacaacactaaaaatacatgtgcctcatcaaatatctgattatccttactttttctttccttcttttttttttttttttttgagacggtgtctcactctgtcgccaggctggagtgcagtggtggaatcttggctcactgcaacctccgctgcctgggttcaagtgattctcctgcctcagcctcccaagtagctgggactacaggcgcccgccaccacgccggctaagtttttgtatttttagtagagacagggtttcaccatgttggccaggatggtctcgatctcttgacctagtgatgtacccacctcggcctcccaaagtgctgggattacaggcgtgagccaccgcgcccagctgattatctatacttttcctaagatgacacactttttgaaatagtaattgagttcctagagttgccagatttggcaaataaaaataaaagacagccatttaaatttgaatttcaggtaaacaaagaataatttttttagtagtagtcatgtcccatacaatatttgggatatatttatactaaaagattatttgctatttgtctgaaatttaaatttaactgggctcccttcattttatctggaaaccctatgtgtacttcgtttttgaaggctaattctgactgcccgctcactattcctactcgaccaactggctggacagaatctacactttcacctgctaatgtggggactgaataccccatccccataatcctttccagaaaaaaattaaaattttagtgtggtggaattttgaaaataattcatatttattcattttctcattcattaaaagatttaaatcagctttattaagatataattcacatcctatacaattcactcatttacagtgtatgattcagggttttgtattatattcttagagttgcacggccaccacaatcaattttagaacatttagtcaaccccaaaaggaacccatagtggttagctgtcattccccatttccctcaacctctctccccaagccttggcaattattaatctattttctgtccctgtagattacctattctggacatttcttttgctgctcccttgtagtcagtcacagtatgtagccttttcactaaggctactttcatttagccaatgcatttgagatttatgaatgttggaatgagtatcagaagttccttccttttattgactgcaggttgatattccactgtatgaatgcatccgttagtctttgttgatggacatggggttattctcaattttggtgatgatgaatacagttgctatagacattcttggcaagttttgatgtgaacatgtttcaatttatcttagataaatgtatagaagtgggattgctaggtcaataaggtgttatattgaacttcataagaaattgtcaaactttgccagagtggctgtgccatgttacattctcacccacagtgtatgagaggtccattttgttcatgcggttgccagcacttagtatggtcggttttgttttgtttggcattctaatcggtgtgtaatgatataacattgaggttttgacatttcactaatgaataattaatgtaaggcattttttcatatacttttttgacatgcatttatcttctttaatgaagtgtcttccaaaccttttgcctattttttatctggttgtctgtttgcttaattgaagcttgacagttttttataaattctggattcaagaatgtgtgtggtttccaaatattctcccctagcctgtaacttgtcttttcattctcgtaactgtttttttggcagagtagaaattaattttgttgaagcccatattatccattattttccttttacaatcatagtttttgatgttgtgtttaagaaaactttttctaactctaaaaaatttcgcttatttttttttctagctttaagctttatatttaagactgtgacccatttggggttaatttttatagattgtgggttttgggccaaggcttttttttatttttgcatatgaatgtccacctgttccagcaccactgacttgccttttttcctttttcaaaaatctattcaccacaggtgtgaactacttctagactttttgtattgttccattgatttcacgagtaccacatgctcttgattactgtaaacttatagtaagccttaaaattaggtagtgtgagttctccaactttgtctctttttttcccaaaacaaatttgactcttctagttccttcaccattccacatacattttgaaaatggttgtcaatttctacaaataatcctgctgggattttaattaggattatattaaatccatagaaaagttggacagtattgtcatcttaatggtattgagtcttctaatccataaacatggtatacttgtccatttatttaaatcttttttatttatttcattattgttttttagtttttagctctcagttcccacattttgttagtcttacacctaagtattttatgttttttactgcatttatgaatagagctgcttttaaatagtctctaattttctattattagtatatagaaattgtatatatacccttgaacttgtaaacctcacttactctggtagatttttttggtggtttttctacataagcaatcatgttgtctctgaatagagccatttttttcctttctaatttgcatgccttttcccctatcctctgcctttcgtactctctttctctcccagtttttcttcatttccctttcctgcctttttttaaatattagttgaaattttttatttattttttatttcttttgaaactgagtcttgctctggggcccaggctggagtgcaatgacgcaatctcagctcactgcaatttccgcctcgccttgcaggttcaagcgattctcctgcctcagcctcctgagtagcaggattacaggcgtgcgccaccgcgcctggctgttttgtatttttagtacagccggggtttcaccaggttggccaggctggtctcgaactcctgacctcaattgatccgcctgccttggcctcccaaagtgccaggattataggcgtgagccactgtgcctggcctccattttgatttctccattagcttttggatatctctgtatttttaagtaattgttctcatgattacaacgcacgtacctagcagctcatagtttatttgagttaactttttatcattcatataaaatctttacatttatagatgtccattaaatctcacccactgacttttcctttatggttgtcatagaattaaatctacatatattagccctccacgcccagacaatgccatacattttttcctttcaacagccatacatattttaaagtacttaaagaaagaaaattacctcatcttttgttgttgttgttgttttgagatggagtttcgctctcgtcacccaggctggagagcagtggcgtgatctccgctcactgcaacctccgcatcctgggttgaagctattctcctgcctcagcctccggagtagctggaattacaggcatgcgccaccacgccccgctaatgtttctatttttagtagagacaggatttcaccatgttggccaggctagtctggaactcctgacctcaggtgatccacccgcctcggcctcccaaagtgctggaattacaaggcatgagccactgtgccgggccacctcatctttactcacagatgaggctgttgctctttcttcattctttaagtcccgagtttctttttggtgtcatttctattgagctgaagaacttcctttagcagattcagtggcagataattttcttagtttttctccatctaaatgtcttcattttgccttcattcctgaaagatattttcactggatctacaattctgcattgctagatcctttccttcagcactttaaacatgtcgtttccttctcttctggtctctttaacttctggtaagaaatctgtaataatgtgtagtttttttttagcttctttcaagtattttcatctttgattttgagcaatttaactatgatgtgtctggatgtcattttccttgaatttatcttctttctgatttgccatgctttttgagtctgtaaatttatggttttttttttttaaatcgagtttgagatgtttttagctattacgtctttagatacattggtctcttcttcatctccctctgagactacaaggataagaatattatacctttttatagtgtcctataggtttctgaagttctgtttgcatttttttcaaacattttttcattctttgaattgcataatttcttttgatctatcttcaacttcactacttctttatttttaatttttaagttcggggtacatgtgcaggtttgttacacagaaaaacttgtgtcatggggatttgttgtacagattattttgtcacccaggtgttaagcctagtatccattagttatttttcctgatcctctcccttctctcaccctccatcctccaataggccccagtgtgtgttgttcccctctatgtgtttatgtgttctcatcatttagctcccacttataagtgagaacatgtgtttttggttttctattcctgtgttagtttgctaaggataatggcctccagctccatccatgtccctgcaaaggacatgatcttgttcttttttgtggctgcatagtattccatagtgtatatgtatgacattttctttatccagtctatcattgatcagcatttaggttggttccatgtcttttctgttttttttgttttttttttttttttttttgagacagagtctcgctctgttgcccaggctggagtgcagtgatgcaatcttggctcactgcaagctccgcctcccaggttcacaccattctcctgcctcagcctcctgagtagctgggactacaggtgcccgccaccacgcccagctaatttttctttgtatttttagtagagacagggtttcaccgcgttagccaggatggtctcgatctcctgaccttgtgatctgcccgcctcggcctcccaaagtgctgggattacaggcgtgagccaccgtgcctggccagttccatgtcttttctattgtgaatagtgctgcagtgaacacatgcatgcatatatctttataacacaacaatttacattcctctggatatcccagtaatgggtttgctggttcaaatggtatttttgtctttaggtctttgaggaatcactgtctttcacagtggttgaaataatttacactgccaccaacagtgtataaccattcctttttctccacaaccttgcctgtatctgttagtttttgactttttgataatagccattctgaatggtgtgagatggtatctcattgtggttttgatttgcatttctcttttttttttttttttttttttttttgagacggagtctcgctctgtcgcccaggctggagtgcagtggcgcgatctcggctcactgcaagctccgcctcccgggttcacgctattctcctgcctcagcctcccgagtagctgggaccacaggcgcccgcaccacgcccggctaattttttgtatttttagtagagatggggtttcaccgttttagccaggatggtctcgatctcctgacctcgtgatccacccgcctcggcctcccaaagtgctgggattacaggcgtgagccaccgcgcccggccttgatttgcatttctctaatgatcagtgacgtcgagatttttttcaaatgattcttggccacatgtgggtcttctttttaagtgtctgttcatgtcctttgcccactttttaatggggttgttttgttttcttgtaaatttgtgtaagttccttataaatgctggatattagaccattgttggttgcagagtttgcaaaaattcccttccattctgtaggttgtctgtttactccattgatagtttctttttctgtgcagcagctctttagtttaattagatcccgtttgccaattcttacttttgttgcaattgcttttgatgtctttgtcgtgatatctttgcccatgcctatgtcctgaatggtacatacaactttcaggctgagactatggggttttctaaatataggattatgttgtctgcaaacagggatagtttgacttcctctcttcctatttggatgcgctttatttctttcttttgcctaattgccctggccagaacttctaatactgtgttgaataggagtgacttcataggcaatacctaggttgtcttccagggttttctttttttttttgtagttttggcttttacatttaagtctatattccatttcaagttaatttttgtatatggtatatggaaggggtccaatttcagtcttctgcatatggctagccagttattccagcaccatttattgaataggaatactttctgcaatgtttgtttttgttagattggtagaagattagatagttgtaagtgtgtggccttatttctgggttctctattctgttccattggtctatgtgcctgtttttgtaccagtaccatgctgttttggttactgtagccctgtagtatagtttgaagttgggtaacatgatgcctccagctttgttctttttgcttaggattgcccttgctatttttggtttcatatgaattttaaaatagttttatctagttctgtgaagaaggtcaatggtagtttaataagaatagcattggatctataaattactttaggcagtatgggcattttagtgatattgattctttctatccatgagcatgagatgtttttccatttgtttatgtcatctctgatttctttaagcaatggtttatagttctttttgtagagatctttcacctccaaaattagctgtattcgtaggtattttattctttttgtggcaattgtgaatgggagttcgttactgatttggctcttggcttgacttttgttggtgtatagaatgctagtgatttttgcacattgattttgcatcctgagactttgctgaagttgtttatcagcttaagaagctttcgggctgagactatggggttttctagatataggattatgttgtctgcaaacagggatagtttgacttcctctcttcctatttggatgccctttatttatttctcttgcctgattgccctggagaggacttctaatactgtgttgaatatgagtgacttcactcctttttttctctgtttttgtttttctatcattaagcatatatagtcaatatttattttagatatcgtatttttcagttctaaaattccatctggttctttttattctcttggctgagaactggtatcttttcattcatttcaagtgtacttactttcacctcataaagcataattatgctagctgcttcaagtctttgtgtgacaattccaacatctgtgtcatgacggggttggcatctgttgtcttttcccttgggagttggtcttatttccgtaggagtttgcatgccaagtaattgtgatttgtaccctagacatactgaatattatactgtaagactctgagccctattactgtccactagggaatgcttttatttgcttcatcaatcaaccaagaaatgtcagtcctccttccttttatgagtggtggttccaatctcaattcagtcctcaaaacctttactacaggcctgtcatgtccatgtaccactcaggggttagtccaagacttgagccacagtttacatcattgccaaattctcaaagcctccactttgctgttttgggtctgttcccatgaatgggcagctgagaggtgaggccagaagctggccgcaaacagacaggggagcaggcgtcttctctgcagctttgccttccaggctttctgcccacactctctggcccacaggactactttattctgcgattttggctagaaaaattgggcttctttcacagatttagctgcctaccttgctgccacgtttgcagctctgtaattgctgcctgcctcagcctaggctgcaagagaaaagaaaagaaaaaaggaaactcccacaaggctcacatctgcagtttttggttcccctctaccaactgcctgctttgtttactttttagcccactcacgtagttgctttttgaattttgtccggattttttctcattgtaatcagttggaagagacttaacaggctttctctatcttggccaaaccagagctgacatttgtttccacatctatggctacagagaagcccgagcatttccttcttttcctcactctgcatgtgctactcttgcacctacattcgtcatcataggcttttcaaaatggaagttgtaaatacatcaattgatataaatgcatcaatacaaaaaagaaagcattaaaaaagtgtatcagaatgccaagaccaaaacaaacaaacaaccaaaaaatcccaactatggttcgtctcccatcttgtccccaacactcatgctttagggaatcaggtttgggaaagttctgccctctaactcactctctgaaaaacacatgctcacaagactgagtaatcatgctgttccaaatgctctccagttcatgcaagctggaaatttatttccctggcgtaaatttgactatcaattgattaaaattagcattactatgtgttttatatttccattctccttctgtccctttcttctttcctcccacattgttcactgaacacatattgtccatagactattataggcagggcatggtagataagattaaggttaatgattcatagccttaacccttaataattaattttaattggaagatattaggaacattatatataacctttaaacactgtcatttaatccctaataatgcatttagattggtgatcataagtaattttagtatataataatacaaaatgtcctaatattttgtgccttccacaacttcactgtggcatcttggctttcttggtggttcttttagatgcatgttaatgaagttgcacaggcttttttccctggaacatttgcactcagcaatcagtagtgacaactatttctactctcttctttattatctaaattgattaatttcccccccccaagttaccagataaatatgttttcctcataaacaaatgtagagaatagggacattcctgaagcattcttttttttttaatgttcctcttttcactttttctgtactcaccggccgacttcagggcataatcagccatctcgacttggtcttctctcaactttttaagtacataattgaccaagtttgacacttcctgtagaaattttataaacagttttctgttaacaatctttgccaactgcttgagttttgaccattcattttattgatttggacctaatttgcaaaattagaatagcagtgagcccctatcagctgcactctgagccaggccctgttcatggatctggactgacaccttcacagctcttgggagtgtcattttcaggaatacggtgtaaataaagccaaggtgtgttcagggactcccacaaggtcacacagcaccgtggacctagggtctcttctgaagccctaaccactggcatcacagtgctctcccggtgaggtgctgtgacctactgtgttctgtccctcattagtgtcctgtggttagcagtaaagacttgaacattctagagttatttgggaatcaaggcagtttacacagactacatgattgcttatattagacatttttcacccagtctaattaatattggattctgaaggctgctctcattctaaaaaacgaacaaacaaacaaaaccaaaagcaccctaagcaggcgtaacagttcaagttcaagctgcctaaacgtaacaccttcacagtgacaaggatgaaatggggtctggagggcggcaggtggtccatgtcagattgctgcgcatttcaaaaagtagacattagggaagaaaaagaaggtagtaatgacagcggaagagaaagaagcaaaatagagcttgtggtttccaacacagttttgcctgaatctgatgctgtctagactaactacattagctatgaagatgatgaatgcaaatcttttgctatttaaggtatttgtgtatagagctcagagactgttatttctttctttctttctttcttttactggaaaatagaacagttatttattttggtgtgaagtaagtcatatgcaatagaatgtcttctctgtgacacagcatttatgaaacactgggtttctgtacacaaaccaaatatcagtcaacactggacttcccactgggagaagaagcagatgtgacatcggaaggacatactcactccccgtcaccctggacatccgcgctaaccaccaccccaccctgcccaacccgcctagcctcatccaggacctctgtgtggtccgggtcctccacagggtctccatgggtgttccagttgtgattattgtccataccatccttcatatctcttagcaatgccttcaggacatctatttgttcgatcaaaaatagaatttgacgaaaattgttttccagattctggctttccttcctgtaaagggaaaatctcagcatgagaggaagaaagtgtaaagctcctgttatcagctgttgctgggctccacccgccatgtgatgaggtgctttatattgttgaagatatacattcttgagtgagggaagagcagagcatgcccatttctctaaagcatcacgcttcactaaaaaaaaaacaaggacatccaggggtcacatggctgagggtgtcctactgcttgaccgggctctgcatggggcaggcaaggctcaatcaatcttgctggtcccccagctgggtaacgtcacacaggtgaatcctaaatcccactgttacctttccaattgggaacaccttgcatttccggtgtagtacagagcagtggctttcgaattgtagcctgagttcagtggaagtgccttgggcaaggggtgctggtggatccagccagtgggcagtgactggttaccagtttgacagcctgagcatgcaagattttacttcccaagaatgttttttttttttttttgagatggagtctcactctgtcccccaggctggagtgcagtggcgtgatctcggctcactgcaacctccgcctcccgggttcaagtgattctcttgcctcagcctccccagcagctaggataacaggcacatgccaccgcgctcggctaatttttgtatttttagtagagacaaggtttcaccatgttgaccagactggtctcaaactcctgacctcaagtgatccacccgcctcggccacccaaagtgctgggattacaggcgtgagccaccacgcccggccaagaatgggttttctatgtttacagtttgaaaattactagtagagagaaaaagaaaatgtcaagcgaataggtatttctttatgctgaaaaagtataagcactacttatctggtatttttccccatttgtaaatcaatacatgtttgaattcgggaaaaaaccaagcatttagaagaaataaacactgttaaattttaatgactttctaccagtttttattccatgcaaaaaattggtaagaaaatagaaataatatttataattttgtgtctccactacacttccaaatcattaaaaactattttaaaattatttaaatggctttataattcttcatttcatgaatatattccaatgtatttaaccattggcctaattttcttatagggttattttccatttttagttatcataaatgacatggaaagcacacctcagtgtgtattttgtcaaggaatgctccatagaagtagaaatatgtaaaaggacaagtaattttctaaagtactacaaatgttactgtttggtgtttaaaattttaaattatgtatatgcacaagtgagaggaggcaatttttattttgttgtttccttcttttgataaatccaagtaacaataaatgtactatttttaatactaaatacagcatgggtagattaagtcacctctaaccctttaatcttttctatctcctttttttctttttcttcctcctttctttccatctgcatatatacatagagaaatgctaggaatgatatcattaaatattaataatagttatttctgggagtgaaattttgagttatttcagggagtaacttttctttcttatacttttctgtacgaaaacatttcagtatttgaaaccacaccaaaaagaggcatatagcaaaagatcgcactcactttaaaagttccagttgctctttaggcatacgaagtctggcctgaaaacaacagaaaaagataaatcattctgaattctgcttattcaaatagagtcttttttttttctcagaaaagggaaataaatagcacattgactcctgatatacagatgtgctggctggaactcaggagcgtcctctgagaggcccgcctctttcctagcctcacctgtacatcatgaatgtatttgaaggagatgaggtaatgcaaatctatttaatgagtgacattcaacaggagctcttggatgggcacatcatttcctatttcttaagactgtaaaggcctgaacacagtctgagagggaggttggaagaggaaaaaatagagggaagaggaagagagggaagggaagacaagcgggagaggcgcccctggtggatgtggaaaaacctaaggagcacatggcgacgttagaggaccatgctgagctctttgggcttgtccctgaataaggagggggactcccacttacaaataagaaagggatgtgattacttttgggctagattggcaatcacaatcagaaaattgcagaaatttatctaacactggtgtcatgtctggtatagatagtctctggtatggacggtcttggtggtgcccaaaccaagacaagaaaccaggaaaaggtaaagttactgtttggacacaacatgtggcttcagaggactttctgctatggaggtggtcagtgaaaacataaacactgggaagatagagcatgctggagtgcaggcagcactctggtctgcagtaccgggctactgtgctgcctgttcctcacctggaatgggggaatggcctagctgcatcctcctgtcactgagaagaacttgggtctgggtggccagcacctctatgtcccttagctcatcctgctgtgtgtcttccgggccctgccacagatgacggtggttgggtgctcacatttcaaatgccctacaagtcattagcctgggagcctccaaagccctgcactctcttcccgtctgtctttacccagcatgagacacacacacacaaacacacacactccacatacacatgcttatacacacgtatgcacatgctcataggcacacatgcatactcacatatgcacacatgcacagcccctattccaacatgggatggttggagaaggtcaataatattaccaacagagaaaggagggcaaaagagagcaccttggggcaccaatcttgaagggctcagaagccaacaactgagtggacaagctggtaagaaggggaggacaagtgtgaaagggtgatctcttccccagaggattccaggaaaaatagtcaacaatgcccatcgagggatggctcctgacatcctttctttacatctggaactcccctaccctgacatgttttactcaagtggtttatcaattaagaggcagtatctttgactatgtgccaagaaaataatgtagatcagagtggaggaatgatcaagtgtgaaaacgaaggccgacccaagcaatcaattcccttgggtttaaacttaaatcttggaggattcccgcagcagtctccagaaatttgtctcatccacatactctccctgccaggttgggaagcagacacctctgcctttaaggatcactttcttgtagcaacaaagctcacacttcaggcacccaacagagaactcaaagggaccctatgagtttcctggggctcttgacacacatgaccacaaacggggtggtttgaaacaatggaaatttattctgtcgctgttctggaggtcaaaagtgtaaggtcaacgtgtccacatgtttacactcctctgaaggtcctcagggagattctgtttcttgccttttctaacttctggtggctctgggcattcctaggcttgtggctgcatcactccagtctctgcctctgcctttacgtggtctcttcttctcctctctgtgtctctctcctctgtaagtctcctaaagagatccctgtcattgtatttaggacccatctgagtaatctaggacgatttgatctcaagaaacttaattacatctgcaaatacctttttcccaaataaaggtcacattcacagtttcttggggtcaggaggtagacatatctttttgggaatcacctttcaacctcctacagtgaccatcaatgtgctatctgggaaatagtgctccatctttacccagtaattagcttgcttttctgttacaaagactggctttttatcagttagctctgcccaaaatagtgctatactataaatgtgttgtgtcttgtgcgatgttattctgtcatgtgtgataatgatgtcagaatggaatgtagtgtggcacatagaaaaatattgccttgcttttgttctgaacaattacacttcttatacgttctcctcaacatttttattttgacaaggatgtgaatttgggagcttatcattggtagatagagattctcacttctagtttttcacattctgtttgagcaacttccctgtcagtaggagcagtgttttcaatttgtttcttttttctgttctagccttaaaataacatacagaaaatactcctcaattaatttgctgataaatgaacttgagagttccatgaaaaataaaatatttcacaattttaaaaacatttttattttgcttcattcccaaaagcatttcaggcaagttctactataggaacttgtatagtataagaacatgtaggacaaaacagtaagtaaggaagtgaaagtgaagataaaataaagattggaaaagtaagataatgcgagaaggatgaagttggaacctactcgtgcctgaaattcttgaaagttattagctgtgggctataaatttgtttcagagcatcacagcaaccaaatgggtgggagagggggcaggccaatggccaaaatttaccacatccacaatgtggaaaaagaaaatcaaaagtgttataaaggctgctttgtgtatagttgattatctttctgaaacatttctggcaatgagatgggggttcagtgtcctaggaaccttcctaaaacatccctccctgtaggctgttggcctcatgacaaagcctatgtcagggaaagcctcatcagatgtgaaaatgtccagagcactcgttaagaggacacagcctccagggatattgttttcagcaacaaagtccctgtgcctcatcctaaccatggattaaggtagggtttgtctgcatgtgctgtcaatttacagcctcctgagacacgaaggcgtcaggtagaggctggcaaagaaatagccatgggcaaagcccagttttacttgttttttgtttagtttttttttttttttcttcagataatgttgactgagacccaaagctttatgccttggaacatggctctagtaatttgaaccaagataaattcaatgatgtgttaacacatttctgacatggtcattaaaattttttttctcaatgaggtcccataagatatctaactttaaaccatataacttcaaggtgaatcctacaaactatagtgattgcagactgtgccctgggtaaataactaagcttgctgcttaatatagctttaagatagaaaccaattaaatattggagtaagtaatttgaagtcattggtcttgaactcacaactgtgatcactgtggcttgaatatctatgtttcttccaaaatttatgttgaaacttaatccccattgtggtggtgttaagaggtagggtcttttggggagtgattaagtcatgaaggtaccacccacgtgaataggattagtgcttttaataaaaagctcgaaggaagtagtttaggcccttttcgccctttgacctcctaccacgtgaagacacaagaaagctctcattaaacatagaatgcacatgccttgatcttggacttcacagcctccagaactgtgagaaagacatttctgttctttataagctacctagtctatggcattttgttatagcagcataaatggattaagactgtgctggtgatttgaaagtggcatgtgacaataaaattttgttctcagtgtagcagtgagcaaagtcttagtctgaatggcaggcccagtctcaacaaaatctggatcctcagggaggatcatttcagctctggaatatgcagtggtgtgaccacaggctgccttccttcattgtgctgatccattgtgctgatccagcttcctaatctataaatggatttagtaatactcttactgaaaagtcatttcgaggataaagtgtaatatatatttagtgttcttaggatctcttctgatgcataactattaccattatcctgttctccatggtggaatatgaggcgatatatccagctttttgaaaagtaatatcaaatcattgggattcaatatgacaacaaggtcacctaaaaattataaatattctttacttatttttcttttaagagtttatcctaagtaatcaaggagaggcaaattgattaagccataggatgtttgtgtttataatatttaaaaaattagagacaatccaattgtttagaaataagtattcattgaaaatattattcattggaatattttatcatccattacatgtcattataaaataatatctaaaggcaagggagcatatttaaaatctattactggctgagtgcagcgtttcatgcctgtaatcgcttgagctcaggagattgagaaacagcaactacttcatgtagcttgggatttataaagaactcacgtagaaataagttaaaatcagtctccagtggtttctgacagtgctcttgtctgtgtgaaaaccaggttaacactggtcaaaaattaaatgatcataggtcaacctcaacctcatgaaaaatactgtccttagaaacacggccatagtcattttattttatattttgagacagagtcttgctttatcactcaggctggagtgcagtggcacaagcacagctgactgcagcctcaacctcccaggctcaagtgatcctgccacctcagcctccagagtagctggtactacaggcatattccaccatgtctggctaattttttgatgttcaggctggtcttgaactcctggagccaagcgatctgcccacttcacctgcccaaagtgctgggattacaggaatgagccaccgtgttgggctggctagacatttttaaagggttgaatttgctgttgagtatgctggttagtctaaaatcggaaggtagaagggaaggatgccttttaaaaatgtgattagtctcagataacttatttatttattcattaatgtgcatatttattaagcctccatttacctggggactcttctaggctctagacaagctccttgatcattacattttagttaaaagggaagaaggcaagaagagagctggtaaagaaatcgatgagtgtctaaaataaagcaggggtaaaaactaggatgcacctacacctggatattgtcacaggtggtttgtgtggtcacagaagcctgtctaatgaggagacatttggactagctggaatttcagaaagaaaccaatcctgcaaagatctgcagcagaagactgtgggcaaaggggcacccaatattcaggcactaacagaacctgccagataaacttacaagtgtattagtcagggttctctagagaaatggaaccaagccaatgtatatatagagagagatttattttgaggaattggcttaaatgattgcaggggctaagtctgaagttttcagggcaggctggcaggctggagaaccagggaagggttgatgttacagctcgagtctgaaggctatttggagacaaaatttcttctttcttggggaatctcattctttattcttaagactttaaaatgcctgtgagaccaacccacattgtagagggtagtcttctgtatttagtctatagatttagatgttaatcacatctaaaaaataccttcactgcaatatctagactggtgcttgaccaaacatctgggcgccatggcctagccaaagtgacacacaaaattaaccatcacaacgaagcttaggcacaaattggcaatagttggagccaccatgaccactctgcgtgctcatctctgcttttctggttatgacctaactatccagcttcagctcccatgggcttggtcttagtctttgatgtgagaacctcgtggagtaggagctatctgaggctgaccctctctgtggggtttccaggtagctgtgcttttgtctaagactggggtctcacagattctcagcatatgcagactgagtagcgcctctgagatgggagttatcctgggcatcaacctatgaacctccagggaggcttcctcactggactggaatgctgtgggcatcatacatgtgcagtctcccctctcttttgggacttcacatggcaagacacattggaatgaggcagttactggaggaactaggaagtagaagatttcagaggccctgagcaaaaagggtatgaagtaggaatctgatcagtcaggcctaaggccactgactgggtcactgaagtcactatgggttaaaagatcagcatactggtggagacaggccaatatgtctgtccatcttcccccagagcagcagtaacctggtcatagctcctgctgaaaccacctttgcaaaaatgaaaactaagggaagtatgacggtgaaagagacaagacctatccgactccatcatgcttctaacttttaagctgtccttgttcattcctgggagtaggccaaactaactttgggaaggaattcagttcatggtttgactctgaaacaaaattgataacagtcctttcctgaaaagacccccttcttgcttggggaccaatctgcctttttaggactaacaaattagctacaagattagaaattacagtttaggggtcacgcagaccctggctccaagagtctgaacctccccaaattgttcctggggataacatcactattgtaagacctaagatcagtgcttgagatgttttgcagaccctgcactagatggatcagctgataccacccaggccagtaatctgactcaaccagttctgccagcccacccaggaacagaagacagcaagaaaacctcactttgactctctacgattccatctccaacctgaccaatcagcactccccacttcccaagcccctacctgccaaactatctttaaaaactctgatcctcaaatgctcagggacactaatttgagtaataataaaactccagtatcccacacatccggctctgcgtgaattattctttctccgttgcaattcccctgtcttgataaattggctctgtcaaggcaatgggcaaggtgaaccctttggatggttacactgccaccctcctccctccaatcttctgagtttctgagcatagaatggacaaggcttattctggaatgctgggggtggggtggatcagaaagaggacattcagtgactagcctcagtctaagcccacctagatctaactagcttcaggacaaagggaagtgccatactcctgtccagtgtcaggcagtgtcaggcagaagttggtgataaaggtttatttgccattttatttgtgcttgagattctcttggggaagtgtggagaatttttaggacctcatagctataaaactattgtcttagtctgttttctgttgctataacagaataccacagcctgggtaatttataaacaacagaagtttgtttggctcacagttctggatgcttggaaatctgagagcatggcactgccatgtgatgagggttctaccatggcagaagggtgaaagggcacaggaacatgtgagacagagagagaaatggggccaaactcatccttttattaggagcccactcttcaggtgactatcccactccaatgataatggcattaattcagagctcttatgacccaatcactttttaaaggtcttacctctgaacactgttacaatggcaattaaatttcagcatgaggtttggtggtcacattcaaaccacagaaaccacttaatagaattccatttcctacattaattttattagatattctcatataaaacaaagataacatattgaaagttgaactagccttgtagcatattaaactttaaatgagtgatatacaaaattacttaacaaaatatcacctgatatttataaagccttgaaccatattctgcaattatggcatataattgtctggatttctgaggaacatctgtttctttaagccactgatgatttaggagtcctgttaaagaaaagacaaactttgattaaagagtttctctggaaacataaaatattttacatgtattcataagaatttccctaaacatgaagaatatgtatactcttaagaatatcagatccttgggtgacatcatggaaaatggtggaatagtacacacaaaaaatcaggcctccatgtaaacaatatagctagtaaagattgacagaatcaattttttttggaactctggaatctaatccaaaacctacagcagccagataactaaggatagggtggctagtttctagaaacagagcatgtggcatttttctttacctgactaccatcttccatttctcaacctggtggtggcagctatagggacagcatttcacattcctttaatatagactttgttcttaaaataccatggtaatgttttttgactcatctagtggttccctgaggggctggcacagaagctgacctgtgtttattccacgcctatagctttctaggaagtggcaatatctattgaaagacttcaaagacatactgccgaagcccaactgggacaaaggacagtagatgatggaagtggcagacagacccaacagcccatgaataaagaggcagtctctttctggaaaaagggctcagaaggactgctgcatcatatactaggaagcagagaacgtaatgtgcatttctaggactggacgcatgttcataaatgaccccaagaagatactgggttgcacctctggtggatctgtagattgtgtataagcaggagatgaagactaaggcagagttttaggtggcctggcttagtcttgaaggagtgtcccagcttagagccaagctgcaaagactgagagagtaatctctgtctctgtctctgtttctgtctctctctcactctctctctggatccaggaattcaaggaaatatgtgagaaatcagtggctaaccactgagatagtggaatagcaaacatatacgacaagaaatacagtcttccaaaatagttttgggaggccgaggtgggtggatcacaaggtcaagagatcgagaccattctggccaacatggtgaaaccccgtctctactaaaagtacaaaaattagctgggcgtggtggtgctcacctgtggtcccagctactcgggaggctgaggcaggagaaatgcttgaacccaggaggtggaggttgcagtgagccaagatcgcaccactgcactccagcctggcgacagagtgagattccatcccaaaaaaaaaaaaaaagtttgaaaatgttactaaacaaacaagtgattgcagccctcaacatgcaacagcaggcaaaccctggggaagagggaaatctgaattctagagttattacattataatattaaaatgctcaatttgcaaaatcacatggcatacgatgaaacaggaaagtatggcacattcaaaaagagaaaatggcagaaaccatccctgaggaatctgacattggaattacgagacaaaaactttatatcagctgttctacatatgttcaaaaactaaaggaaaccatggacaaagaactacaggaaaccaggaagattatgtatggataaaatgagaatattgattaaaataaattatgaaagaaaccaaatataaactctgaagctgaaagaggaataactaaaatgaagaacttactagaagggctcaacagttgatttaagcaggcagatgaaagaatcagttaacttaaagatagagctatgaaattattgagtctgtgaacagaaagagaaaagtgaaaaagtgaacagagcccaagacacccatcagacaccatgaagtggatcaacatatgcattgtggcagtctcagaaagaggagagagagagaaaggggcagaaagaaatgaagaaataaataaaacctatgggatacagcaaaagcagtactaagagggaagattatagttgtaagtgcctatattgaaaaagaggaaaaacatcctataaatgatgtaatgatgtaccttaaagaaatagaaaagcaagagcaaaccaaccccaaaatgagtagaagaaaagaaataataaagatcagagaagaaataaataaaatggaaatgaagtaaacaatacaaaagatcaatggaacaaaggtttttagaaaaattaaatgaaactgacaaacctttagccagattaacaaaaaagagaagatacaaatgaaattagaaataataaagaagacatcaaaactggtactgcacaaatttaaaggatcattactagctactatgaacaactgtatgccaataaattggaaaatctagaagaaatggacaaattactagacacatacaacctaccaagactgaaccagaaagaaattcaaaacctgaacagaccaataaaaagtaatgagatcgaagccataataaaaaatctcccagtaaagaacagcccgggaccccatggcttcactgctgaattctatcacacatttaaagaagagctaataccaaccttatgcaaactattctgaaaaagagaggaggagggaatacttctaaactcattctacaaggccagtattaccttgatatgaaaaccagacaaagacacatcaaaaaaaaaaaaaaaaaaaaaaaagaaagaaagaaaactacaggccaatatctctaatgaatattgatgcaaaagcccttaacaaaataccagcaaactgaattccatgatacattagaaagatcattcatcatgactgagtgggatttatccctgggatgcaaggatggttcaacatatgcaaatcaatcaatgtgatacaccatatcaatagaatgaaagataaaaaccatgtaatggttttcaactgatgctgaaaaggcatttggataaaattcaacatctctccatgataaaaaccctaaaaaaaactgggtatagaaggaacatacctcaacgtaataaaagccatgaatgacagacagatccacagctggtatcacactgaatgggaacaaactgaaagcctttcctcaaagacctggaacacgacaaggttgctcactttcaccactgctattcaacatagtactggaagtcctagctagagcaaccagacaagagaaagaaataaaaggcatccaaactgcaatgaaagaagttaaattatccttgcttgctgataatatgattttatattaggaaaaaaactattagaactgataaattcagcagtgttgcaggatacaaagtcaatgtacaaaaatcagtagcatttctatatacaaacagtgaacaatctgaaaaattaataaagtaatctcatttacaatagccacaaacaaaatcaaatacctaggaattaaccaaagaagtgaaagatctctacaacgaaaactataaaacattgatgaaagaaattgaaggagaaacaaaaagtagatagctcatgttcatgaattagaagatcaatattgctaaatgtccatactacccaaagcaatctacatattcaatgcaatccctatcaaaataccaatgacattcttcacagaaatagaaaaaaacaaccctaaaatttatatggaaccacaaaagaccccaaatagtcaaagctattctaagcaaaaagaagaaaattggaggaatcacattacctgacttcaaattatactacagagcttagtaaccaaaacagcagggtactggcataaaaagtgagagataggctgatgaaacagaatagagaacccctacagagaactcattttcaacaaatgtgccaagaacatacgctggggaaatcatagtctcttcaataaatggtgctgggaaaactagatattcatatgcagaagaatgaaactagacccctatctcctgccatatacaaaaatcaaatcaaaatggattaaaggcttaaatctaagactttagactatgaaacaactataagaaaacattgggggacaatctccaggtcattggtctgggcaaaaatttcttgagcagcaccccacaagcacaggcaacaaaagtaaaaatggacaaatgggatcacagctaaaaagcttctgacagcaaaggatacaatcaacaaagtgaagagacaacccacagaatgggagaaaatatttacaaactacccatctgacaagggattaataagaagaatatataaggagctcaaacaactctacagagaaaaaaaaaaaaaacaaacctaaataatctgataaaaaaatgggccaaagattcaaataaacatctctcaaaagaagacacacaaatggcaaacaggcatatgaaaaggtgccagtttcattgattgtcagagaaatgaaaatcaacactacaatgatatgttatctcacctaagttaaaatggcttatacccaaaagataggcaataacaaatgctggagaggatgtggagagaggagaactctcatacactgttggtgggaatgtaaattagtacaaccactctgcaggatagtttggagaatcttcaaaaaatgataaacacagctgatatatgatccagcagtcctactgttgggcatatacccaagataaaggacatcagtatatcaaagagatatctgcgctcccatttgttgcagcattgttcacaatagctaagatttggaagcaacctaagtgtccatcagcagataaatggataaagaaaatgtacatattcacaatggtgtactatgcggccataaaaaagaatgagataatgtcatttgcaacaacatggatggaattggagatcattatgttcagtgaaataagccattcatagaaagacaaatatcacatgttctcaattatttgtgggagctaaaaattaaaagaattaaactaatgaacatagagagtaaaatgatgattaccagaagcaggtgagggtagtgtcgaagatggaggaggtgaggatggttaataggtacaaaaaatagaaagaataaataagacgtactatttgacaacacaatgggtgactacagtaaaaaattacttaattgtacattttaaaataactaaaagattgtatttggattgtttgcaacacaaaggataaatgcttgaggggatggataccccatccttcatgatatgattatttcacattgcatgcctgtatcaaaacatctcaggtaccccataagtatatatactatgtacccacaaaaaattaaaaaattttaaattttaaataagaaaaagaacatttgaagaaataatggctgaaaaagttccaaagttgataaaaagccatgaatctacacatccaagaaactcaacaaacttcaagtaagacaaacttaaaaagactcatgctgaaacctattataatcaaactgttgaaagacaaaaacacagagataatcttgaaagcagaaagagagcaatgccttgttatatagaagaaagtctttgttggattatcacctgatttttttcttcagaaactatagaggccagaagacagtgggatgacatatttaaagcgttgaaagaaaaaaaattctatatatgagaaaacgattctcccaactgcagaaaaaattaacatattctaagataaagaaaagctcatggtgtctctatgactagaccagcccttcaggaagtgctaaagggattccttcaggctgcagtgaaaggacattagagagtaactcaatgccgcatgaagcaatcaaaatctccagtaaaggtaacagagaggtaaatatgaaaccagtattattgttttgggtttgtaactccttcttttatttctttcataatttaaaagacaaatttataaagcataattataaatctatgtttatgggtacccaatgtgtaaagatgtaatttttgacaacataaagaggagtaaatcccagtgaatacagatcataaggaggaaaaaaaagaggagcagagctgaataggagcagagtatttgcattctattaaagttaatttggtataaatttaaactatattgttataaatgtagggtctcagttgaaatccccatggtaaccactaagaaaatatctaaaaaacgtatacaaaatgaaacagatcagaatcaaaagagtgcactacaacaaagcaattaaacacaaaagaaggcagtaaagaaggaaatgaagaacaaaaaaggtataagatatagattttctaaaaaatagaaaaatggcagaagtaagtcattccttagtagtaattaatgtaaatgaaaatggattaaactttccaatcaaaaggcagaggctggcagaatgaatttaaaaacatgattcaactatatgctgcttacaagagatttactttagaatcaaaactgaaatttataaaacatggctgaaagaaattaaagaagacctaaataaatggaaggacaacttgtgttcatgaattggaagatttactactgctaagatggcaacactacctaaagctgtccacagattcaaagtaatctttatcaaaatccaaacagcatgatactggataatgatagacatatagactaatgggctagaatatccagaaataaacccattcaactatagccaattcagtttttggaacagaggacaagacattcaaagattcctatagggaaagagtaatatttttagcaaatattactttggctttccacatgccaaaaaatgaagttggatcccttgcatcatatacaaaaatgaactcaaaatgggtcaattacctaaatattataagagctaaaaccagaaaactcttttaaaaaggtttggcaatggatgcttcaatatgacaccctcaaaattacaaaccttcgtgtatcaaagaaagtgcaaagacaacctagaatgaaagacaacctagaatgaaagaaatgttttcaagtgatatatctgagaaggatttggtatctagaatatattaaaaaactcttccaactcaacaacaaaaggacaaacaacctaatcaaaaatgagcaaaagactttaatggacatgtctccaaggaacacatacaaacggtcaataagcacataaaaagatgcttgacatcattagtcattagagaaatcaaaccatgatgaaacatgacttttcatccatcaggtggctgtaatttaaaaaaaaaggaaaaaaatgatagtggaaatgtagagaaattggacttcttgttttaatccatttgtgttgctgtaaaggaatatctgaggttgggtaatttataaagaaaagaggtttatttggctcacagttctataggctgtacaagaagcatggcaccagcatctacaactggtgagggtctccagctgcttccgctcatggtggaaggcaaaggaggagccagcatgtgcagagatcacatggtgagagagggagcaagagagagctgggagaagtcaggttctttttaacaattagctcccacaggaactaatagagtgacaactcattactgtaaggatggaaccaagtgattcatgaggaatctgtcctcatgacccaaatgccttccattaggcccccacctgcaacactggggttcaaatttcaacatgaggtttgggaggacagatatccaaactatagcagtcctcctacactgcttgtgggaatgtaaaatagtgcagccattgaggaaaacagtctggtggttcctccccagaaatctcattcctatgtatatacttgaaagaattgagaacaggtgttcaaataagcacacatacacacttatgcacagcatcactattcacaatagcctaaagataaaagcactctaaatgtccatgaatagataaatggataaacaaaatgaggtatatacatacaatgaaatattatttagctacaaaaaggaatgaggaactgacacatgataggatatggatgaaccttaaaaacattatgctaagtgaaagaaggcagataagaaagatcacatgctatatgatcttttttgtaacaataactgggttgaaacttttattttaatgggagatacatgccttaagttgtgaatatattaaagaacaattttccagtgtgctaggggtggtggatggtgatatttcccgatacgaaactacaaactgcacattctgcagtaatttatttgggaactgtgtgatgagcaagagtctctggttgtcaaaacctcccaagtggagtcacctaaatttagaaaaggtaaaatgtatgtttgcaataaatatattagaaattcttaactttaaagcaacatctatgactaaaaaatttgcaaaaagcaaaccacaattctaaaagaaaaatctcctttctaaattttctattaaaaagccagtattactcttacaatcagaaataaaaaacaaacgaaaaagctttgagaatgtgcaggtcacctccagcactttccgtggcatttatttacaaatatgagtcattccgttgagatctctctcaccaggcagacataacctgtggaatggttttaaggatcattacttaggaagacttacctacaagaagaaaagtcagtgtaagcattgtacttagaataatcttccatgatcgagttaccctaaaagaataaaaacaatgattagaaaaagaatttaacaacatcatgcatttaacttggactttagccactacactcacgtcaacaaacttacttattttcattcttgcttaatctaggttgagtctatgaattactttaatttccaatccactattttttaaattgagagaagatcgttttagtgatgatacacactcaccagcatatatgagtgcgcatacatagagtcatgcctcttactttcacatatgcaatgcttatgctagtatatgtctatttatattcttaaaatacttataagaaaaaaacaaaggcagttttctggaggtctcaaatgtagaactagctacaaaaaaagaaaaaaaagaaaaatcaggttctgattttatggaaattttgtactaagctaaagaactatgacagttaagaaatatctgataaaattctttaaagccaccatgaccttttttcctactctgtgttgaagtacagtatgctatacaaatacgatttgtgctcttttctgtataattgtacagaccagtgatgcctcacagaatgaacacatccatgaaacctcacccaggactggaaattgagcatactcagttctgtggactgaattgcaccccaccccccaacacacacacacacacacacacacacacacattcatttgttgaagccctaccatcattgttactgtatttagagatagggtctttaattgctaattaagggtaaaagaggttatgagtgggactctaaactagcaggattgttgtccttagaagaggtggaagagagaccagaactttttctctctttgtgcagtcagaagaaaggtcacatggggacacagtgagaaggcaatccaggaagagagccctcgctagagaccaaatcagctggaaccttggacttcccagcctccaaaactgttaaaaaaagtaaatttctgttgtttcagccacccagtctgtggtatttattattgcagcccgagcagatgaatataccaagcccatcagaagcccatcttatgcccttatcaaccctatacctcccacctccaaaggtacctgctctcctgagctctatccccattaagtaggtttgtctgggtttgaaccatctataaatggacccatgtgggtatgggctctatctgtctgcctcctgttcccagtcttaagtctgtgagagtcaactgtgctgttgtgtatagttgtggttcattcattcttataactgtgtagtatttcattgtgtgaatatatcatgtgggtatccatcctaacattgatgggtgtttggggctatgataaacaatgcagttataaatattactacaagcaatgcagctatgaacattcttgtacatggtttctgatgaagacaagtatgtatttcatttaagtgtattttcaagagagacattgatgggtcataggatacatgcataatccgttgcagtagattttgctcagtgttacaaagtggttgtaatgacaaccttttcacatctaaccttttaaaaagccctaaagggtggatggggagggaagctaaaatgatcacattaatctaacgtgaaggctataaacttccggataaagtattacaagttggcaaactaaaaatttctacttaaaacataagaaaaatcacattaagatggaccattcattaactgtattcactagagtgggccgcctaattctcccagtacagaatctttaagtagcttatctaccctacataaagcagtcatacctattagccatccaagagtgtgacagtgtggaaaccaactaagaagagaattttcttaactctcttcccctccagggaagtgtattctggaacctcttccttttaactattattggagatgtggagagtggtagggggtccactgtattaaaaaagttgttcataggtcagttatggtctacaagagctcttttggtgggctgcattaagtgaaaattatcacattaccatatttaccaaagattaactccagtgtttttcgttttttgtttttcactagaaaactggctgccaggctctgcattgcaaaattccttcggtgccttcacccagccagtgggattctgccatttggggcaagcatattttgttattactgtgattttgaaatgctgctctacttgtactaataactttgtagcattccttttatttttattgacagttttgttctgtgcaagtgcttcattgttaccaataggaaggttatttcattacttgtagtttttgttttcccagcaggcagcacatgggcagggcgtttgtaaataggtttagggtatttggattccctgctataataatccccacatatgttctcactagaggaaacagggtgattcactcaaaatgtgcatcccctaccagagtctttagtcaattatcacccaagaatgtaataaatgccactctgtgcccagagtcctgagcccggtgctaagctctgcataccaccaagactatacaagctagcccaatgacaaaaaaaaaaaaaaaaaaaaaaaaaaaaagtgaattatctggaagcttttaagttcctgctgctgtggctcattcttttaaagagggtggctctcctttcttaatccttctcccaagtctgctgttattaatccagataccgttgacatagaagtattgtgatcaagtgtaagactgtgatgaagagaaaccttcaaaggaaactattgaaaatgattttctctataaagggagaaaatactgtcgggtaacaggtaacagatgaacagacacaagtgacagatgtaacacataaaacctacaatttcaggcacaccgttctgccatgtttacctacccattcgcatcaggattttcgtcctctgataacaaagcattgccactggcgctaccgctggcgtcttcagagcaacgtctaaaaaacatggcagcccttcttgcctttgtttttccactcatgatcccctaccaaagaacaaacagctggtaggatgaagagcaacatttgtcctcattcctattttatgaaaaacatgaagctatacatacagtttctaaatttgttttgtataatgtcttcttcctccacgggtgtttcttcttgaagacggaattttgaaaagcttctgattcttctgttgcatcatcctccgtgacacctcataatgcagatggccaccacgcccagccagggcatggacaggcaaccacctctctgcttcaagggcctaattgtaccatatgtcacacccactgaataatacaaaggcccccccatgtacctaccgcttttcgatagcaaatctggatgttttgctgtgtttgcttcagtgcttttctaataaagaaaatatcagaaatataatagtagacccccaagtatccctgaatctcagcactcttattttccacagataactacaacctgaaaattgatatactctattctcattatttttgatactttactatgtaaatctgtatctataaataataccattttcatgcttaaaacataaactaaatgttatgccactctaggttttcttacaatattatttatcttgagacattaactccactcattttaattgctctatggtatttcattatacatacatcacaattcatttacccatccttctgtaaatgtatgcttaggttgttttcagtttttttggcaaggaataatgctcattgcacgttgttatatgcacatcacaaggtttttctaaacatacacctagaaacagaatagttaggtggaaggatgagctggtttatttggggcataaattctacgatgacagtcatttcactctcagcactttggagatactactccatggccttgtggattgattgttgttgatgagaattctgtcttatcttcatttctctgttttttttggcaatttctcgcgtagtttttaagattttctgtttatccatattttccagttgtattttagtgtatccaggtttgatactagtttttgtttttcctcacttataactcagagagtcttttcaatttgggtacttgtgtgttttttcagttctggactatttttcagccatcagggcttcaaatattgcttctctgccactgcctcaattttcttagaatggtccacctattgacacttgtgtctcccttttgctttccgttcaactgctccttcatatttgtttttgcttttttctctttttacttatgctgatttctgggtgaatttgtaagtgttatttttcaatttactacttattttctgaaagcttagatttataccaagaaacccccaagtttctacttttttacctactagtccaaaattcgaaagttacaaaatggtacacagcaaatatggcctttccacccggcatctgccttctagctattggttcccctctcttttagcatctatgctaccatttatagtatttcctttcaaagatgtgatacacatgcacagtatgtgacattgtattatatatgtaatattttataggtatatttatctctccacattcctaatggtagcttactataaactgtgctctgcatcttgcttctttcccttaaacatgtatcttggaagttgttttgattgtttgagataatcttcctcatttatttatgactgaatagtgtttcattgggtgaatgggccataggctatttagcctgtctcatattgatgggcagtttggtatttaaaataatgtgcaatagtaatcttgtatttaagttattatccatatgtgtgaatatatctttaaggatatatacccagaggaggaacttctgggtcaaagtctatgtgtatttttcaagaataaatccgcacatatacagccaactaatcattgataagtttgtcaggtgtacacaataaggaaaggacactgtagtctcttcaatgaatggtgctgggaaaagtagatattcacatgcaaaagaattaaattggacagttatcttacaccatacccaaataataccttgaaatagataaaagacttaaacataagacctctaaccataaaattcctagaagaaaacaaggaaaaaatctccctgacattggtcttgacaatgactttttaaatatgacatcaaaagcacatgcaaaaataaataagtggaaccacatcaaaccaaaaaccaaaaagcttttgcacagcaaaggaacttaataacaagaaaacaaataactgaatttaaaagttggcaaaggtcctaaatagacatttttttccagagaagacatacacattgccaacaggcatgtgaaaagctactcaacatcattaatcatcagggaaatgtaaatcaaaacaacaatgagatatcacctcacagctgttaggatggctattataaaaaagataaacagctagtgttgcacaaagtggtacacgcctgtaatcccagctactcgggatgctgaggcaggaggactgcttgagcccaggagtttgagaccagcctgggcaacatagccagaccccatattttaaagaaattgttaatcttaaaacaaacaaacaaaaatatataaagataagtgtaggcaagaatgcagagaaaatgtaacccttgtatactgttggtgggatgtaaattggtatactcattatgaaaaacagtatggaagtgccttaaaaaattaaaaatagaactaccttatgattcagcaatcccacttctgggtatatatatccaaaggaaataaaatcagtgtgttgaagagatatttgcacttccatgttcattgtatcactatttacaagccaagatataaaaacaacccaagtgtttattgatggatgaatgaatgtgatttatgcacacacacacacacacacacacacacacacacacacggtgggtgtgtggtggtggtggggggagagaaagagaatggaatattattcagccataaaaagtaggaaattgtgtcatttgtgtccacatgaatgagcctggagaacattatgctaagtgaaataaaccagacacagataggtgaatactgtatgatctaatttatatgtggagcctaaaaagtcaaatgtgtagaagcaaagagtagaatgggagttgccagtggctgatgggcagagggagtgggaatggggagatgttggtcaaaaggtgcagagcttcagttacaagaggaatacattccagggatcgaatgtacagcatgctgactacagttagcaacattgtattgtatacttgaaatgtattgagggagtagatagatctcaagtgttcttaccccacatacgcatacacaaaggtaactaagtgagatgatgaatatgtcaattagcttgattgtagtaattatttcacaacgtacatgtgtataaaaccaacatgtacaactgaaacatagaagttttgtttgttaattatatctcaataaagttggaaaaaatccaaaatgtgtctttaaaaatttcaaccaaagaaaaaggccattattttaacatgcagagcactgcagagtcaaagaaatccagtctctctcctgtgtgaagagaagatgatcttgtttctccaatgaggctgaaaacccaaactgctataacattgaaatacataaatatatatcaaaaaaggaaaccttgtctttaaattactcagattatcagaaaaaagcacaaaatgtaaaagcccctccagttggtggaaccctggtgagactatgttgtatgttctagagggaaagactgagctcacagaggtgaaggttggagaggggaattatacaagggctttcagctgcttgagattggaacagacagtaacaaggcagggcaaaagtgggagagatggaaaagcacaaatggaggatgtgtcctgaaagtttaaataaactagcttcagccaacaacatgggtaaaccaacagagaccaggcaggaaggaagggccagagggctttgaaaaatcagaatttgtactcaaatacatttttcctcttctcaaaatgctcataagcaggagattatctgcatatctacaagtaaagtgaaaaaattaggcataaagtgaaaatatatgtcagagaatgttggatctttctaaatactgaggccgattatgtggtagaaagatgattatgtcataaagtatagaaaataaaaacattgagatattcttattataaataaattattcttgtatcatgttttaatttccatggcatcattacctacattcttgtctgatctggtttgcaaatatttgtaatttcaatcacactgcaaaagtcaaaagttggctaggtgtggtggctcatgcctagagccccagtgctttgggaggctgaggcaggaacattccttgaggccaggagttggagaccagcctgggcaacatagcaagaccattgtctctaaaaaaaatttaaaaattagctagatgtggtgctgtgggcctggactcctaattactcaggaagctaaggtgggaggatctcctgagcttaagagttcaaagcttcgctgagccatgatcacactaatgcctttcagcctggatgacagagcaatatcctgtctcaaaaaaaataaaataaaaataaaataaaaagtttcttctaaggaatgataacacttcattatcactgaacttatgatttcagccagtcaagaaggttatcaacttggatgaatgctgtacttttttgttaatccaatggagaatagagatgctctttggtcatgacagctccagttattatgatcaattaaaaaaaaaagaataaccttcttgactaggcacggtggcccatgcctgtaatcccagcactttgtgaggccgaggcaggtggatcacgaggtcaggagtatgagaccagcctggccaacatggcaaaaccccatgtgtactaaaaatacaaaaattagccaggcgtggtagcacgtgcctgtaatcccagctacaccggaggctgagacaggagaattgcttgaacccaggaggtggaggtggcagtgagccaagatcaccccactgcactccagcctgggcgacagagcaagagcaaggctctgtctctaaataaataaataaacttctcttgaccatacaatcccgtagctagaggatgctgtgacttgcacaaacaaaagcatttgtcatgcttggcaataacctaagagcgtgtatatgcagtggaacaaacatttgacattgcagtatgaagtcttgattactcatgactggaccactgaagatgcttagaattcattatgatattatattagagcaggataaaccacagaattagagttaattcctgcacaaaaactatcttctctttaaccaattctgatattacctgtctcctgctagatttctaaggctatactcgtgtaacagaaacagactcatgttcagttcaagttgtcaaatacccaccattatgaaaagtcttgatttaaaaaaaaattttcaacaagagaaaaccaaggctgctaactgttgctgcagtcgttggaacaacaggatttctttgaatgttctctgtatcaacttatcccctcaaactctcacaagcggttaccaccgggtaagtagcccttattatttttgccagggttgtatagggctttctgggtatcaaaagtgtctcctactgaactgcgccatagctgttggtgtctattggcctcaccaagcatatgccagatagataatcttcattcccatgaagcaccattggtaatatactcattgtactttctgtagatctcaaaatccaggcaggcaacaagtttacacttaagccaagtgtttggagttctaaacgcgattccatataaatatggttaagagctttaaaaaaagtctctcaacttataaaacagaaatattctcaaaaaataagatataaggaagaatgttcacatgataattttattatcgacacacaatttccaaatacttattagtcttgaaaaaaatgcattagatgagaaatttgcaagcaaatttgtctaaaattaaggattcctttactaagtgaatcattactcctgcatctcattagtaaattctttttatgttttatttttgtatactggtggggtgttttgttttgttgtgtttttagggtgagacagttatacttatttggaaaacgtgatgcatgtccccaatttttctggaccgctctacagtaactgtggttcccagccagagcggcatgaggaggactgaggcctgactctcttcctgcgtccacgtccccacgtccccacgcccccacacccctgcaacagtaaggccctgctcccacccccgctgcgtcccgcccggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcggtgagtgcgccctgagcgcgtcccggccagaaagagctgggtgcgtgcactctgcttgctagacacgctgtggacccaacgtcctctatgtgggctggaggggggtgtgaacgatggaggaccaagtgataaaactaacaagtcaaagaaagccacaaactgctcctgtgcctgagtgtgaaatcaagacttaaatatgagtggggggagtcttgtttttctttattttcaacaagagagaaccaaggctacctatcttggttcaatctggagcaacaggatcccttggaaattttctttgtcatagttcaaccctatacaattctcacaactgcgttcctgaatgttgacctgggaagtttcttctctagcagaatcccctaggaatttcactgaatccctagcccttgctcctactttagaccccaagcaagttaaatatacattctgggtttagtgtctggatacaggaaaaggaattcagtgaggttcatgtcttcttatgtgccagggtttgaagtggaggagaggggaaggaagaagaagtcttgagatgctgtcttctgggttttttttttttccttttgctattgcttttttatttgtgaaaggctgtaggagggtagagaagagggtcctggggatcagctgggacagctgagttgcagctggtcggcaccctggagccagcacatttgctcagaagtgaaccaaatgtgacccttcttcatactctaaacatgctgctagcccagagctctaccttgtgaccactattgaagatagtgtggccatgctggggattggaaaggggacagcacagaaggcctggctgatttgccttttcccagtaggctctggagcctttatgtgacttctgggtgccttctagtgaccttgtctgtatgaacagcagtaaggaacactaacaactgccaggcactgttctaagtgctttgtattaatatacactaactcatttaacctcataacaatgctacaaggtaacattacccccattttatagagtttggagtaatttgcccaaggtcacacacttcgtaagtggctccacagctgttctgtgaggccacagcagcctaaagcaggagcctgtgcccctgcgggtatgtgaacatataacacactgccttgtgccttagagaccagaagagctgggggatcttcagttcatctcatagactgtcacagactgtgtttcctcactgattaaataagagtactaatatatggcaaatgagaaggcagggaaggctatatatatatataaaaaatctataggatagtaaatgactgatattgtacaagtgccaacaattttttgcatgataaaagctgagataactcttagtccctttaaccctctgtgtgtgtgtgtgtgtgtgcgcgcgcgtgcgtgtgtgtgaggtggtcacaaatggttcttactgatccaggccctcattctctgagtgcctcctttgtatgcatttacaaatggccaaccagattcgagttcagtgcctgtccacagcttccagtaatgagaagaaggtagaagacacactgttctctgtggattaattagtaatcaaaacacagagcggaaaaataatgcaacaatcaaacgccttctctcaaatagaaaatatttgaactgaatatgatcggagtatgaagctgctaaattctcttattcattcttaaattgattctctgtgatcttttgtgcaattctttaaatcttttccaatttttttctttccttttcgaaaccatatagtgttgattcagctatttaatgtcttttacatacttaaaagattgtctgtattaaataccatccattaaaaattcaatgtctaagcttttagctttaaaggatggttacttctcatttctctgtgcttacataaatcaatttattcagtactattttcctgtgcatctactgtaatagtcagcattctccaaaccaaaataaccaacagcatatccatgtctatctttctatatacatatagatagatagatagatagatagatagatagatagaaagggagagagagatttgttttaaggaattggctcacgtaattgtggagtctggaaggttcgaaatttgcagtgcagaccagcaggctggagacccagggaagagctgatgttgcagtttgagtttcagagtggtctggaggaagaatttcctctttctgggggatctcattcttttctcttaagactttcaattaactgcccacaaaaagagtcaaactctgtaaaatatttaaagaggtttattctaagccaaatatgagtgaccaaggcctgtgacacagccccaggagttcttgagaatatgtgcccaagatggttgagtcacagcatgattttatacattttggggggacagaagttataggaagacatcaatcaatacatgtaaggtatacattgattcagtttgaaaaggtgggataactccaagtatgtgtgtgtatgtgggtggggggtggttccaggtcataggtggatttaaaggttttctgattggtaattggttgcaagttattatccaaagacacggaatcgatagaaaggagtgactgggttaagataaggggttgtggagactaaggtttttgtcatgcagatgaagtctccaggtagccaacttcagagagagtagatgtgaacatctcttatcagacctaaaaaagtgtcagactcagttaattctctcctggatcaggaaaagagctggaaaaggaaggggattctctacagaatgtagattttccccacaagagacagctttgtaggaccatttcgaactatgtcaaagaagtctatattggggtaaaatatttcaatttctttcaggacctgctatctgtcatgtgatgctatactagagtcaggttgcaatttggtctctgactgccacagagagtctgttttttcagtcttaagatctctgttttaatgataatgctggtctgctgtgcctgaattccaaaggaaggagggtataaggaggcacgtccagctttccttcccattatggcctgaactaatttttcaggtttactttggaatgctcttggctgagtggggggattcattcagtcagctggcgggtggtggggggcttagaagtttatttttggtttactctgataggaggaagcccacccacattatagaggacagtctacttcactcaaattctaccgtttttaatgttattttcatctaaaaaacttcatagacacagctaaaataatgctttaccaatatctgagtaccatggtccagccaagttgacacataaaattagacattatacctacccaagaagaggatattgtgttagactctgaacatactgcccctgtgacagtacgttctgataagtggtattgaatagaaggggatattgtgttagactctgaacatactgcccctgtgacagtacgttctgataagtggtattgaatacacccagtcacttgtgtcacattaattgcatcttttgtatctgacattcttcctgggttttgtttctaaagttttcaatcaggtgtggttttttttttcttacatttgggcatctggttaatcaatttcagattcaaatagttacctagaacctcagttgtctgagtgccccagatctcttctctctgtgggggtcatcaataaacactgataactccaggtccctgggattttgccaactcacttgacagaaactcccagtaggactccagggagtctcctgggtggtcccaagccagcctgcagggcctgtcctggataccctcagctcaaggccttagggagcctcatggcttcaccaggcccatgttcagctcctctgtccacagcacctttctgcatgggctccaatcaagaagggaggatggacagagaaccgctctcttcctccactcgattgtgcctggcttcttcgtgggacctttttcaatagaaatcacacaatctacactcactgtgtttcaacttgatctttctcaagggagccacacccagtcacctcaggaatctctgaatttccagctgagatgtttttccataacacataagtcacctgtttccgccacttttcaggaaccatctagacctctggccacctttcacagccctctttggcctcaggcatgagcaaagccattatgattgaaaacagtaattacatattaataataatgaaagggacaaggagagagggagagggagagtgataaggtgagatgaattctcatgtggggagtctgggtggagagaatgggggaactcacactgtactcgctcatatggagagaggctgccgagctgattcgagtgccattgctcggtggacaggcctctttgaccactccccagtcctacctcttctcactcttgtgttattggtaaatgtgttcaaacaggctgttatttctgtgacagaacttagatttcagtatttttaacatactaaatttagcaaatcttggtcaacatttagtcatgtattccacaggcttacccataacgttttaagtgatttgggatttttcaggaatgtatattccccaacataaccagaaatactgttgtcttatttttatggaggattaggagagagagacagagacatcatggggcttgggtacctccctgggaagcgaaagcacccatgaaagaggctgagccctagcagctttccccttgattggtgccagtggtggcatcttggtgggcagtagagactggattgcatagctggtgttatgactcacgtcagtaacccaaaagagggcattttcttccttgctaatgggctctgtggcttgcactgccccacctgatggtgttgtctgcatagagatactctggtagaggcctagaggccaccccgacacacagcaacagtgtggccctccgcctctctcctctatagattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccggtgagccccctcctgccctgttcagtgtggcagcctcgcgggcggtgaggggggcgtttgttcctaatttcttccatataaaaatattactacagagtctgtatgtttagcttagggccttgggaaagctaggttaattaggtgtagggatgagcatgatctccagggatgagctaatttttatgatgctagaataaataggccaaattcacagaatttcctgtgtaggatatttcttctgagtaatgcctttgcgatgattcaacccttccctcacccactttatattctaattacaaagagaatctcaggaagttgcctccaagagagaatctgtctttgcatgctaccaattcttgtctaattgtgaaaaggttttgttgtttattctcattgcggcttgtcctttgtatgaaaacgttttagaaaatgaagaccatagaggagtttcagtgtgatactgacgaggaccaaattttgatacatgatttaattgagaaagtactgcttaactatgctaaaaactaagttatttgagctcaatagaaattactgatcagagtctaaaatgtctcagagccagccttgtggtcagtgacttggagagacactaaccttttttcccctttagctgccattacccctgtggggattgtcagagagaaaatgggaagcaaaatggcaacatctttgctttaatattaaaaagcctggaccaaacaatttgatggactaggtgtgatgctcagagaacaagacctagacattttttcttagattcacctcctcctgctgttggttaaaagaacattaaggggacaaactctgaatgtctgtaaatcagataaaagaattgcatcaatagtagtttcctgagtgtgatcattgtgccatgattatgtcaggaatgtcttttggcagcatctgctgaggtatagggggaggactgggcattgtgtctgcaacgcgctgcccagtgattctgaaaacaataacgacaataaaaataataatgagagagagggacagacaaagagagaaaacataaagcaaatgtggtagaatattgtttggggagcctaggtcagggtataggggaactcatactattcttgcaatgtttctgtaagtctgaaacatttaacaatgaaaagtgctttaaaagtaaaaaaaaaaaaagaaaagttaaaattttcttactgatagtaataggtcaaccaaagttgtctgctactgccacaggcactgctatcattttgctgtccttatgatcaagaaagtcagttcttcccactccccgccttttgaaaccgggggagggaagtgtggggagctagaaagcaagtgggtgagtccggagctggcctgggcctctgagaaggagcctgtgctctctgtgcctctcagggttggctccaaggtgactgtgaaatctcccaggtacctttcaggggcttgtatcctacttcccatctggaaacctggaggtgtggcttctcctggaaatggtaggggtggggttagggacagctccacagtggcagaggacagtcagaccgtcctatgctaggagaacggtgtgggggtagctgaggatgagggagccagcatgtgcagcccctggagacctgagcagtggagggatgggccccctccaggagctggtagatgctggcctgcatagatgcagctcaagaccaggagctctgtccagatctgcaaagagtgagatgtggggaggcatacaggatgtccctgcctgagcacaaagcaggacgcccacctgtcagcctgtgcacagacaggtgaggatcagggatgctctgttagtccctggatcccagaggcaactacagggagacctacagttcgccttgtaaattgagcctatcactggcaatgctgtgcgtctgtgtaggggcggcggggtgtctcacagccatgtcattttctcttttgagatttgttgaagcactttgcccctggaaccaggaaaggctctccagtggcctactccctgccagactggtatatccaccacagcaagccaccgacagccagccagcaagagtaagtaccttaaagcactcacatttttgtttatctttacaggaaaaaaatagcccaattttaattttaaaaatacaaatgtctaatagtggtagcaagcatgtgatatgacaacttcaggttctcttttacaatagcctgctctttgagggatgtagcctaagttgtcagaaaaccagagttctggaaacctgtggcattttgtgccaccctagagtcttgtgtctttgggctccttctcggtaaattgcactgtagtgttaccggcgggtcttcgttcttagagcttctaagatggtggcgggctgcttccaagatggtggtgggctgctctcaagatggtggcaagccttttgttctctgacctggggttcttggcctcacggattccaaggaatggaaccttgggccatgcatgagtgttatagctctatgagaagctgtgggtcacggaagagaaccgtggaacccagcgactagtgttcggctccattaggacgaacccgggcacttagctgcgcaggaacaatggcgagcctctagcccgatggggagcgtcagtgggtgcctccctggatcagaagtgcagcggacactctgccggatccggagaggtggaaattagcggcgggtctgcaacggaggcaatcagcagtggtggactgtgagtgaaagctcagctcaagccggaacaaacacagaccagaagagtgtgcagttgcgagatttaatagagtgaaaacagagctcccatacaatgggaggggacccaaaggggtttgccactgccggctcaaatgcctgggtttatatgccgatcattgtccctccccctttgctctcaggcaatagatgattgactatttctttacctcccgcttttagcctaattggtattttagtgaacgctctttactacctgattggtcgggtgtgagctgagttacaagccccatgtttaaaggtgggtgcggtcgccttccccacctaggcttaggaattcttagctggcctaggaaatccagctagtcctgtctctcagtaggactgaccacatcctcctgatgtagaaatagcagcctatcccaaagggttctcattaaagacaaaaggcactaggtaaagctagaaatacatgaaatcctaaatttctatgttcaatattgagatatggggagccatcgttcccataatatttgaaatgtctaagaaatttctatttgtggacatgcaaactttatctccagaaccacctgtcgtggattgagaggtaaaatgaaaaatcatttcaggccatttccccatttttttggcttgaaaataggactaccacaaatatatttccaagtggttatccggtgttacttgaatgttctgcacactgccacatggactttttcttcccttccttctgctttttttcttccagactgttggtacccctgtccctttgctgtctcctcccaccccatatgtccttaccaattgtccaagccttctaggatgatctacttctggggccttcagtgttttccgtcctcctgggaccttgtcctcctctggaccgcagaccacctgctccaggtcctgggacaggcagaggatgaagagtgggaagctcaggagaaatccttccttcactgaaaatctgggaacccaggagctataacttaacatgctttttgtttttaattgtccctccctttgttgttttcaatgctcatctgtttctgtgggctttttcctgccgagaccacatcagaagtgggaggcctggggagaggtgccgcttttcacacctgtgctccctgagcagctcagccacactcatggcttctcttactgggtatctgcgtccaccttccaagcctgcatttccagcctctgaccgctgctctctggcctcttcactcgctctctcggaggcccccagccacctccttcaggtgctttgctgcagtggtgcccagtaccccacgcctcgaccttgcccttggtgcccactttgcagctggggccttttttcagcatcctggagccctgaacaagtacaaatgaggagcaggacatgggggcatccctgcagcccctcagacactgcatggggggtttgtgttgccgtgtcaaacttgaatccagtgttcttccctgttcaaacctggttatgtgtacagatggtaccttcagggatctgaaggctgaagcattctagtgcctttggatgcccctcctgtgtgcgctgcctatatgggaagactggttgctagtttaaatactcacattaaaaatgaccatccaacaggaaacagagcatgttattattattttaaatgaacatgttaaatggtaaatgtttaggggtgtttagctattttaaggggtcaaagtggtagatgctatcctaaaagaaataattattttataaggtacgttttataaattcatattttagtatatctcgttttactaacgttgagaccttgtgatttctaagtgggcctcctgatcctgggacgcagggcctggaggggttggtgtgttgtttagcaggcacaggagggaagggcccgtctgtgttttcaaggagaatgggtagtgctgatgtcaagagagacggaagagaagagaataagggagggagagaaagagaaagagagggaaagaagaggaagaggaaaagagagaaagagagagagcaggagagggagagagagggagagagagaggagaaaggaaaggagggagacagtgagagaaggagggagacagaaggagggagggaaagggagagccagcgatggagatggaaggaagggagggagtggaaatggctctgagcaccaggctgtaactggtgtctgtccttgcagagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaaggtgacgggagcccataaatagacggcatccgcatccgctttgcttctgtggtctcgagtaattaagtgctgtgatgttagctgctggtggcgtcttatgttgctcgtggcatcggccacgtgctctgtattttaagtttggatctactaaaaggcaagcaggcaccatactatggtctttctttttctttttatgaataatgactttaagaggtaagatttctttttgctaaatgatttatagatagttaatgcttatctagaggaaaactggcatagcacttcttatcaggccaatatagaaaaggaattttatatttagtcatcccatttctgaatattttcatttatttaagtattaagagttttctgggacactctttgttgataataaaggaagagaagatgaattctcttctgtatgaagtcctggtggtgtatttgatcacaaaggagtgactggctgtgcagtgaagccttctcagaggatgtgtattttaagaatgcaatggagaaagttggaagcaatcttgaattgccagctctgttgttgggaagtcttgacaggaggaccttctatcccctttccttggtgctggaaggaacaagagccaggccttcagctccaccaagggctcagtgttgcccggggcatcagcaccaggtctcagattagtctcagttcttgcaacttcagggtttgtgagtgaaacggtgaagttcatattacaaataacaatagtgtttgatactgagaataagagtgaacaccgttgtcacctgatgggtgatcattttgaacaatgaagagactggatgtgtctcagcgtacgtggaagttgttgtgaactatttatgcctgattcctaggctgttgccttagcatcttggtttgaagggaaacccctcagtttattttggggacttgagtagctgaacaccaagtggaatgtcaactggctgcaatgggccacatgctttttctttaagatctccatgtccggctgtgattcagattttgggttgtttccatgatccgtgcaaaggcattagaccttttattgttgtttttttgtttttgttttttattttatttttttaattagagagaagttctcgctctgtcacccaggctggagtgcagcggcattatcatagttcactacaccctcgaactcctgggctcaagggctcctcctgccacagcctcccgagtagctaggtctacaggtgcatactaccgtagacactcagccaaaatggaccatgttaagaattagatttatctcttagtgttgcacaagtgaccaattacactgagctacaacctctagtgataaatgaacctttggatattaaccgtggctacagctcatttctacagaaatcttaaaatgctaaatgctgtatcactctcaaatcaagtggggtttttaagttagtacccatttacaaaaggtgtgctaggggctacacaaagttcctgaagccagcccttcactatggggaaggagataggatgacaaggggtggtggttaaagacacacatgctgagtatttaacaggtagagggacatggtgtcgggtaaggtgcaggggatgagcaccgcatcgggatgggctctgatttccctaataagacaacaccatcaccgctttggtatgaaggtcacctatgagtgatgatcacatcatgggcgtgggccagctgacaaagcgcttcctcagctgtgccctggcctcacacgggacacatggtggacacctgacaagacttagggcacatgtattgcctgttggttaccagcattcatgggggtcttgctcacctacagggtgatcgggggatcttgtttcttttttttgaaaagccatcttttcttcctataattgttagcaatacctccgtggattttgtttgcttcgttttgttttttcccgttttcccatagcatgtatttctatttcttttaataagaaacaatttaggtagagcgaaacccaccttttatagagaactgctccccaggttttgactaaggcgtcccttgtgtaccaccacagctgtcaaggaacatatagcagttctgttgcccccagcatttctacccctctttatagtcagcctctcccctgccccttgcaagccctgatctgttttcagtctttatagttcttctggacagtgcaggaacatcgccatcttggacaagcctctcattctaaaagttcaccttaaaaaaaaccgcctaaatccaaggggcatcagcctaatggctaaggtcaacacgaccatgaaccataggtaacatctccaaccagaaacattccaaactcctccctgaccagagacatggtagcccctaaataagctctctccagccaggaagatgccaggcccgagttaacccccctccgggctgaaagatgtctgcaccaagataacctcccctcctcccagagagattccaacccagccatgaacttctccacacacataaacattccaagcttctgataagccccctcaccccaaaactgatatatacttttagtctgtaagagaaagtgctcctgaccacaatcagccaggagtgcctctcaggttttaactaaagaaaacctgtctttgactgccacgccgcatttcgtgtttctttcctctttctttaattcttacacttccttttccagaatgtgaaatcaatggaatcatacggcatggcgtctttcctgcttggcttctcccatgtggtgtaatgcatttacattatgcatctacattacatacgcatggccatgctgttctgagtgtcagtagttcatttgtttctgttgctgagtttcattggctgatcatgatacaatttgtttatccattcgtttgttggtggacatctgggttgtttccagttctgggtgattattacaaaagcgtacaggtgcttttgtgaacatatgttttcatctgggtgtgggaagttccttcaggacgaggctcttagttcattgtttttcctcctgagcagatggcatctttactcaaatatagcaactgcttttgagttagtgatagtcccttttacataactattttgttgaatgagattattgctgaattatattttattgtgagcatttacaatgaccacattgaaagtccagcctataagctttgtatctttgctaccattagtgagttttcttctctagctgttgaatgctttccactaactcaaggttttgtgtgtttcctcacacagctgaggctaccggccattgactcaaagtatctgagcaaagcaggcaccccacttggccctaagaatcctgcaggaagtagactctccttcccccccgtgtaagtgcttgagctacgccctcactgtctggactgggtttgggtttggccttccgtctttcatccggtgatgactgcgctagtgacagcatccacacaacttcccgaagccctgtctgtggcctggcctggctgtgcctgtcgcctcctcactgtggtttctgttccttcctaatgtcattttgcccctgttgaacacatctgcccttccaggtcatgcttgctgcaggttggcagtgtggaggctctgcttctccatcaggctgtgccctgcctgaagcactccccctccaagataccaccctcaccacagttcacggggactgcttgtcctgcatgtaggggccaccaggtcctgacgtttctgtgtccaaggcctgaactgaggtgtccgcgccttgtaagcgtgctggctctgtttccagttggaagatatagcagacacactgacatttgctgatcctccagctgcagagtgaaatccctgaggccttaggtgtcttcttactctcccagaatccaagtttaatgctaggataaatgttattaattacctgactaattcttcaaacagcttcttgtccaatggggaaaaaacaatcagatacattgcattgtgacaaatgccatgagagcaccaagctcagagggaaatatacatgtattcatatgtgtttatatatatgtaagtatatatgtatacctagacatgtatttatagatgtacgagagagaaaataaagcattaggagtggccttgataacaaagtgattgaacccctcctgggcgcaagaaatcctcccacctcagcctcccaagtagctggggctatatgcatgcaccaccacacccagctaattttttattttttgtagagacaagatctcactatgttgcccaggctggtatcaaactcctgtgctcaaaaaatcctcctgcctctgtctctcaaagtgctgagatggaggcttagagagaacaggtggtgggctgctactgctcgagctgaaagctcacactacctctaccgtgtcaaactgccctgtcactcttcagtgtgggtcaggataagatatttgaagatgcagtagatggtgaaaggctaagctaacatcaagaaatgactggagacaaacctgtgtaagagagtaaaatagcagcagataatcattgataaggacaagaaagaaccaataagaaagtaatcattacactttttttgagatggagtcttgctctgttgcccaggctggagtgcagcggtacgaactcagctcacagcagcctccacctctcaggttcaagtgattctcctgcctcagcctcccaagtagcgggactataggtgcctgccaccacagctggctaattttttttttttttttttttggagacagagtctcactctgtcccccaggctggagtgcagcggcgcaatcttggctcactgcaagctctgcctcccgggttcatgccattctcctgcctcagcctcctgagtagctgggactactgtgtgggctaattttttgtatttttagtagagatggtttttcaccatgttggccagagtgctctcgaattcctgacctcaagtgatctgcccgcctcggcctcccaaagtgctgggattacaggtatgagctactgtgcccacctccctccctcccttcctcccttcctttcttcctttcttccttccttccttccctttctttctttctctctctctctcctttctttctttctctttttcttttctttctttttcttttctttctttctttctttctttctttctttctttctttctttctttccttccttccttttctcttctctttctttctttctttctttctttctttctttctttctttctttctttctttctctttctctttctttctttccttccttccttccttttcttttctcttctctttctttctttctctcctctttttttctttcttttttttttctctctctcttctttcttttcttttttttgagacagagtctcgctctgttgcccaggctggagtgcagtggcacgatcttggctcactgcaacctccgcctcccaagttcaagcaattctcctgcctcagcctcctgagtagctgggactacaggtgcgtgccaccatgcccagctaatttttgtatttttcgtggagacggggtttcaccaggttgaccaggatggcctcgatctcttgacctcatggctgcctgccttggcctcccaaagtgctaggattataggcgtgagccacggcacccagcagtttgttgttgttttttgttttgtttttaaaggtagttctgagcaatccattactatgagggaagggcatggtgttttcttaggaaggcttccctgtgaaatactagaattattactaattcttaattgactatcacaaagaaagattttggaagctgaactaaacatgctctcatccctgtacaagggatgctttgacatgcacttgctatgcttaaaaatggagacagtgagacagagaagcagagggagagacaaaggggcagagagagatagagggagaaagagagagggaaagacagagagagagaggtttgttaggtttaaagggacagtgacacctcctatttggtgtgttcacggaatactgcttctgctttatcattaacccttgtacttaagtttcacattacttttactctttttaaggcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccaggtgaggcacaagcagccatctgcatttattggaggcttggttaattgtgatgcagcagctgacgttcttatcacatgatgcgtctcgtaatgagaaatgagtaacccaaaaaccatgtgaaaacgcccacagaagtactaaggttacagataagcaagagagtaatacatgttttgctctttcctctttattcaaatgaatagcggaagtcatgacttttggggtttcacattttcttttatttgtcaaaaattttgatagtccatttgatataacaaacaaataatataccaaatagtatcaacttttaatcttccagatccaaacaatgttgaccctaaaaggacttttgcataagcagccggtactttttgagatcacttcttaaaaagctttgaaaataagtcaaaattcaaacttaaaattactccattattggcatgtcttaagctttgaataatttagaactttctccacaattagatgttcaaagtactatattagtttttatttattataatattttattttatttatttattttttgagacagagtcttactctgttgtcctggctggagtgaagtggcacaatcacagatcactgtagcctcaacctcctgggctcaagcgatcctcccatctaagtctcccaagtagctgggactatagacatgcaccattacacccagctatttttttatttttcataaagacaaggcctcactatattgccccggctggtctcaaactcctgggctcaaacaattcttttgcctctgccttgcaaagtactgagattacaggtgtgagtcactgtgcacagccattcatttttatttttaatagtacagaaagaattcatcttattttttcaacacatccatcttaaagcctattgacattgtgttcagtatccatagctctattaattattgaccatttgcttctgggaaacctgtttttactcttgaggcttgagctctttgattaagaggaaagatggcgtgttatacctcttcagacatttgaagtgtttggtgtggtgtggttatttgtaagtgaggtcaccgtttgccattctacaccctgttccttactgtatttgttgaacaagatctgccacttattggccaactctctcctttattatcctggaagatgagatggtgacaagttcatactcagtgttgttaaaaagcaccctattggctgagcatggtggctcacgcctgtaatcccagcacttcgggaggccgaggcaggcagattacctgaggtcaggagttcgagaccagcctgaccaacatggagaaaccccgtctctactaaaaatacaaaattatctgggagtggtggcacatgcctgtaatcccagctactcgggaggctgaggcaggagaatcacttgaacccaggaggcggaggttgcggtgagccgagatcgtgccactgcactccagcctgggcaacaagagggaaactctctcaaaaaaaaaaaaaaaaaaaaaggtttgttgccctattgaactttacaatgtcaagagtgttttatgacttattgttgttttaagtaatacagaattttcattaaatctttaagtaattatgacttcttttaatacttgatctgtttcattaacctgaacaacgaatgtactttttattacagagtcttctcaaagtgagtacttataaagtaaccagcaccaaaacacaaaaagtcttacacaaagaaattgatggacatagtcctgcattctgagactacagcctctaggcagcctggaatgtccttctccaaactgcatgcattctgactacaaagcttgtgccatgtatgctttaaaaaaatcagagttccagaaacttaacttagggagagcaaaaagaggatcgcttacacaattacaacaggatgaagatgatgatgatgatgatgatgattattattattattattattttttttgagatggagtctcgctctgtcgcccaggctggagtgcagtggcgcgatctccgctcactgcaagctccgcctcccgggttcacgccattctcccgcctcagcctcccgagtaactgggactacaggcgcccgccacaacgcccagctaattttttgtatttttagtagaggcggggtttcaccgtgttagccaggatggtctcgatctcctgacctcgtgatccacctgcctcggcctccgaaagtgctgagattacaggcgtgagctaccgcgcctggcctattattcttttattcatgttacacaagcaaaaacatactttagttcatggacacacattgtattactcgtcatgtgagagtcatactggaaaacataagtaaaaagccatcggagactccaatttattttttagtttactttttattttattttaaatcgacagataataattgtatacaactatggggtgcaatgcgatgttttgatatatgtatacattgtggcatcattaaatcaaggtaactaaaatatccattacctcaaatacttaccctttttttgtggtgatcacacttaaaatctgttcttttaatgattttgaaatatacaatatattattattaactttattcaccttgctgtgaaatagataattaaaacttaactcctcctgtctaagggaaacttggcaccctttgaccaacttctcctcttaccccatcaactactgccccatccccagcacctggtaacacattctattctacttctatgagttcaatttttttagattccatatatggctgcaattatacagtatctgtctttctgtacctggcttattttacttagactaatgtactccaggttcatccatgttgtcacaaatgacagaatttacttcttttttaaaggctgaatagtgttccatcatgtatataccacattttttttccttattcatctgttcatggccagtgaggttgattccatagcttggctattgtgaataatgctgcagaaaatttgggagcgcagatgtagctttgtgacatactgattccatttcctttgatatatgcccagcagtgggattgctatatcatacgagaattcgatttttagttttttaaggaaactccataatgttttccattatggctattctaatttacatttcaccttcagtatgtaagggatcccttttctccacattatcatcaacacttgcttttcatctttttgataatagccattttgacaggtgtgagatgatatctcattgtggttttcatttgcatttccctgatgatagtgattttgagcttttttgtatatacctgttggccatttgcatgtcttcttttgagaaatgtctatgtaagtcctttgcccatttttaaattggattatttgtttttttgctactgagttgagttccttatacattttggatattaaccccttatcagatgtatggtttccagatatttttcctgctctgtggcttgtcttttgttgtttgtttcttttgcttgcagaaactttttaatgtagtcccacttatttttccttttgttacttgggcttttggtgttctgtccaaaaaatcattgcccagaccaatgctggggaggtttttccctatattttttctataggtttagcatcccaaatctgaaaatctgaaatcaaaggaaatgctcattggaacatttcggattttggatttttggatttgggatgctcaaccagtaagtatgcaaatatttcaaaatttaaaaataattgaaatcccaaacacttctggtcccaaggatttcagataaaggatactcaacctatagcagttttacagtttctggtcttttgtttaagtcttcatctattttgagttgattttagtatattaaatgagatgaagatccaattttctttctctgcatgtggatattcagtttacccagcatcatttattgaagaaactgtcctttccctcattgtgtgttcttggcacctttgttgaaaattaattgactgttaatgtgtgggtttatttcttggttctatccactgatctatacttccatttttatgccagtaccatgctgttttgcttactctagctttgtaatatattttgaaatcagatgatgccatatatctgtttttttttttttctgtttgctcaagattggtttggctattcagagccttttgtggttccctacaaattctaggatttattttctatttctgtgaaaaatgtcattggaattttggtagggattgcattgaatctgtagattgttttgggtagtatggacattttgacaatattaattattctgatccatgtatgtaggctatgtttccatttatctgtgtcttcttcaatttatttcatccatgttttatagttttcagtgtacaggtctttcacctccttggctaaatttactcccaagtattttttaatgctgttgagagtgggattgtttccttactttctttttcagatcatttgttgttagtatatagaatgctaccaatttttgtctgctgattttgtagcctgcaactttactgaatttgtttaccagttttcacagttttttggtggagtctttagggctttctatatataagatcacattgtcatcaaacagaatatttcacttgtctctttataatctgaatgatttctatttatttttcatgcctaattgctctggctaagacttcaggtactaagtcaaatagaagtggtgatagtgagcacccttgtatttctcctgatcttagaaaaaaagctttcagctttcattggtgaatatcatattagctgtgggcttctcatgtatggtctttattgtgttgaggtacatttcctctatgcttaatttgttgagagttttttttatcataaaaggatgttgaactttgtcaagcacttttcctacatctattaaggtgatcatatggtttttgtccttcattctattatgtagtatatcacattctattaatgtagtatatcacatttaatgatatattatgtagtatattaacattctattaatgtagtatatcacatttaatgatttgcatatgttgaaccatccttgcttaccagggataaattccacatgatcatggtttatgatctttttaatgtgctgttgaatttggtttgctagtattttgctgtgaatttttgcatctatgtttatcagggaaattggcctgtaattttcttttcttatagtgtccttgtctgactttggtatcagggtaatgctggcctcataaaatgagtttggaagtgttccttccttttcaatttttttgggacagcttgagaagggttagtatgatttcttcctttacatgtttggtagaattcaccagtgaagccattatgtcctgggcttttctgtgatgggagagttgttttttttttaactgattcaatctccatactcattcttagacagttcaaattttctatttcttcatgattcagctttggtggattgtatgattctaggaatgtatccatttcctctagactatccaattcgttggtgtataatccttcacagttgtcctttgtggtcctttgtgttttgcagtatcagttgcaatgtctcctctttcttttcttatttttttcagtcttttcttttttcctctcttagtctagctaaatatttgtcaattttgtttataataaaaatactactctaacattttttatctcttctatcttttcttctgctaaccttgggcttagattattctttaggacctcaagttgaaaatacaaatacagcaggtacagaagatcaccttcataagatatgataagggttttattattctgcattgtcttaagaagatagaatttacttcaccattgacaaagtattacatattatctgatcaagggacgatcatttggcattcatataaatgtataaactttatattgcaggtgttatgtaatctttgtgtttatattatcagcaagatctgttcaattttgaagaaaccttttaacgtttcaaattaatgaaggcctaaataagcagcaaagcccctaagagctggaagaatcgtcatgtggagaagaggatctgctctgcttagtttctggatagctgaggcgggggtcactatgaaatgcctgctcccacctctcagtatctctgatgccaaggctagtgctagagcttttgacaaccacactctctccactgtcagtctgaccactattttccttcctgtatttcatttcctcttctgttttcctatttcccctgctgtccctcatggttttaactttataagcaataggcaatttagaaagtgccttttttccttccaactagacatctctccacttagagtgtgttgctataactttctggagactaatcttgtcaaggcttcttattttatttttttgagacagggtcttgctctgttgccgggcctggagtgtagcggtgccatcatggctcactacagccttgacctcctgggctcaagtgatccttctgcctcagcctcctgagcagctgggactacgggtgcatgccaccatgcctggctaatttttgtattttttgtagggacgaggtttcgccatgtggcccaggctggtcttgaactcctaagctgaagcaatccacccacttcagcctcccacagtgttgggtttataggcgtgagccaccacacccagcctaaggcttcttcttaatgtttctttccctccatgagacacaagattattattatttctttattgcaatttttttcagctgtcctagatgttttgacgtgccctaaagctgggcattaggaaactggtacactactgtactttgagagggtcaacattaatgaagattgcaacaggcttgggagcagggacacgtgccatgccgaggctgacagacagcctgagttgcccctcttctctactcgccttgcccaggctgtgctcatactatttatttaataattcttatcggtgtgcttatgtcagcagaaactttccaccatacacaggcaaaactcatgaattgaactgtttccaatggggcattctcttctggtctaccagtgcaaaagttgtaatcttgtgtttccaatgtattatttatgccaggatcataagctcaatttttatgtagacttcagaaataatccttattaataggtacaaaactatgtgttttcttatatttaaaattaatgttttttaatttatagaaaatgtcatctttgtctactcatttatttactttgtgttgcaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattagagtaagaagtttgttttttccctttcctattctcttcctttctctatattctcttccttccttacctcattcccagacacccccaccttaacaaaaaagtcatcaggaacagatatcaatagtgtagaacgcttcaattatttgtttagattattatagtaacagaaacctgtggtttaggaaaaatggggacaaaatttggagtaaggaccagtgatcaaatttaggctccacctacagtagccagtgttgacctaaacaacaagcagagaggctgtctgaaagcaaatggtatttatttgggaatgaagcagttcaatggaaatatagtaaaccatgcacatatagtaaactgcgcacatattcatggaggtcaaggaagacaaaaatagggaggattacataattgttttgacataattatccttgactataatgatcaataatgagggtgatgccagtccaggtttgaacaggcagtggctgaatagatgtcctcacagaagtatttttttaatgtatggttgcaataccctttgttcaaggttgcagttttatagagtcttttgtgatagcttttgctattctgtgcaattccaactatatggcatgctgggaatggaaaaactatggctgcagtaaaactatcactgatagatggggattagggaggaagaatgaatagatagagcacagaggaattttaggccagttaaactactctctgtgtaatgctacaacggtggaaatatatcattataagtttgtccaaacccacagaatttataacaccaagagtaagccttaatataaactatgaacattgggtgataatggtgtctcaaaatgggttcatcaagtgtaacaaatgttatcactgctgctccaggtgttgatggtaggagaggctgtgagtgctgagaggaaaaggaatatgggaactctcttctttatgctcaattttgctgtgatcctaaaactgacccaaaaagtctattaaaaataaaaaaaataagataatgccctacatgtcataaaaaaaataaaaactacagtgtaaaaaaagcaggttgggcatggtggcacatgcctatagtcccagctacataggaggctgaatacagactattgcttgagcccaggagttcaagtccagcctgagcagcatagtgaggccctgtctcataaataaataaataaataaataaataaataaatatttttataaagcaaaaagtgttgggtttgctgcctgcagtgctaaatgatgggatatacaagtggttgtatcacatcccttgagttaaaggttaaaaaacaacagatcaacttaggtctaaaggacaaatcagcattagtaacatttaaaaatgaaaataagggtgctcacctcagcagcacttatactaaaaatgaaaataaggaggaaaaattattttcaagtctttttgtccttagagagcaaagctcagcagctttgacaggctctcacactcttagtttagattgcatgtgggagctctttgtgaaacaataaagaggctgtctgtgcagttttaacaagtacaataatgtgctacagaaattctgattcagtagcaagctcttcaggtggtaagacatgaaccctcctttgagacatactgccctgtaacctgggtcaatgcaagtttgaattaaaagattttgttttgaatgtgccatgtttttatgaggttactaaaagatttgcaataaagtacaacttttctacccaagaatatcctaatttctttgaaactatccattatgtattaatatgtagctattccttgcctcatgaactatagatgtacaattattttaaaactccatcttggggactttctggtagttaagataattataaccatctaagctaaatctccccacacatcatttaaaaattgagcagatcaattaaccaaattgagcagatgtaccaatctttgtacagctataatataaagacaaccaccaatggcccatttcttcagcacaattagaaaaggaaggacgtcataagcttaaaatgacctgtaaatagacaaacataaacttccagtagagtcatttctgtagctcccaccacacactttactgaagatgagggaggatccagaaagactccagaaagagaagcaagggtggaggtaaaactacctgcagaaggaaaagtcccagttatgtgggaacatagtaaaaatgcatggtgaaggggaaatcgaagtggagaaaatggaagactctatcaaacaacagtaaaccaaaaaaaatggaaggacacaccatccctcccctgtacctatgaaaacagccactcaagaaaaaagtctttacatctcactactgatagaagatggcacatttgaattgtataaatcatcccagtagacaactctattcacaaaataaaatatattagaagtctttatctattaagagaacaataagacaaaggcaaaaactgagaataaaaatattttggctgataaaaattttctccaaaaagttaacagtgaaacacctctattacaacaattctcaagcaagcatttagagatttttaaaatgtatacacaacaacaacaaacatacactctggcttggaaatttaaaaactaagaacagaaattaattccatcctgtaaaaaaaagaacaaataaaatgagagtttatttaatttcaagaagaaaaagaatcaaaagaaaaattatatcagaaataaggactataagatgcccaaaggagaacagattccaataaaaatgtaatatgagtcattgaagaaaagaaagaaaagaacgaagagagtgaaaatgagatgaaatggaaaggattagagggaaatttgttgaaatggaagacaatgaaagaagattaaacatatgtacaattggattctctgaagaaggaaaaagctatatacaatggaacagaactaatatttataactgtaactcaagaaaatatttcagaaataatacttgaatctacatattggaaagatccacaatgtaccaggaaaacttatttgtaacaatgtcaagacatattctaataaaattataaggttttattgtaaataaaatatccccagttctctaaagatctaataacttacaaggtcaaacaaaattatccggcgtaagatttctcaaaagcaatatgcaaggcaacactgaaatagcattttcaagaaactcaatgaaagaatatatgaaccaagccaaactgtccctcaagtgtcaaggctatagaagaacagtttcaaacttgtaagaatgagccttttctgaagcaccagctagaggatgagactgactcagctaaaaatcactgaagaaaattcagcaaaaggaccactgatgagcacttaatatagttaattgtggacctgaaactaaaataaaagtggggaaaacatgaaagagtaatatataaatgttctatgttctgacaaactagaaataacataactaaaattttagaaaaggaaaagataaatctaaaataaaccctttggtggataggtcatacacagtactcaaagaataccattagaaactgacaaaacagatagtaaaaaattaaataagaaaacagaaataagggcactaagaaagacataagttaaaaaaataaaaacaaaacattacagagaaagaaaaatagtaaatataatactcataataattacaataatgtgactgaattaagactacacctgtaagtcatatcaataaatgcaaatgagcttaactcatctgttaaaagattttcattttggtttacaaagcaagacacaaatgtcatatgctggagacatgagacacatctgaaacaaaggattcagaaaggctaaaaatgaaatgatgagcaaaggcataccaggaaaacagaaataatagaaaacacaggtagcaatatttatgtcatacaaagtaaaattcaagcaataaacattacatgagacaaataaagaactttttaatactaaaagccagaagtcatgggaaagacagtacagttatgaatatctaagtatcgagtataacagagaccacttttatgaggcaggaactacaggaaatgcaaggagtcaactactaataggatactttaacagatcactctcagtgcaattcagatcaaccagaaaaagataacaaaggttatagaaggcctaagcagtgtaatcaatatgataggtcgtacggatatatatcaaaagttaagatgcgataatagaatgtataccttcaaatgcatgcacagaatattcacataaatagttgttatactggaacacaataatgtagaaatgtgcaaatactactctgaccacagctcaataaacctggaaattaatcacaaaatcaataaacttaaaaaaattcccaccaggaaatttttgaaaacctgcacaacttatatttaatgcccttgatgaaagagaaagtactaacctaaattacaaaatttctaaaaataaatataataaaaattctcctagtaaggacctatgagaactagacctaacacatatatacagagcactacacccaacgacagcagaatgcaaattcttctcatgtgtacatggaacattctttaagacagagcatacattaggcaacaaaataagcctcaagaaatctagtaagatggacatcatacagcgtatcttctccagccacaatggactgaaaccagaaattaataacaggaaaactggaaatttcacaaatatgtggaaattaaacaacacatatgtaagtgaccagttggtcaaagaagacatcacagggaaattaggaaatagtttgagatgaatgaaacaaaagcacagtatataaaaacttatggaggccaggctcagtggctcacgccttaatcccagcactttgggaagccgaagtgggtggatcacctgagatcaggagttcaaggcgagcctggccaacatggtaaaatccctactaagaatacaaaaatcagctgggcagggcagtgcatgcctgtaataccaactactgcagaggctgaggcaagagaatcgcttgaacccaggaggcggaggttgcagtgagccgagattgcaccactgcactccaacctgggcgacagaatgagactccgtctcaaaaaaacagaaaacaaaaacaaaaaccaaaaaaacacttatgggatgcagtgaaagcaatggtcagaaattataaatttagacaatttagaaattttcattataagtttagaaatttataattcctgaccactgctatcactgcatcccataagtttttttaaagtttttatatgttgtacttttttaatgtaaacaaatacatgaaaaaagaataaagatctcaaatctgtaacctatctttacattttgaggaactataataagaacaaactgaacccaaagttagcagaaggaagggaatgatcaagattaaagcagaagtcaacaaaacagagaataggaaaaaatacacactcaatgaaaccaaagttggttctgtgaacagattaacaaaactgacaaactgttagctagaatgatgaagaaagaaagagagaaaactcatattaccaaaaaaagaaataaaagtaaagacattgctaccaacattaaagaaattaaaaaggattataacactatgaacaactgtactccaatagaattagataaccaagatgaatggacaaattcttagaacactcatattacaaaaagtgactcaagaagaaataagaaaatatgaacagatctataaaaattaaagatactgacccagtaatcaaaaacctcccaataatggaagtagttttcactaattaccagttatgaacaacaatctttctccagctcttctaaaaatcgtaaaggaaggaatacttcctaactcatgaggccagcattactttgatcccaaagtcagataaaggacattgcaaaaaaagaaaattactatccaatattccttatgaatatagatgcaaaaatatttaacaaaatactgtcaaactgaatccactagcatattaaaagaattaaatgtcatgaccaagtgggatgtatcctaagaatgcaaggctggctaaattaatcaatcacattgagggaatgaaaggaaaaaaaaaccataatcatctaaattcatccagaaatgtatgtatagcatacacccacaatatatccaatatcatgttaaatactcaacacaccaggaattgaagggcacttccttaccctgataaaggacagttatgaaaaacctgcagctaatatcaaaatcaatgatgaaaggctgaaggctttccctctaagatcaagaaccagataaaaatgcctgcttttggctgggtgctatgactcatgcctgtaatcctagcactttgggaggctgaggcaagtgggttgcctgagctcaggagtttgaaaccagcctgggcaacacggtgaaacccgtccctactaaaaatattaaaaaattagccaggtgtggtggctgggtgcctgtagtcccagctacttgggaggctgaggcaggagaattgcttgaactcgggaggtggaggttgcagtaagatgagatcgcgccactgcactccagcctggggacagagcgagattgcatctcaaaaaaaaagaaaaaaaaaaaaagcctgcttttgtcacttctatttcaacaatgcactgcaattagggaaggaaaaaaaaaggcataccagctggaaatacagaaataagtagaattatctctatttccaaatggttctacagtttgagtgttggtgtctccctacttcaaattcccaattaagatagtatttagaggtggggacttcaggaagtcattaggtcatgagggcagagtcctcataaatgagattagtgcccttatagaagaggcttgagagaacctgtttgccgctactgccatttgaagatgaagaaagaagccaccatatttgaagcagacagtgactcttccaccagacactgaatctgctggccccttgatcttggacttcccaacttccagaatagtgagcaataaatttctgttgtttattaattaagaagtttaaggtattttgttatagcagcaggaacaaactgagacagatggaatgatcttatacagtgcagtatacagaaaatcctaaagaatacacacacacacacacacacccctattatatggcctatggccaataaatgaattcagcaaagttgcagcatacaaaatcaatgcacaaaaatcagttgcatttctatacttcaacaatgcataatctgaaaaggaaattaagaaaacatttccattttcaatagtatcaaaaagaataaaatacttagaaataaatttaaataaggaggagacttgtacactaaaaactacaaaacattattaaaagaaattgaagaatacagagtaaatccagagacatctgtggtcatggattggaagacttaatattaagatggcaacactcctccaaacaatctacacacttaatgctatactaatggaggcagagtggtactggcataaggagagacatatacaccaatggcatagaactgagcttccagaaataacatcatatgcctacagtcagttgattttaaacaagggtgtcaaaaccattcatggtgaaagaacagtctgaagttctaaccctttaactgtatcttggtttttcctaatcctgaagctaatctaggggctcctaaccaaaaaaggcatctcattatcgtataaatgacactctttttcactctggagattccacaggttttaggagttgtgtgccaaaaaccaaagacaaaacccgagtaacttttaaaaattataacacagtatatctggaaaaccctaaaaaataaataacaaaactaactcagactataagataaaccaatgttattggcatatatgatcaatatgcagaaatctgcaatataaattttttaattgacaaatacaatcgtatatatttatggtatgcaacataatgcaagttttgtatacacaaacaatgaccatttagatgataaaatagtagagaaaattccatttatggtaacaaaaaaggagactaaatatttgggaataaatttatcaacaagtaaaatctacatgagaaaaaattttaaaacactccagaagacataaaagtagtcttgaactagacatcccttgctttagccaggatagcaacattataaggatgccagttaatttataaatttaacacaatcccaataaaaatatgaataacccttttgaagtcaatactaaaatccctacagaggtcaggcttggtggctcacgcctataatcccagcactttgggaggccaaggcgggcggatcacctaaggtcaggagttcaagaccagcctgattaacatgatgaaaccctgtctctactaaaagtacaaaaattagccaggcatagtggcaggtgcctgtaatcccagctactcaggaggctgaggcaggagaatgacttgaacctggaaggaggttgcagtgagcagagattgtgccattgcactccagcctgggcgagagagtgagactccctgtcaaaaaaaaaaaaaaaaaaaaaaatccctacagaaaagaaaatatgcaagaatagaatgaaaacagttaaaaaggaaaatctacaagggagactaggccaactaaaaagtaaaacataccaaaaagccttcataataaaacagtgtggttctggcacatgaatgacaaacaggtcagtggaaaagatgaaaaaataatacaactacagacataggtaaatacgtgtataatgaaggtggcatcgcataatgaccgagaaaataaagtttttaatacatgggacaagtatacagccatttcgatagaaaaaaagagaaaaagagaaaattagatccatacctcacaccatacacaagcaatactcagcatggacactgagaagcacgtcgtcagttatgtggtgccaggctacagctgcaagctcctcatctctcagtcaagtgggaaggacaacagcgttgctaggtcttcttccagttctgagaaaagggagtcaaaattcatgaaacctgacagttgggtctccgccatcccagtctaaatgccctggtgagagtttaatctgtacatgatggcgaccacgagttaagacaccaggtgccatctggagtgtgagctacctgcagctcttcaagggaaaataggattcagatccactttttagataaaatagtggttctcagagcatgttcccaagggtgcttgggaatacccaagacctgttcaggagtctgctaggtcagaacaattttcataataatttaaaaactgtatttatctctttctcttattttctccctatattcaacagtgtttactgtactatatgacatatgattctatttcagattaaatgcagaagcagacctgagaatttaactgtctctattaagctggatagtgaaggaattggcaaaaatgtagaattatgccactcctcacacttttttttgttttgtaaagatatagttatgtttcatatacatgtcatttatactaatataatgggttaattattgttactttaaaataaattaataagtaaataggctaaatatattagttttaatttctaatataataaacatcaatagctaaatacctacatacacatttctttgaagtcttcagtgatttttaagagtgtaaaggggtcctgaaaccaaaatgttggaggtctgctgagttacagcaactcagagaggttaagtgacttccctgctatcacatagcatgtgtcagacagatgcctgtccacctctggacctttatgcgctttcctttcttgttttactgtgttccagcctttgcattaccccatacgatacacgcaaattggatgccaccttttgaaaacccttacttaaagaattttattttcatttggtgcagtatttgtgctttgccagtggagtataaaacacttaatctttccactcactcagacctggggctgaagtagtttacaggacaaggacaccaagatctccacttaggatgttacctagaaaggctttctgatatctcaaggttgtgcaagggaaagctaacaccatcatttcttttgagatagacctgctttgggcagccaactgccatggggtgaggtggtgtgggacacagaaggcaacaggggagaaataagcagaaaagaataaatgtccaaactgcttggcaatgcacagtgtatattacatagcatacaatgcacagtgtatattacaatgcacagtgtatattacagtgcacagtgtatattacagtgcacagtgtatattacatagcaatgcacagtatattacatagctgtatattacagtgtatattacatattacattacatatacacagtgtataatatattacacagtgtatattattgtatattacacagtgtatattacaatgcacagtgtatattacatattacaccgtgtatattacatattacaccgtgtatattacatgtgcaaaggtgtgcaatgtgcagtagaaagacacgcactttccctcgcgccactgcactccagcctgggtgacagagcgagactccatctcaaaaaacaaacaaacaaacaaaacacaaaacacacaaaaaaccagaaaactacaacccaactatatgctgtttataagaaactcacttcacttacaacacatgaaaatacaaaatggtcgtgtaccatgtaataatatttctgtcaatgacagagctcatatacaactgtggtcctataagactacaatactgtattttaaattacattttcagtgtttttgtatgtttagatacactaatacttaccattgtgctacaattgactgcgctattcagcatagcactatgctgtacaggattgtagcctaggaacaataggatataccatataacccagcctagatatgttaggtataccatctaggtttgtagaagtatgctctacgctgtttttacaatgaggaaattgtctaattgtctaatggtgcatttctcagaatgtatctccagtgctaattgaggaataactctacatcaaaatttgtgggatgcagctaaagcaatgctgagaggaaaatttatgcccatattagaattgaagacaggcttcaaatcaatattctaggttgtcacttcaaaaaactatacaaaagtagcaaactaagcccagagaaggcagaagaaaggaaacaataaagcttagagcagaaatcaataaagttgaaaatagaaaaacaatagaggaaatcaatgaaacaaaagtttgttcttgaaaaaatcaataaaatcaacaaatctctagcaagactgataagaataaaaagaaagaagatacaaacaccaatatcaataatgaaatagggaataccacaacagacatcgcagccattaaaaagatggtagaaaaaaacactaggaccaactttaccttcataaacctagtgatttataagaaataaatgaattcttcaaaagtcacaaactaccaaaactcaaccaagatgaaatacactgcttgaattgttctatacctattcaaaaaattgaattcataattcctcacaacttggaggtttcccacatggtttcaatgggaaattcaacaaaatgtttcaagaattaacgccaattttacaccatttcttttagaaattaaaagaggagagaacccttttcaacttatttcatgaggccagtattatcttgatgccaaaatgagatgagcacagcatagaagaggaagactgcagaccaatatttcttataaatttagattttaaaatcttcaagaaaatattagcaaacagaattcaagaatgtgtaaaaataattatatccaattaccaagtgaaatctattacaggtatgcaaggtggttcaacattcaaaaatcagttagtttagtgtagtttgccatgtaaatatgctaaagaagaaaaatcacatgattctataaattgacacagagcatttggcaaaattcagtatctacgtatgataaaagctcttagcaaattaggaatcaagaggaactacctcaatttgataaagaacatccacaaaaaaccctacagttaacatatttaatagtgaaagatgaaatgatgctttcctccaatgaccagaaacaaagcaaggatgtccactctcacccttcttattcatcatagtactggaaggcctagccactgaagcaagggaaaaaaagaaaataaaaggcatacaagtgggaaaggaagaaataaaactgtctctgtttgtaaatgagatgattgtctgtgtaagatttcccaaagaatctacagaaacactcttagaactaataagtgagtccagtaatgttgcagtttaaaaaacccagacatacaaataaatcactcttctatacacaacaatgaagatgtaagaattgaaaaatttaaaacacaatgccatttatgatcactccaaagataatggactgcttaggtatacacttaacaatacatgtacaggacctgcctgttcaaaattacaaaatgctgatgacaaagtttttaaaagacttacatatgtagagagacatactgtgtggattagaaggctcaacatagtaaacatgtcatttctactgttaaagaaaaatattattcatgactcttattaaagatagtagagaggttttattcaggacttttgcaacagatataggcaccactgtgatgggtttttacagtaggagagagagattgtgaaagcatatttgcaaaaattttgacagagaaacctaatatggctgacaacatcttgcttctagtctcacaggctgactgtcttcactcattcctgcacataggccaagctaatcacaggaggaatttagtttatagtttaagttggaaacaaggataacaatagcacttccctaaaactaagcccctccttgctcagggactcaaaattagtgaaaggccatgagattaggatcatgggagggacctgaactctgctaaaatgtaggcacagtttctataattctttacttcccaggagtcatgtggccagaggtcacaagattggtgacttcaccaattgctcctgtagataacatcactattgtagaacctaagattggtcttttgagatggttttcagatttttgccttctggcaaccagctgacttcatctggagccatgactcatggctctaccaggcatgtagcccacacccagaggctggctcaatttttcaatcagcagcaccaattccctagccccctacccaccaagttatctataaaaacttgtctctgagttttcagactgatttgagtgataaccccagtccttctgctcagctgccttgctttaattaaactctttctttactgcaataccatggtctcagtgaactggttttgtctgtgcaacagccaggacgaacccatcaggtgttacagctgggttcaacaactaatacaaggataagtgggaatttacagccaaggagctgtacagggtcagtagatagaaaattactaagagaaaacatctaggctaaggggattctggctaaactgaatcaacctacttgctgaagacaaggcaaggtgataaggtatctagggcaaataattagaaatttgatcagatatcaagcatacgggacttttgctaaattaactcagcaggattcttgctaaaactcaactaagtggacatatactatggactaaggacagatcaggttctagtcagaaaggggactcagaggccaggtgcagtggctcaacctgtaatcccagcactttaggaggctgaggcgggtgggtcacgagatcaggagatcgagaccatcctggctaacacggtgaaaccccgtctctactaaaaatacaaaaaaattagccaggcgtggtggtgggcacctgtagtcccagctactcggggggctgaggcaggagaatggcgtgaacccaggaggcggaggctgcagtgagccgagatagcgccactgcactccagcctgggtgacagagcgagactccattaaaaaaaaaaaaaaaaaaaaaaaaaaaaaagaaaggggactcagaggaatctgactcaagcttggtcaaaaaaagagaggcttagtcactacccaaattgatctataggtttgatacgatctctatcagaatcccagtatgttttgttttattttattttttcgcagacatagatgtgtgtgttctaaaatttatacgagctgggtgtagtggctcacacctgtaatcccagcactttgagaggctgagatgggaggatcacttgagcccaggagtttgagaccagtctgagaaacatggtgaaatcctgtctgtataaaaaaattaaaaaattaggtgggcatggtggcacacacctgtggtcccagctacaagtgaggctgaagcagatggattacttaagcccaggaagtgaaggctgcagtgagccatgatcgcacggctgtactccagtctgggagacagagcaagaccctgtctcaagaaaaaaaaagtatatggaaagggataggccttggaatagcttaacatcttaacaaagaagaatctaacaggaaaatcactctaccctatattaaagcctagtatagtgatgaaaagagtacagtatcgacagaagagggacagacacacacacgactcgaacagaatagaaaacccagaaacagacccacacaaataagctcaactaaactctgacaaaatgccaaagcaattcaacagagaaggatagccttttcaatgaatggtcctacagcaaccggatatccataggcaaaaaaaaaaaatcatcttcacccaaccatcacacctaaaaacagaccataaacttaactgcaaagaagaaaactgttaaacttttagaaaaaaacataaaaggaaattttcaggatctagggctgggaagagagtcttgacaacaaaagcacaattcacaaaagggatgatatatgaattaaaaattaaaatcaaattgaaaattaaggccaggcatggtggctcacgcctgtaattccagcactttgggaggccaaggcaggtggatcacttgaggtcagtagttcaagaccagcctggccaacatggtgaaaccctgattctactaaaaatataaaaattagccaggcatggtggtgggcacctgtaatcctagctactctggaggctggggcaggagaatagctagaacccaggtggtggaggttgcagtgagctgagatcacgccactgcactccagcctgggcaacacagcaagactgtgtctcaaaaaaaaaaaaaaaatcagaaatttttaaaaatgctctatgacagttcaaatatatgaagaggataaaacgacaaactaaaacagggaaaaaatatttgcaaacacgtactcaacaaaagactgatatctagaatatacaaagaactctcaaatctctacaagaataacaataacaacaacaacagaaaacccaaaccattcaattagaaaatggggaaaagatatgaacaaatatttcaccaaagcagatatacagatgtcaataagcatcaaaagatgctcaacatcggctaggcgcaatggcttacgcctgtaatcccagcactttgggaggccgaggcgggtggatcacgaggtcaggagatcgagaccatcctggctaacatggtgaaacctgtctctactaaaaatacaaaaaattagccaggcatggtggtgggtgcctgtagtcccagctacttgggaggctgaggcaggagaatggcatgaacctgggagacagagtttgcagtgagccgagatcgcgccactgcactccagcctggatgacagagcgagactccatctcaaaaaaaaaaaaaacaaaacaagctcaacatcattagccaccagtaagggcaaattaagaccacaatgagacactgaaacatcactgcacatccatcagaatccctaaaattttaaaaaatgacaacattaaatactggtgaggatgcaaagaacctggatctctcataaattgcttgtgggaatgtgagatggagcaaggacacctctcttagggacctgcagttcccccatccttcaagcacagcaataaaggaaaatcctgagtttcttcaagggaaattctaggcatgtagctggccctgagaagtacataagcaacctgataagcaagaaggtaactgtagcttagaacaatagccgaggaagctagaatcacaggatgtttggttcccctacagaagctaaagataatagcttcacatatgtccctgagttgtttttcaggaacccagacccctaccaaatggatctgccagcacatagacctcagataaggggaactggggactgaactcttgactatcattcttcattttaaattttttcctgaggggtctggaggaagtcacagccatgagccagaagtaacattctttgctgaccccaaattttaaaacaaagcttctcttccctagccagttggaaatcagagtatctttgaattaacctgtgacctgaaagctcccatttcatagcccatcctttaggccaaaaccaatgtgtgacctccatgtattgatttaaaattttgcctgtagcgtgtgctttcctgaaattacccctgccttaaaaacgccttacctggctgggtgtggtggcttgtaatccttgcactttgggagaccaaggcgggcagatcacctgaggtcaggagtttgaggccagcctgtccaacgtggtgaaaccccgtctctactaaaaatacaaaaattagccccgcatgatggcaggcacctgtagtcccagatactcgggaggatgaggcaggagaatcacttgaacccgggaggcagaggctgcagttggctgagattgcaccactgcactccagcctgggtgacaaagcaagactgtctcaaaacaaaaacaaaacaaaacaaaacaaaaaacccttagctgataggcatcagggagctcaggacttaagtgtgagctggctgatgctccttacttggtgcctacaaacctcagtgtggataactggttttcccatgccaggtgagtggactctatttcagttagataacagatataaaacattatagccactctgaaaaatagttgggcaacttcttatagaactaaacatgcaattaccataccactcagcaagtgcactctgggcatttatccaagagggaagaaaagttgttgctgagttgtatggtaattgcatacatgaaatttcatgccagctttattcttaatagcctaacactgaaaacagcctggatgtctttcaacaagtgagtcgttaaactatggcacatcacaccatggtatatggctcagcaataaaaaggaatgaactaccgatacacacaacatgggtgaaagtctgaggagttatgtggagtgaaaaaagccaattccaaaaggttacacactgtatgtttccatgtatgtaacattcatgaaatggtaaaattttaggaatggaagacagattagtggatgccaggcttagggttggagtgggtgaaggggaattgggggtgagatgggtgagctataaaagaccaaatgagggatcctgaaactgctgaggatcttgactgcgatggtatcacactgtgacagaatttttttttttttttttccttgagacggagtctcgctctgtcacccaggctggagtacagtggcgcgatctcggctcactgcaagctctgcctcccgggttcaggccattctcctgcctcagcctcctgagtagctgggactacaggcacccgccaccatgtccggctaattttttttttgtatttttagtagagacggggtttcacggtattagccaggatggtcttgatctcctgacctcgtgatcctcctgccttggcctcccaaagtgctgggattacaggcgtgagccaccgtgcccggcctcactgtgacagaattgtataggactaaatccagcacaaaatgagtaccagaaaaacaggaaatctgaagattggtggattatgttaatgccatatcctgggtgtgacaccctcctatagtttttcaagacattacctctgagggaaaccaggttaaggagtacaagggatccctctgtgttattccttaaaacttcataatcaattaaaatgcaatttaaaaaatgcaggggtcaatgggctagaatttcaggaatagggctctagaagaactggggttcagggaaggctatctgggagatgacctttacgttgagacctaaatgaggaaggaagagaagacgcctgcagggtgagtgaacactgagtggaaaggcgtggagcagcagcaggacatgttcagagagcaggaaaggaacccatggggacagctcaaggcacctggatgatctgacagcacttgtcctctcacagattcctggacatttccacaccacatgctttttggcttcctaagccaaaaagcacttccagaaaatgaacagtgaaccccttagtaatttatatcagcacacctttaagggtcatctctgccaggggtccccaatccctggaccatggatcagaaccagtgcatggcctgttaggaactgggctgcacaccaggaggtgagcaggaggtgaatgagcaaagcttcgtctgtatttatggccacttttcgttgctcatgttatcacccaagctctgccttctgtcagatcaggggcagcattagattctcataggagcatgaaccctattgtgaactgtgcatgtgagggatctaggttgtatgctccttatgaaaatctaatgcctggtgatctgtcactatctcccatcacccccaggtgggactgtctagttgcaggaaaacatgctcagggctcccattgattctgcatgataatggattgcataattatttaatatttcattatatattacaatgtaatagaaataaatgagcaataaatgaactgtgcttgaatcaccctgaaaccatcgcccccatacccccacgtctgtagaaaaaatatctgccaaaaaattgaggactgctgatctatgacaacatagatgtaagatttaaccaacctgaagtttttaaaaaagcagggatatagaaggtatctcagggcactgagtagttttttttttttttttcaccagtcgaagtttaataatttcaagatatactgaaaacaaaggcaagaaacacttaaaatgataacaattctcaaactcaaagtactgtttgtagacatcagatctaatgaggtcacatcacattaaaatgttattaaataattagctgtacaggcaatattctaagtactttacaaatatcaactgttttaatcttcttaagaaccctgggggagaggcactaatattaataccatttacaaatgaaaacacagagacagagagattaagttaatttaccagctgtcacacagctaataataaatgacgaaagtaagactcaaattcagcaatcaatggtttgatcccctgcactttgctgcatctcggagtgacttctgaggctcctgtagccagaaaggggcaaagcaaggtatagaacagagatttgacttccattgtctcatgctctttccataaaatcatctggtcagttcaaatgttcaactagtgttagaaagactaagaaattctatgtggtggactagtcaattgtcacaagcaaaaacagcaaaagaaatataaagtattcctgaaatcacaactttatgtgatatgattaaactatgatatacatttaaataccaacaacagaattcacaaactaacatatagaataattttaagtgaagtggctcattttgggttaaccccttgcaatcagctcacgtgatgtgaaaaaacaatataaccacaacccaaattaaaccaaagaagagctttcactgatatgaagcattgtttttgttaagccgcactacagcaaccatacccacacaaacagaactgacatatactaaagactttaccaataattagcaatgaaaatattcatgatgtcttccagcaatttaaagatacatcttctaagacaaacaataataatcagtgtatgtgcagcttttaaatagtgatttcatctttatgaaagttataacctcaaccttttaatgttgtgttttaaaaaaatcatacatttacacttccctaccaatgaaatttgactttttaaagactatagttaaaatttctatgctatttacaaggtaggataatagtttgacattcagttaatcaaaaatattatgtgttctcaagcatctgtaaatttagaatattataggctgaacatatttgtagagaattcaaactaccattattttattaagaacattaagtgaaacttgaaacttaacacatgatagatctttacttgtatcacttaacttatactgagtattttagcaattacatttttatttccagcaggtaatcaagaatacagattttcgtggcattggtggtagagtggtgatcatagctgccttctaaaaatgctgatttttatttatcttataaatgcgcaaaacgttttggagaaacaaaagcaaatttgaagtgagtaaaacttaacagttaacaccaggttacatagctggttaatggcagtccttgaaatacctagctcaaatctcaaaatcaaacaattgcatggggtaagaaatagaaagctttctactcctttgttctgtttgttatgctgcttcccatgcccagaaaacatgcagggaaccaagataatgcattcccagagctgcctcatcagaaaaatgaaaaagctttaccttgtcttcaaaatggctggtaacagtacagccccaatttattcatttttccttatgcttgttctctcccctaccaggtacacctaaatactgcctcttttttaaaaaaattaaaaatctgcaatccttttaatcctaggagctatactagtttagaagtttaaaataaagatgtaatgaggaatttggtgtcctaacaccatgagtcatagtgatacaatagcaatatcacctttactatgaagaatacctgagaccaagcctaggtaaaggaaattgcaggcctgtattgaacatgcaagtttcaggctatggtttaattagtgagtcaattttctgtctccagtacattggcacacccaaaccttaaagatatgtcacactcattacctagctggaaatcaagacaactgtaggacaaaactaagctgacagtcactagaaaagtgatgatgtctgatcaccagtgacacctcattttccagaccacattctcctacctaggggtacaaatgggatagagtgagacgagggagcaaatagctttacctggcatgtgagatagcaagcataaggaaacaatgatagattaaaactatactcttaccagccattgtgaaagcaaggcagcagacttcatttttctaacgaggtggctccaagaatgcctcatcctagctctctgcgtgttttctaaacataagcagcagaataacaaacagaacaatgaaccagaaaagccttctttttttttaaattttattactatgatactttaagttttagggtacatgtgcacaacatgcaggcttgttacatttgtatacatggggcactgagtagttctatatgatgagtgagagttggtgggaagaatctcgctttttgtattttggcaagaatttgctaatttgaatacatttttccctgacctcaaccatcctgcagaaccatattattcccctgcgtagacgaggaggctggctcagatggtttttggtaacttgcccagtcatcagctagggtgcggcatggccaatgacccctgtgtcaaatctcatgaggaaaatatctccatgggtcatatggcatgctgagtccagttcagaaatgaacccttattattcctgggtggaatttgtgaagaatttcagtctgagatagtggtttagagcaaaaccagtcaggtagaaggcttcttggaaaactggagagcaaatggagctgtgtggcagcaaggcatgagacaagggtgtttcctagattagatggttccagaggccctgaatgagaaataccacatcctgccagcaccacctctcctaaaggtgaagactgagagggcaagaaccagtcagccattggcatccgttgggtagctggctgtgactcctaagtgttttgtataaatatctcatggcctgtatcttttctgtaaacatggatatgcctgtgaagcctctgggcagctggaatcctgtgggaatcctccacttccttggaggctagccattgactgtgaggactaagctctgacgtttttttttatcttgccaattcttatctaaggggtctggggagtcatgccctataaacaatgaattctcatgagatgggttttatttaaccctatatatcgtgacttactttccaacctgactctggcataacattacgagacagggaagaaaataaaaatattttatcccaaaacatgtttctttgccatatcttgaaatggccctgcaaagctgtcctttgtgggggaaatttgcatctgtaaaaaatctctattaacatagctagagctttttcttccaggctctcccaattttaaagagattaactggccgggcacggtggctcacgcctgcaatcccagcactttgggaggccgaggcaggtggatcacaaggtcaggagatcgagaccatcctggctaacatggtgaaaccctgtccctactgaaaatacaaaaattagctgggtgtggtggcgggcgcctgtagtcccagctactcgggaggctgaggcaggagaatggcatgaacctgggaggcggagctttcagtgagccgagatcgcgccactgcactccagcctgggtgagagtgtgagactccatctcaaaaaaaaaaaaaaaaaaaagagattaactaagtgtctagcaccttttattaaagatctgaataggaaacatttgtcatctattgtctctaagggcagccactataagacttcaaataccctgggtctccacaatcttttatcttaacctggacatttcctttctatcaatccaggtctttagacaaactcaaccaattgtaaaccagaaaatgtctaaatttacctatagccttgaaccctgccccctaccccgctttgagttgtcctgcctttctggaccaaaccaatgtatttcttaaatgtatttgattgctgtctcatgcattcctaaaacatataaaaccaagctgcaccctgaccgccttgggcacgtgtcctcagaacctcctgagggccgtttgctgtgtcacgggccatggtcattcacatttggcttaggataaatctcttcaaatattttacagagtttgactctctttgttgactactaggaccagcaacctgggaaagtgatggctcatcagactggactcagctgccaggggagtgggcctgccactgtgagcctatctgagctgggggtgggtcaggggactgagtagctctatatgatgagtgagagttggcgggaagaatctcactttttgtattttggcaagaatttgaaatctcaggggtctgagtcatgctgtagtctcaccacaggcctcaggggagtcaacttctgacctggaggcctggtctgggtttgtggtgtctgagtcatagttcgtgtgataaaagtacgtgctctggtgtggaaagcaggcagaggctttttcactccattctgtctcactgacaatgaaaatgctagctgtgacccaccacatgggtttcatgacccacgaatggaccaggcagctgtttagaaaacactgcggctcaatttctgccctctctgaggggtgttctagaaatctgtatggctgctggattggaaagaaaagagcaattgcatgaggaattgggaagtgaggacaaacagagaagaagcctcagctactatctctaaaatattatctgagaaagaaaacaaacaaacaaacaacaaacacatttcttttcctgaggaaggtgagcctttaaattatcaggcccagagaacatttagaacagaacagcagtcatggctcacttccccttcagctaagtggttacctcttgaagccacttgctatgtggctgtagaataactgaggccaattagccataagatgccatccaccctatagttcaacactgtgtgggcaatcactaaccaatgttatttctgtaaaccaatgaggattcctgacaactctgcaatcgccccatctcctgagttgttcttttttctttaaaaacttgagcctcctttttgttcttggagcactccccatggcaacttagaagtgtgtcctgggctacagtcctcaacctgggcacaaataaactctctatgttaattttgtctcatctttcttttaggtagacacattagctttgggagaatttcaaagagtttgaagttacttagatttgggaaacctgaagggcagtggtgtgtcactatctggtgtggcctggccttcagcctctcagccccttccctccccacctctcagagctcagggccaactgcatctctgaaagagcccaaagaccttgttgaggagcagggggatcctggctgagcctgcaagccctgggtctcttccagactttcctgcctctagcagctgctgctctaggtggccattggtgggctgcatttgctctctgcttgcaaacattgatgacacaggtattttgggtgtggtttagtagtggcccgacacaattttgtttccagtttgtcacactgacaaggttttaacctgacaaatgttaaacacaaattataggaggccattgttttagactaagctcttgcactaggccccaaaagacaagactaaaaataaaaataaagtcacccatgctaacgtttcaggtcaccaaacttactggaaaggcgtcctgatcctgagccctagagaaagttcttggatctcctacaagaaagaatttggggtgagtccacagagaacagtaaaaggaagtttattaagaaaggaagggaataaaagagtggctactccataggcagagcatccccaagggctgctggtgggtattttttatgattactcttgaatatgtgctaagcaaggggtggattattcctgagttttccaagaaaggggtgagttatttggttattcccccttcccttttacaagggaacccttaatcctaagggttgtagagtcaggaaatatgtcagcaggagtcgactcagagactcttcatcttgaataggagctgggtaaaatgaggctgagatctgctggagtgcattcccaggaggttaggcatccttagtcacaggatgaaatagaaggttggcaggtggtatcacaagatacaggttacaaagaccttgctgatgaaacaggatgcagtaaagaagccagccaaaactggccaaaacctgccaaaaaccagcaaggtgaggaaaactacctctggtcttcctcattgctcattattcgctaattacaatgcattctcatgctaaacgacactcctaccagcaccatgacagtttataaataccatggcaacatttagaagttaccctatatgttctaaaaggaagaattcctagaaaactcatgaataatccacccttatttagtatatgatcaagaaataaccataaaaatagccaaccagcagccctagaggctgccctgcccatggaattgccattcttttattcctttactttctcaataagcttgcttctttcactttactctgtggactcaccctggccccgaattctttcttgcacaagatccaagaacattctcttggggtctggattgggacccttttccggtaacaaaactaaaactaagttgttaatctaccttcagagagagagaatagcaacttcctaaccaggccagtttcagtcttcagtctgaggcagcaaaatagggtctggaggcagggaacataaggccgattcacactttagctatgacaggaaatagcctctgcgtaggccaagtaaatgactttgtaactttgcatcatccctttcatttacatagtgtgtgccccaagcggaggacattgaaactccccaaaattctggaatggggcctttgagcccctacgctcaggcccgctcccacactgtggagtgtactttcatttaccttttttttttgagatggcgtctcactgtgtcaccaaggctggaatgcagtggcatgatctcagctcactgcaacctctgccacccaggttcaagtggttctcctgcctcagcctcccaagtagctggaattacaggcacctgccactgtgaccggctaggtttttttttttgttttttttttttttttacttttagtagagacggggtttcaccatcttggttaggctggtcttgaactcctgactttgtaatccacccgcctcggcctcccaaagtgctgggattacaggtgtgagccactgcgcctggccgtactttcattttcaataaaacccttaattccttccttgatttgtttgtgtgtttcactcttgtcacccagtatggagtgcaatggcgcgatctcggctcactgcatccttcgctgggttcaagcaattctcctgcctcggcctgcctagtacctgggattacaggcacgcgacaccacgtccagctaattttttgtatttttagtagtgacggggtttcaccatgttgggcaggctggtctcgaactcctgacctcaggtgatccatccgcctcggccttccaaagtgctgggattacaggcgtgagccaccactcccggcccaaccccatgttttctcaggaactggagttccctttaggaagcaagtaacagaggtgctgggctgcccgggcctctaggtcgtcttctttcccaggctctgtgctctcaccagagtgcgcgttcgggaagcagggagaggaccaggaaagacgcctgagacggagagtgggcaccggccgggggcaggcaggtccggcccctgggggtcagagtgcagcgccggtttgaggcagttcggccacttagctgcgactcgaagtgaatgagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtgggtaagaagatttcctctgtagtaggggctgtttaatgagtaacagaactggctgctggttctttacaattgcccagctgctctgcagaggcgagaagcaattgcgggctgagcctcccgggaccttcgcgggagggtggagaggaggaaggcgggggaggcggggccagaggggcagaggaaggtgggggcgggcggggcttgtctgcgggatggcccaggatgcggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggtgagtcgcccgcggcccggctcccgccgttctctcttcccaggggtctagcccgtcccctgccttggccacgtgcccatttacctgtaggggcggtgacggaggctctggtgcaccttggctgtgagctgcagaggagcagagagcggcccggcgcggctgcgcggggaggcgggcgcgcggccgggaggttctggggctggtgtgtgcggagcgaggtgggcgtgggggaagcgcgcgggcgggatgtgcttcctcgggtccaccccgtgcctacctctcccacgtcccggcgacggagcgcgcggggctctgggcggggagcccaccgggccgaggcgcagcgagggtgaagccagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctgccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgtttcatttaagaaggataaattagtgtttctttacatgggctttttgtcaaagtggaattttgttgactttactgatcttaaaattaacgcaaacttattgtaaaaacaaacaaacaaaaaaacccaaaaaccaaaaatcaaatatataacagaaaatgaaacttctaggttttcctcttccctaaagataaacaacaaacattcttcttccttctcctctctctctcacacacatttgcttttgaaatatgttcattcaaaaaagtattttaaatgtttacaagctaagttatttatgcaagtaacttaccaatctgatttgagtttaacgggttaaaactaaaaaaaaaaatcaaaaacatcttcagtttttttttttttttaagtaagatggatctggctggtaataggtagagagccccaggtgatcaccgaaaagactcttccttggggagccaaatcctaagccaggtttaggatttccctgggaggtagaatttgcagcccaggtaaaaccagcaaaactctcctgttatgtggggaggggagcgaagagcatggctttctagagaggtgagagaagacttgttgagaaactgaatttcatttccttacggaagttggagaacattgtggtacaatgttaggagaaaggttttctaaaatcagtgcagtctgacatcttcaacaccagggtcttttccactggagcactgcagacatctgcaactttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagacgggaagttctgtctttggcttggtttccttttctacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgccccacagaaactggccctggggatcaggactctgcctgaccctaaaccctacttcttccctcagtcggtaggtctgcttaatggatcctgaagaaggcctgaaatcatgaccagacccctacgccccgggatcctcctgtagtgccttttgataagaagcactgccctggcttctctctcctccttccacatgtgtagggagaggtagctctgcctattcatgaagcttcatccctacactgtccttcatttggcccctggtgaaccgggggccaaggtgtgatacctcttttaaaactcattcccttcacactggtgttgtgactcatgcctgtaattccagctacttggaggctgaggtgggaggatcacgtgagcccagtaatttgaggcggcagtgagctgtgattgcaccactccactccagcctgggtaacagagtgagaccctgtttgtttcttttttttttttttttgagacagagtcttgctctttcacccaggctggagtgcagtggcatgatctcgactcactacaaccttcatctcctgggttccagcgattctcctgcctcagcctcccgagtagctgggattccaggcatgcgccaccacacccagctacttttttgcatttttagtagagatggagtttcaccatgttggccaggctggtcttgaactcctgacctcaagtgatctggcctcctcggcctcccaaagtgctgagattaggggcgtgggccactgtgcatggccccctgtttctaaaaaaatgaagaataaagtgttgaattaaaaaaaaaatcaacaacaccacaccttattccccttcttagctctccttagctggactgcagtaggctgggatttccaaagaagtgttgtgtaaatgctaagggagaatgaaagcctggtggagagatttaaggcagcaattggagggaacatttttctccacacctaacaactgtagttttccctggcattcaaaatttgctggaaatgatcactatattatggtaataataaatcccattctccaaaaagggaccttttgggttttagcttggtgacaagagactgctgagttacgaaggtgagaaccgtgtggtggaaacaactggcttgacctcaggaaagcagcttcacttcacagactcctactgatgtctttatgagccttggatcatcctgtagacccagtgcttcactctcttcctctcagcatgaatcctgcccactctgcaaggctttccagggagttgggggcctggccattacagggcatttggggatttgtttctttattaactgagttcaaaacgtgagtctcaccctccttcaaagagctctggcaaaaccctgcccttctccacacagagaagtggtcttgggggtttctgactactgagccctagtagaataacttcaggtacgccacgtttttccttcatgggactttgcagtggagacggggccgtgggctgactcaggtcagcctcagtccctctccctcctatggtggtcccctgtccccgctgctccccctggagctgataacttttacccatctttgacccaattcttcctggggagaagagcatctgagattctagaaaagtgaggcagaggccaggcgcagtggctcacacctgtaatcccagcactttgggaggccgaggctggtggatcacctggggtcagcagttcgagaacagcctgcccaacatggtgaaaccctgtctctactaaaaatacaaaaattagctgaacatggtggcgtgtgtctgtagtctcagctactcgggaggctgaggcagaagaattgcctgaacctgggaggcggaggttgcagtgagccgagatggcaccactgcactccagcctgggtgacagagcgagactgtctctattaaaaaaagggaggcagagaggtgtggtgtgttgggtcagtgagtcttgacttgctgagctgggaaattgggaataagggacaggtttttgttttgttttgttttgttttttgagacggagtgtcgctctgcaacctctgcctcccaggttcaagcgattgtcctccctcagcctcctgagagtagctgggattacaggcgcctgccaccacacctggctaatttttgtatttttagtagagatggtgtttcactgtattggacaggcttgtcttgaactcatgatctccacccaccttggcctcccaaagtgctgggtttacaggcataaaggggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccacgggagccaatgcagagaaagctgaaagtcacaagtaaggctccatttcattccaggttgggttgggtggggttgggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctctgtctagtaggtttttcctctatgtgccaatttcttaaacaaaatcccctgcttatcactcagctctgccttggttctgaattttaaatgccttcttatttctttgcagtttgtcatacttctggtatgcttggcatgacaccacttgtgtttaggcattgctagaaaagcaagaatttcttgtcttcattctgattcctatgtgaactttaatccgctgattattcttattttctcacccccccagttgtctcccacctctgctggggttacctgggcaggccttctgtcctgccgccatggcctctccccagtcttggtggcctctgaccttggcaccacccagggttgtggtgacctctggccccccttgctctggactcctggtcctttgttcctctgtaacttccctgagacctctctgaagtctcacatgtgacagctgcatacccaggtcataattccatatggacaatgctcttctcctcctccattccccagaagtcctggtgtccattttggagtttctggtgcctgtggacattccctgcagtgattttttttttttgagatggagttttgctcttgtcgcccaggctggagtgcagtgagtggcgcaatctcagcttgctgcaacctctgcttcccagtttcaagcaattctggtgcctcggcctcccaggtagctgggattacaggtgcaagccagcacacttggctaattttgtatttttagtagagatggggtttcaccatgttggccaggctggtctcaaactcctgacctcaagtgatccacccgcctcagtctcccaaagtgctgggattacgggcgtgagccactgtggcctgcctcagtgattattttttaattgaactaatagtattcctggtattttcagtcattgacagccaaaaatgccttgtccccagtttctggagctcccctccttcctcctcctgccatggcttgaggttgaggcctagtaggaggctggtgggggtggaggggagtggtagaaatgaaggctggagaaaacagggccggcacaccaagtgccaagcaactcagtgagggtttcctccccttccctctcttcagtaattattttaccctcccttgttttatcctcagctatctgctaatcatgttccacttgctgaaaggcagtcaggtgtagagctcaggagtacagcctcttaggaaggatgtgaccttggactttgaatggggttactgatggtacttagtttatactgagagtattaaatgaattgatatgtgctagctattaataacttcatttctaccccaagtcgaaagccttccatgagtggaactggatcttactcatctttatgttcagtacacccagcacaggatgcttggctgttgcgagatgcagccagcattttctggagccctcccacttccccttccccagtacctcaggcccctgtgtctcacccatctcattttcttcttgtctccacatgtgctggtcctaagctatttgggcaagtttatataaaggttgatactgctttctcttccctgctgataaactcctggaatcagaagccagttttcattgctttcttttttttcctttttgtcttttattgagacagggtttcgcccttttacctaggctggagtgccgaggtgtgatctcagctcactgcaacctctgcctcctgggctcaagtgatcctctcacttcagcctcctgagtagctgggactacaggcatgcaccaccacacccagctaatttttgtatttttcacagagacagggtttcactgtgttgtccaagctgatctcaaactcctgggctcaagtgatctgcccgcctcagcctcccaaattgctgggattacaggcatgagccaccgcgcccagacagttttcatttcatttcatatatttcttttacatggtagatgctcaatgaatatttgctagatgaataaagtggtagaataaagcagaataaagtcacttgaaattatgtgtagactagagaaatatttttttccaggtagtatgtctctgacttgttattttaaaatccttcaaaaaataaattggggcatctactggttcattatggtacatgttaaatttactttttaaattttactttattttttatttttagacagtcttactctgttacctaggctggagtgcagtggtgtgatcagggctcactgcagcctcaacctcctgggctcaggtgatcctcccacatcagcctcccagggaggtgggactataggtgcatgccaccatgcctggctaatttttacattttctgtagagtcagggtttcaccatgttgccctggctagtctcgaattcctgggctcaagtgatccacctgcgttggcctcctaaagtactgggattacaggagtgagccactgtacccggccaaattttcatgttttaaaataattgcctgtcttcacggttacaccctacttccttcttcttcatttctcagaatcaaggagaaaagacaagtattttattttgaaatatgtgacaaagttgtcttaatcacatcctgttttgttattttgaagcatgactcttagcccttctatgttgtactctgtgtatttctaacatcctgaaggaggagaatggaaatgttacttacatgaaaaatagttgtcactaaaggatcctaaaatactgtggggtgtgcagatcgtcagaatttcagattggcctagagatcaaaaaggttttctgagaaaagttcaaggatggtccttaccacacgtgattctggatttggtcgcttgaaaaatggccttgccccacatcccagagtagaatgaaccctgattctggagatccccccaatagcttgtcaggaagaggtgggcttaggggcaggcgggtgtggctctgtgcttcaggcaggctgctgtgccttcctgagcagggttttcagcagattcactagtgcagtcagcagagtccctgcctgcccatacaggagacagtcacctagccccctgtccccttatacaaagatctccctgtctctgtgtataaccctttgtacttatgttttctatatcagcctttctgaaatgttcaggtgtgagctcacctgggccccactctaggggaattgatgggaaggaacatttgacagtcatgaaaggaggaagcagtcaggtataggccatctgtgtgtttggagcctgggtgtctgctgttgatgagtgccagatagaaatagggatttgataaaatgatagataaaataggatgggaccatctcaaccttgtttttcttgtctgtggtgtgttacgtgggattcagagatatataagacgtggtcatggcctccagaaatttttgttctggaggtaaagttattacattaattatgtataccagtgttaaaatatagataaggtgtaacaagcatcgtgtggggagagaatggacaatgtctgtgaggggggtgcatcccttatttaacagttatttccaaatccgtggcagctgagaccttgcctctcttgtgtctttttcttttctcatgagttagaatgaggaggagacatgaccacggggttcagggcagaaagtcagactcagaaggaagaaaaagaagtccccaattgctctgacatcagcatcccatgtctgcctctgtttcctgtaagggagcccacccatctctaggactcagaaggcatacattgttgaaggagctacgtttgaggctggctctaagggacttcgacaggcttgagggactcatctagacctggggcatttgttttgtaaggaaggttttattggaacacagacacactcactcatttgtgtgctatctgtagttgctttcacatgtctacggtggacttgagaagtagcagaaatcatgcagcctgcaaaaccacatgtatttattatctggccttttatgaagaaaagtttgctgatgcttgctctagaccagcatgtgccacgagcacattttctagcagataaacagatgtcttatcttgtcactcctattggatatcgtgctggagaagtggtagctagtgtaacaaaaacaaaaacaaattgaaggtatgcagattggaaaggttatctctgggaggtaggattagaggttgtttttccttctatttctgttcatatttcctatggtaaacatagtagttttaaaataaattcaagtttatacatcgaatgaacttgattagaggagcaactggctatactccctactccttgtatgggtagatcaaacatttccatctgtgtactttcgtgtgctcttctgatttcatccctgttgccctccaaacagagccatgggagcaacaggggttaagagggaggagaagggggaagaacagaggggaggcaagtgcggaccttggcaatgttggggttgtcttatctccgggatctggccctgtctttctcccaccatgagcctcgtgtctgacataggccacttctgtgataatgtcggctgtcgggcactgatgttctataagccttccactttcttgttttttaacagtgattgccccgtcagacttttaaatccaaacatagcaaaaatgaaagaagatattctctatcatttcaatctcaccactagcagacacaatttcccagccttgtttggagatgtgaaggtaagaggccaggtgttgacaccttggaatttgccttaagatcaacctccccctatattatacaggtagaccaacccacaaatgcttgagagaccacagctgacaggtttatgaagacataatgtttaccaaatttttgcaagtttttaactttcaagtatgtgaactagcaagtaaaactatcctaagtagtgccaaattgttccctaattcatcttttgcaaatttagtgcagtcatgcattgtttaactctggaaatacggtccgagaaatgcagccttaggtatttcatcattgtgtggacaacatagagcgtaaccacacaaacctaggtggtagagcctactacttgcctgggccatatgcctctaggctacaaacctctatagcatgtgagtgtcctgaatactgtaggcagttgtaacacagtggtaagcatttgtgtatctatacatatctaaacatagaaaagctacagtaaaatcatggtattatataattttctgggaccgctgttgtgtatatgtgattccttgcttaccaaaacatcgttacatggggcatgactatgcatttgaaactatatataaaataaacttcctaatgcttcattgagagaagagaaagatgtaaaaatttcctagggaagcaaaggatagtaaataaaggtcattgtattttgtttgtaatataagatacatattgatattctgtttagttaattgcctttaatgtcttattttgcttcatgcagcttccagttaactttttctacaaagtcttaagtcccttagttctgatttatcttaacgtaggactttgaaatgtctaatgggtaaagatgaactgacatgtagaattaaaaatcaaaatataccaggacgctagaatccagtgctgctacatgggatcataattaaacaatagtgttatgtcttatcaatcatcctgttctttgatagtgttggtttcaaatggtggacaacttcccatgtgcttttaattcattaaaatttcattcatcctattaagttaatccgtagtgatttttattccaggctatggaattttcttttttatgtttagagaataattaataattcttttcttttatcttcagacttttttttttaaattttttgacctggagtctcactgcccaggctggattacagtggtgtgatctcagctcactgcaacctccctgtcctgggttcaagcgattctcttgcctcagcctcctgagtagctgggattgtaggcacctgccaccatgcccagctaatttttgtattttttagtagagatggggttttaccatgttggacaggctggtctggaacgcctgacctcaggtgatctgcctgcccactcccaaagtgctgggattacaggtgtgagccactgtgcccagccatcttcaaactctttaaaaacttactcacttaaaaaaattttttttttcaaaaccaacattttcttacatgatgttctgcaaattaaagtttttacttctctgagagagacccatccagaatagctatcacttcctgagcctcctctaggcttcggctggctcttctcaagcattggctatttggcactcaagtaaccaggcgagagagcggtcagtagcccattttgtggggccctggtaacacagagggacagtgaggagttgctccctctgtttcaaacccaggctgtctccacaggccgccttctacatgacggagggaggccgagggtgcacaggacctggaattacctcctcagagagagcaagggtctggattcctgcgtttgtggagctgactgccttttgatgcttggccgcccaccctgaccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtgagtacctgccttcccttgtgctcagtctctaggctctgcaaccccctgtgccccacccctctgcacacacagacagctggtcccctaacacctgcttactgtaaatggctgggagcagggtgagcccacagtagctgggattcagagattattgaactcaggctatcgtccttgaggctcagtctccaggggcgactaagtacacaaatgcatatacaccgctgtctgtctacacagtgtgagggtggcaggtgcagggagttagagtgcttggggtgtagaggaaggacagtagggggcgccctgcctggagcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacatgactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaagcagagggtgtagggagaaaagagaaaggagataaaactttaacctgtggtggggtgtgggagaatagggtgggtatttatgcagggcttcaaatgctagaaggagctgtttgttacctggcaatagcagactgctgcttccctgctgagcccctgggtccgcagctgttacctatttgacaaattgtgtcgatcaaatggggttttgtctttgacagctttgcatacactttaaagtttcccaaagtgttactagttcttaaatttatatttaaaaagtttatctttcatcactatgtcaatgggcatgttagattgaattacatcacatgaaacatcagccagaacattgacaaagtcacaaccttggcttaacatgggtgtttctccctggttccagcatggtatgggcattccttctatctcaatcatgttgcatgagctcataaagctgctgtactatgcccggtgctccaacgtcactatcatccgcattggcacttctggtgggataggtaaggtctgcagaggggcctcttgccctgtgaatggatgagggactggggcatgccaaggcagcttctacatggtgtggcattagagacaaagagttcctttcttggctttgttcaagggaagcttgttaacaggaggtgtgaaaagaagcttgttttgttgtttttgtccaacctgttctcccaacccgcaccccagagctaggcagtagaagggcaccacaccatgcatatgggggaaactcatccttttggggttacacaatttgtgccttcttgtctgcttgattctgtcttattctttctaatcccccttcttctccattctctcctttcctttgcttacttttcctcctccctaatcctgcagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcgggcggatcacaagatcgggagatcgagaccatcctggccaacatggtgaaaccccgtctctactaaaatacaaaagattagctgggcgtggtggtgcacgtctgtagtcccagctgctggtgaggctgaggcaggagaatcgcttgaacccgggaggcggaggttgcagtgagccaacatcgcgccactgcacttcagcctggcaacagagcgagactccatctcaacaacaacaacaacaaacaaacaaacaaaaacccccacaaacatggcaaagaaagaatgagatttaatgagaaagcaaaagctaacaaattgttgaattgtaagccaaagtctgttaggcagatttgttttaaatacgtggtcttgctctctggggttccaactctgtgccattctttctgctaaaaactgggttctagtgattcctgctcccaccgaggtgttcagagctcagggaagaagcctgcatgtgccctagagaaagttgagctttgccgctgctggccaggcctgtgtgtacttgttccaggctgtctagggcctggactatctaggatttatagcaattctagaatttaagtgtcctgaccttgaaaggggacttgctttagacccaaatattttgaatatgttatcttgtctcttttctttttgttatatagagagattgatgcataaaatctgtgtttgtatgactgtaattccaagtttagcgaaattgtccctaggacaacacaccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaatgggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgcccagaacagccgcaggagtagcaatggaaagaggagttcagatacatgtggggagcgaagcaaaggtctttgcaatcggccatgttttttaatgtttcatgaaaacaactgacttgggagctctggaaaagatctgacttcttgttccctcccacatgtttaggaaaaccaattttgcattaaaataagtatcagaaatggatcatagttatcttagtccctgcaggttgatagacaagatgccattgactgagtggcttataaacaataggaatttatcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctggtttacttttcaagtatttgcctgaaatcttaaatattaacaaggtatgaaacagggatcaatgaaacacatcatggtatatggttcagtgacagacaacagtgggaaatcgccgtgaatggaagcaagaaatatgggacaaagtacttgaaggttcctggccatttttattttattcttttttttttctttcgaaatggagtttgctctttttgcccatgctggagtgcagtggcgtgatcttggctcactgcaacctctgcctcctgggttcaagtgattctcccgcctcagtctcccaagtagctgggattacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctctcctggagcccctcgctggggcccctcctcctggggcaccccgatacccatttctggtttctgtttccgctgcccccaagtcactttctgacatatgtgttgtcaccacaatgctgttcaatgtctgactgtcacaccctgacaaaatgcaggattctcagtgaccttgtgcaggaaaaatgacaaaaaagcttttgctgccccatgaggctgccaccaggtctataaaaaactcggctttcaaagcgctttggctttctgaattgtggttcatctaccctcaaggtactagccacccttgaaggccagctcacagctctgcagaattcccttatcacctcggccaaaacgtgcctttcaaggtggtgcttgcagccctgagctggtcctggaatggtgaattccttttggaagcaggcacgagaataagggagggacagggcagggtggtgtcagagagggaggagtcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaccacttgcaatgagagatgactgaaaaccaatgaagcagacagcaggggtgtttgagaaataatgcgtacctaaacaggcatatacacagtttccaaattatagtcacacacattcccaaaaccatccacaccagcttaatcacacgacagtaatcctcccacccattgtccacaatgctagtgtcttgatccaagtacctagggatgggaaacgggacacctgggctcaagacagcttgtcctattgtttctgtccatggcttgtcagccttgcattcattcctggcctcacactgacattcctagactccgtgtctcttagcttccttctcggttgcaccttatagtggaggggagaatccagggtggcccctctgtctgtctcgggtgagtctggcagcagctacttgggcaggcctaggtccccagctcaggggcagctgggtcttgggtcttcactggcttgtgggttgcccaggctcctggctgacttctcaactctccccacatcagtgtggccactttctggtatttattgtttcctgtccttgagatgggcttatttcctggtgggctctgagggacactcccatgctcaggggctctgcttagcagtttgctgtgtgacttggagtggccagggaggtgtgtggggaccttggtgtgggtgcatgtgtgtggtctgtgcactctttaatgtgccttccctgtgattctgagattcaacccaaaatgagggtcattcagcatctactgagcccacatgcccttctaagtgctaagagcaagagagatccttgtcccaatcaaaaacttccttcccttccaccttctcaagctctagggtctgtaatacagatttgcttagggtggagagtgagtctccttccatttctccctcagcacttcttggtccctttgttgaagctgtccaggagaaattggaaccctcaaggagacttcagggtcctgggatgtggctgtgcagtcatctgtgcacccagggcagcatgctaaaggctctgctcctggcttctcactccagcacgagctgcaggggctggacttgctactattgtgcgctcatctgtctccaaattaccaagtgcccccagacttcaactggatgtcaccatgcccctgtgggtgcaggacccagtgtgggatagcctttctatcctctgaccaaccagatgatgtttatcaccaggctctggggcaggctgaggatgcaggtgcggaccattgccccaggcagtaggggacttgcaggttaatttctttcacacctcaacccaggcaagtgtggccaggtgggcccgccacttcctaggaggacatctttgataaagcagagaaaaaaaaccacacagaaatagaatttaaggctaaagaggaggctgctattagtaagaaaagggctagtttgtttttgaggtgttttgtctctgcactgcctggaagtctgtctcgctgggggagctgtcacagagcctgtggcctgagcaccctcctccgggacaaggcagaaggtaaaatgacttctgaacatgagattctttctacaggtgtcaatggccaagctgcagctattggcactgcactgccctctgctggctatgtgaggtagtgcacatcagccacccccaggtggatctctgttgatctaatcgggcgacatccctgaccttacaggtgaactctataccccctgacacgcaggaaatgccggttgaacaacacatcttgttctgattgagtaaacatgaacttgttggattagtttatgtcggcctaaaaggaagaagctgaggcaaaattggtaaaagtagagaagtaactgggtccaagcttgaagactgcaacccaagaacatagattcaagttcccctgaatgaacactctgattagcagcacttacaagtggatttttaaaggtaaaagggacagggaatgggctgatacacagctgtctgccaggaattctcattggtttacagaaatgatattgatcaatggctacacattgttaagccatagagtgtgggttctagtattcagtgtggcattattaagttaatttatagctacttgtggcaatagcaagcagttccaagagatgaatacatagttaaaaagggggagtgattgatgtctttttcttgagacaaggtcttgctctgtcacccaggctggagtgcagtggtgcaatcacagctcactgcagccttgacctcctgggctcaagcaatcctcccacctcatccttctgagtggctgggaatacaggtgcacgccaccacaacctggctaatttttgtatttttttgcagagatggggtcttgtgtgttgcccgggctggtcttgacctcctaggttcaagcgcccctcccacctaggcttcccaaagcattgtgattagagacgtgagccactgtgtttggcttattgtcccattttaatgtctctctggctgtaataatttgaaaggtctcaaattcctcagatgaaagttattttctttcctcatttggctaccaagatgtctctggagctgacgttataaatgtcctcacatgagtgttacttgaattcctcgggagacgaccagaaacttggtccccttcctcaccccgcactggccactctttgactttcaggcccttgtgccacgctggtatcattggcttggtccccttgtgggggcttcccacaacctgggcactggccccttcctcaacccctcctccattcccagcgctggtgataaagactcttctgagcaggaatataatgacaccaacatggttcactttcggtgctttcagcaaggcagagagaattaggaatgtaattgggattgttctgatggaactaattaccctggatttcaaaaatcgttgtcagcgagttcactccatgttttcctctagtgcagtccttaagtgatatgctcagaatgcctcccactaatgtgaaaaaaaaatgttaataattatccagccctttgtaaattggaaaatcagcacgtcactagtgagttagtcaagagtttacctcaggaagcctgccacgctctcacataaaaggttgggctttggtgtcaattgcagaggtggccacgctcctcctgctgcctcctcgcggtccagtctcatcacagcggtgacaatgccaccttgaccagaaacaatgagatgatggtttgtctttataaatgacaatagggacagtggaatatgttagagcatgagctgtgcgtctcctatacctttatccttaagcctagcactaagccacgttttaaagccaggtgtccatcatatattgtattatccggtaattccactcctgctcctgggcttgcatggagagaactcatgtggcccaggaaacatggacaggaatgttcataattgcaaaggcctcggtaacaaaagccagaagtccccaaatatccatgtgccagagaacaaatgcaatgagtttggtgtgctcagatgatgaaaaacagtgaaaataaatgcagacaccttcaccatcagtacagaaccatctcaggtaacattctaagtgaaaaaagcaaattgtagaatagtacctacaacatgattccatttatataaagtttgaaaatggacaaaactaaacaatatgttgtttaggattacgtgcatttcattgtaagactaggggaaaaaactccaccagggattgagaaaccccaattgagatcaggagtttcctctgttgggaggcagggtgcatttgggaggaggggggacccccaaggacatcaaagatgttctgtttcctaggttaggaatgactttcacatcagggcttctgggttccattgcagcttactcatatttcagtactccttggtatgtatgtaatagtagaatatcatctcattaatcaccacccagacattaggctcaacttataaaataaggaagcagtgctagtataagaaaatagtactgctctgctggtgcttagtagtttttcagttaccacgtacatgaaggagagtgatttctgaccgattttcatggagtaggatcagctctgcagatgtgagcttttaataatagctaatatgtattgagccatcgttgtcaggccccttgtgtggaacttccatcagcgatcctgcctggccctctccccatctgtgttatccccaaatgccagatgaggacacagcctgggctcaggtctgtgtgagggttgggactgtgcggccacagtgtgttattcacatatgtgcacacatacacacctgtgcgtttccatgcacattcatgcacacattgtcatacatgcacagccatgcagaagtttacttactaggaaaagagtagcactcagttctctggacttcacaaggagaggagaacacaggtatgaatgtcagtccttggcatcccagcgtagtctgtgctgcggtggggtggggtgggggctggtaagagttctcctttagggtctctttcagtgaatgttttgtaggaagaaaattttaaaaagggtaaaatcatgactgccatacagaaatgaaatgaacatgtgtgttatggaaataaagccaacccgccagtggtaggcctttccatgtccagtctaggagagagaaagccccagttatgtgtgctgagactccacgcgtgtgggaggggactatgtggagggagtcttacattacacagtgaagtggaggaaaaatgagaacttcccccagatctccttgaagggtgactggatgatcttgtgacagtccctgcgtgcctcccgagggtgcctgagttatttgggtgcatgtgttcccagttctagggggcagaaggccctagaccttgctttataaaatcaaaatctctcacccggctgattctggaggcactctaaggagggaggagggaagcaactacctcccacaagaaaggttcatcattttatccttacacatggaaaatactttttttttttttgagacagtcttattctgtcatccaggctagagtgcagtggtgctatctcagctcagtgcaaattctgcctcccaggttcaagctattctcctgcctcaacctcctgagagctgggactacagtcatgtaccaccacgccaggctaatttttgtaattttagtagagatgaggtttggccacgtgggccaggctggtctggaactcctgacctcaagtgatccacccgcgtgacctgcccacctcggcctcccaaagttctgggattataggcatgagctgctgaattgcactcaccatgagggaagctggcaggtgctgtgactggttctcagaggcagtcccagtggcaggagttcacacggagtgaggagcatgaagtacagatggaagcagagccagcctctcagcagggcccacaggggcagtcaagcctctccaggcaggacagaagttctctacaattcccagggttgcaaatagctcctgtggaagggacgccagaagccctgcagaggcaccttgcagagtctggacaaggcagggttccctgcagggccccacggcttccctccagtgtgccgcggccagaggcaaaaggacgtggtggtggactgccttgctggcaggttcccaggcctgtctgggcaggttcctcccttcactgaacagcagtttcctttcctacgaaattccatgtaccacacagggctcttgtgacgatgggatgaggtcacaggtagagaagcacgggtgcgaggggctcatgaacagatttaaactcttccccagatagctgagcttggtgccatttgccctggggcctctttctggctcacattttcctcctgtggcagtagttccctgaggccaatccagtctcacctcaaccttaaacacccctccttgtgcccggccagttgtcacttgttatctgagggctgcacccctgcatccctgccctccttctcactgaggacacagcgggtcccctctttctagtcccacgcaaggatcactcctcggggctagctctgggctttggttcacgtgccccacacccagtccacgccaggctggcctctggaaggtgagcttctcactggggacaggatacagggtagtgtggcccaggaaggacatctggtcggggggctgaggagagggaggtggaggttgggagagaggcaggacaggcaggatggaaactgtgtttgtccatttgcactgctatacagaaatacatgagactgagtcacttataaaggaaagaggcttaattggctcatggttctgcagacggtgcaggaagcatggccctggcatctgcttctggtgaggcttacaattatggcggaagggaaggggagcaggtgtgtcacatggggagagaaggagcaagagagacgggagcaagtcccagattcttttaaaccaccagatctcatgtgaactcactcatcaccaaggggagggcaccaagctattcatgaggggttcactcaacacctcccaccaggcccacctttaacactgggaataacattcaacatgagatttggaggggacaatcatccaaactataccaggaacagtacttggggatggttcgtatgtgtgtgtgtgtgtggttttgtgtgtgtgtgtgtctgtgtgtgtttgtgtgtgtgtctgtgtgtgtgatcaaggtgtgggcagaactggttccttttgaggcctctctcctgggcttgcaaatggctgccttcttgctgtgttctctgttgtcttccctctgtacgtgtctgtgtcctaatctcctttcttataaggacaccaggcatattggatcaggcccaacacaatgactctgtttattcattcattcatttattttaaaaaatagagatggggtctcagtatgttgcccaggctggtcttgaactcctggcctcaagtgatcctcctgccccagcctctcaaagtggtgaaattacaggcatgagccaccaagcccagccccaatgactccatttaaatgtaatcacttctttaaatactccaggtagaccacagttgcattctgaggtcctaggtgttagcacttcaatacatgacttttgaggaaaaacaattcagcttataaccagaaggagctggcgtgagggccttgtgaaaacagaggcacataaatattaatggtgttgatctactgtcttggatgtaatacagatacatccagccctagtcccaaaacaaatgaccttcagtcagaggtaattttttaagtgtgcatttccataggagcaaccaatgtgtaagagcaggttgctcaaaattaatctggttttaaaaaattctacccactttgcttttcaactagaacatcatgatccttccatatcacctttccactaactgtgttgctgccacttaccaggccacctgtggggactggtcaccagtggacacacggccgagattgcctgtgtggactggtcaccggtggatgcagggctgtgattccccctgtgtgggctggtcactggtggacacagggctgtgattctcagtgtggactggtcaccagtggatgtagggctgtgattccccctgtgtgggctggtcactggtggacacagagctgcgattccccatgtgtgggttgatcactgttggacacggtgctgtgattctccttgtgtggactgatcaccagtggatgtgggactgcgattctccctgtgtggactagtcaatggtggatatgggcctgtgattccccctgtgtgggctggtcaccagtggatgtagggctgtgattccccctgtgtgggctggtcactggtggacacggggctgcgattccccgtgtgtgggctgatcactgttggacgcggtgctgtgattctccctgtgaggactggtcaccagtggacgtgggacttcaattccccctgtgtgggctggtcactggtggacatggggctgtgattattcctgtgtaggctggtcactggtggacgtggggttgcgattcccactgcgtgggctcgtcactggtggatgtggggctgtgattccagtgctgggtaagcagatgcttagagagcttcagaccctggcacgggtgatgaagaatgacaatatggcagaagacgagagagggttcttttgggagtggctactttagaatgattgttgggggttatgatacccacttggttgttgggggaacaggaacaggaagtctgtggctccagcagaggaacttgccagatacatgccagaggaatgaacgtggcatgtgagaagattccagtgaaggggactagtggtgtggcatacaaggtggctctgagctgctgagagcagattacacagattcctgtagatcacacgtgtccctgtagaccacacaggttcctatagacagaacaggtccctgtagaccacacaggtccccataaaccatacaggtccctttagacaggataggtcactctagagcacacaagtctctgtagaccacattttctttttttttttttttaagttcactgaaaaatgcatgctacaaatataaccaaattttatagcaggaggaaataagtgaaaccaagtaaaaccaattataataaaattgagaaaatatgggcagccaaaataatggaaaatagcatttttcatggtgctgtcacatttttcattgcaaatctaagaactaaatcaatgtcgaagcaatcacgtttatgagatttccatcaagttatatttattcatcttattcttcaaattgaaactttattacagtttagattagaaagcaaaacttgctaatatttttatgtgtattaaagcaaatttgacaacaatgtttcatattctgtaacttggctttggtcgttattttgaaaatgactttccatgtttttcttacagggcccaaaaggtaatcctggcccagtggtatggatgtctccatgttttctgtcatttaggatataggtctttgaaagaaaagaatcaggaagatggcctgctttcttaggtgttcatcagttaacatgtttgaggtgacaagcaggccaccaaagaaatgccaacatccatctttccctccctccctccctcccttccttccttctttccttttttttctttcattttttgagacagagtctcactctgttgcccaggctggagtgcagtgacgtgatctcggctcactgcaacctctccctcctgggttcaagtgattctcctgtctcagcctcccgagtagctaggattacaggcacgcaccaccatgcccagctaatttttgtattttcagtagagacgaggtttcaccatgttggccaggctggtcttgaactcctgacctcatgatccgcctgcctcggcctctcaaagtgctgggattacagacgtgagccaccacacccggcctgttctttatttttaagaggcattagagctgatgttgtcactgcccttgaggttcgcctcttcccatcagtgtgtttaaatcatcctgcgttggaggacggcgcacagaaagctctgataaatgggacggtttcttttaatagctctcttgatgattgattctattttaagtagattgtgggagataaatactgactggagagaaattccttcacatatctgccacctcccaaacaaaaaagaaaggaactgtttctctgctttaaaccagaccacattttcttcatccaatctgctgttgaggggcaccttggttgactccatgtctttgctattgtgaatagtgttgtgatgaacatacgagtgcatgtgtctttttggcagaacaatttattttcctttgggtgtatacccagtaatgggattgctataggttaaatggtagtaggacataggaatctttcgatttctatctctttggaaatctgtttcctgatataaaggagcaaattgaagataatgtaattggatacaggtcagccctttgatatcacttgggctgcaatccagttctttgaggaattacaaacaactgtccttgtcttataaattgagcctttacaaaaacaaaaatgtgactctggaagcaattcaaaactcatccatcctacttcccaaccctcaaacctcctctattcacctggagatgcatcaggtactgtacagtcaggacactgaaaatgtaggcatcctgcatctaagaaaagaggaagaagtttaaatagtcataacctaaaactctgatcataggcaaatgtgctccagaactctttgtttttgccttttcttttttttccccatacgttattggggtacaggtgatgtttggttacataagttctttagtggtgatttgtgagattatggtgcagccatcacctgagcagtatacattgtaccctatgtgtagtctttcaactctcgctcccctccaatccttccccgcaagtccccaaagtctgctgtatcattcttatgcctttgtgtcctcaaagcttagctcccacttatcagtgagaacatatggtgttggtttttccattcctgcagaactctttcttgaagaaaacttccatcttttctctgtgccattgaggtgtaaatcttctactctgtcttctcttggaccaaaaagccatctctttgaaacttccagggagttacaaacttccaggaaaattactttctacccccaaacccaagggaaacaaaagtggggttaggggaggctattaagaaaaaaactggcaaataaaaattcctgaagatttcttccacaaatattggtaagaaactttagccatctgagcagatttgtctcatcttccagaagcaacttaaattcagctatttttaaaatataaactaccgagctttgtgttattgtattgtaaaattttaaaacaaaagctacataatctctatttgcatctgtctgtttatatatgtgtgtttgcatgttatgttatgtagtatgatatttttctaccttcggatgatatgaaattaatatataaaatcccttaaaggcattctatttaattagcttgaataaaataagtgcttacataaatttagtattcctttttttttttttttttttgagatggagtctcgctctgtatcccaggctggagtgcagtggcacgatctcaggtcactgcaacctctgcctcctggtcctggttcaagcaattctcctgcctcagccccctgaatagctgggattacaggcacgtgccaccttgcccagctaatttttgtatttttagtagagacagggtttcaccatgttggccaggctgttcttgaactcctgacctcatgatccacctgccttggcctcccaaagtgctcacaggcttgagccaccgtgcccggccaattaagtattcttaagactttcagaggtgtagaaatgagtccaaacgtttctttttttaagttcacgtaatttgtgatactctttggtaaagaaagttttaagattgctgacaaaataaaaacacggtttccagagctgttagcattaaacataataaagacatacacttttttctacctagtttactagtcaaacaaacttatgttatctctattagatgtttaagattacaaagctataaatccaacctaagaacaacattaagaacaaattgcttgatgcatgttaagtgtggcagtgaggaaaacaaataaagaagaaccatatatttgctgttgtaatttccttgcttctgtgatttttttttactacttgcctgatatgtcaacaataaaaaaattaaataatttagaatgatagctacttttgtttaatgtctcatgaaattttcctgagcagtactggtgggaataggcccccaaaatctggccataaactggccccaaaactggccataaacaaaatctttgcagcactgtgacatgttcgtgatggccatgatgcccatgctggaaggttgtgggtttactggaatgagggcaaggaatatctggcccacccagggcggaaaaacgcttaaaggcgttcttaaaccacaaacaataacatgagcgatctgtgccttaaggacatgctcctgctgcagataactagctggagcccatccctttatttcggcccatccctttgtttcccataaggaatacttttagttaatctataatctatagaaacaatgcttatcactggcttgctgtcaataaatacttgggtaaatctctgttcgaggctctcagctctgaaggctgtgagacccctgatttcccactccccacctccatatttctgtgtgtgtgtctttaattcctctagcgctgctgggttagggtctccccagccaagctggtctcagcacagtacaaatataattgttaagaataagtaaattacataaatgtaagtgagattaaaaatgtacaaatgaactattcagcaatgattatgttttataatatgtctgcctgaaaacacttttcagtcttttggtaacttgcaaccttaaggttatgctaaattaaattaagtcatagatattcattaactgtctgggtcattcctaaataagataagctattgaaatgttaattactaagcaggagtaggcacttataaaccttgtttttatgtgatataaagtaaatatattcaaatttattaataaacaagaaattgtaatatgaggaaatagcaaagagctacaaaaatgtgagaggaatccttttttaaaattcaatttaatttttaatttttttatttcaataggttttgagagaacaggtggttgttggttacgtggataaattctttggtggtgatttctgatattttaatgcacctgagcagtgtacactgcacccaatgtgtagtcctttaaaccttaccttcctcccatccttccccacaagtcctcaaagtttgttgtgtcattcttatgcctttgcatcctcatagcttagctcccacttataagtgagaacatacaatgtttggtttgccattcctgagttacttcacttaggataataatctccaactccatccaggttgctgtaaatgccattatttcattcctttttatgcctgagtagtattccatcgtgtgtgtacgtatgtgtgtgtgtgtatatatatatatatatatatatatatatatataaaaatatatatatatatatatatatatatatatatatatatatatatatatataaatacaaattttatttatccacttgtttattgatggacatttgggctggttccatatttttgcagttgcaaattatgctgctatagacatgtgtgtgcaagtgtcttgttcatataatgacttctttttctttgggtatatacccaggagtggaattgctggatcaaatggtagatgtacttttagttctttaaggaattttcacaccgttttccatagtggttgtactagtttacattcccgctaacagtgtaaaagtgttcccttttcaccacatccatgctgacatctattattttttgattttttgattatggccattcttgcaagagtaaggtgataccgcatagtggttttcatttgcatttccccgataattagtgatgatgagcattttctcatgtttgttggccatttgtatatattcttttgagaattatctattcatgtccttagtccactttttgatggtattgtttgtttttttcttgctgacttgtttgagttccttgacgattctggatatcagtcctttgtcagatgcatagtttgtgaagattttctcccagcctgtgggttgtctgtttacactgctgattatttcttttgctgtgcagaagctttttagtttaaataaggcccatctatttatctttgtttttgttccattggcttttgggttcttggtcatgaagtgtttgtctaagccaatgtctggaagggtttttctgatgttatcttctagaattgttacagtttccagtgtcagatttaagtctttgatccatcttaaattgattttggtatagggtgagagatgaggatccagttttattcttccacatgtggcttgccaattatcccagcactatttgttgaatagggtgtcctttccccactttatgtttttgtttgctttgtcaaagatcagttggctataagtatttggctttatttctgggttattgattctgttccactggtctatgcgcctatttttataccaataccatgatgttttggtgtctatagcattacaatagtttgaagtcaggaaatgtgaagcctccagatttgttctttttgcttagtctcgttttggtggtgtgggctcgtttttggttccaatgaattttaggattgtgttttctagttctgtgaaggatggtgatggtattgtggtgggaattgtatagaagctgtagattgcttttggcagtatggtaattttcacaatattgattctacccacccatgaacatgggatgtgtttccatttgtttgtgtcatctatgatttcttccagcagtattttttagttttccttatagaggtcttccacctccttggtaggtatatccctatgtattttattttattttttgcagctattgtaaaaggggttgagttcgtgatttgattctcaccttggtcactgttggtatatagcagtgctactgatttgtgtgcatagattttgtatcctgaagctttactgaattcatttatcagatctaggagctttttggatgagtctttaaggttttctaggtataagaacatatcatcggcaaatagcaacagtttgacttcctctttatcgatttggaggccctttatttctttctctcctctgattgctctggctaggactagtactatattgagtagacgtggtgaaagtgggcatccttgctttgttctagttctcagggggaatgttttcaatttttccccattcagtacaatgttgactgttgtcatagatggcttttattactttgctaagggtattaatcataaagcggtgctggattttgtcaaatgatttttctgtatctattgagataaacatgtgatttttgtttctaattctgtttatgtagtgtatcacatttattgacttgcatatattaaaccattcctgcatccctggtatgaaacccacttgatcctggtggattatctttttgatatgctgttggattcggttagctagcattttttttaaggatttttgcatctaggttcatcagagatattggtctatagtgtcctcttttgttctgtcctttcctggttttggtaatagggtgatactggcttcatagggtgatttaggaggattccctctttctctatcttttggaatagtgtcaataggattggtaccaattcttctttcgatgtctgatagaattcaactgtgaatccatctggtcctagatttttttattggcatttttttcagttgtcatttcaatctttctgctttttattggtctgttcagggtttgtttcttcctggtttaatctaggagggttgtatatttccaggaatttatacatcttctctgggttttctagtttttgtgtgtaaaggtgttcatagtcgccttgaatgatctttgtatttctgtggtatgggttgtaatatctcccatttcatttctaattaagcttatttggaccttctctctctcttcttttcttggttaatcttgctaatgaaccctcaattttgcttatcttttcaaagaaccagctttttgtttcatttatcttttttatttcaatttcatttagttgtgatctgatttttgttatttcttttgttctgctggttttgggtttggtttgtttttgtttctctagttccttgaggtatgaccttagatcatctatttgtgctgtttcagactttttgatgtaagcgtttaatgctctgaactttcctcttagcaccacttttgctgtatcccagaagttttgataggttgtgtcactattattgttcagttcaaagcatattttaatttacaacttgatttcattgttgacccagtgatcattcaggagcagattatttaatttccatgtatttgcatggtttcgaggattccttttggagttgatttccaattttattccactttggtgtgaaagagtacttgatataattttgattttcttaaatttattgagacttgttttgtggcctgtcatataaatggtctatcttggagaatgttccatgtgctgatgaataaaatgtatattctgcagttgttgagtagaatattctactgtaaaagagtccatttattctaggttatagtttcagtccattgtttcactttctgtcttgatgaccagtctagtgctgtcagtggagtattgaagtcccccactattattgtttgctgtgtgtctcatttcttaggtctagtagtaattgttttataaattttggtggtccagtgttatgtgcatatatatttaggattgtgacattttccttttagactagtccttttatcattatataatatccttctttgtcttttttaactgttgtggctttgaagtctcttttgtctgttataatagctactcctactcccttttggtgtccatttgcatggaatatattttcatacccctttaccttaagtttatgtcagttcttatgtgtttggtgagtctcttgaagatagcagatacttggttggtgaattcttatccattctgccattctgtatcttttaagtggaacatttaggccatttacattcaatgttactattgagatgtgaggtactattctattcatcatgctagttgtggcctaaatatcttttttttttctcattgtattattgttttataggccctgtgagatttatgttctgaggaggttctattttggtatattttgaggttttgcttcaagattagaactccttttagcagttcttgtagtgctggcatgatagtggcaaattctctcagcatttgtttgtctgaaaaagactatctttccttcatttatgaagcttagttttgctgaatacaaaattcttggctgataattgttttgtttagggatgctaaaaatatgaccctaatcccttctagtttgtaaggtttctgctgagaaatctgctgctaatctgataggttttactttgtaggttacctgatgcttttgtgtcacagttcttaagattttttcttgcatcttgacattagttaacctgataactatgtgcctaggtgaatgatctttttgtgatgaatttcccaggtgttctttgagcttcttgtatttggatatctagatctctagcaaggccagggaagttttcctcgattattccctcaaataagtttaccagacttacttagctcttttcttttcttttcttttcttttcttttctttctctctctctctctcttccttctctttctttctttcctttctttcttctctttctctgtttctcccttccttccttcctttctctctctctttctttccttcctcacttccttcttctctctttcgctctctctttctttctttctctttctctctcttttctttctctctctgtctctctctctctctccctgtctctctctctctctttctttctttcacatctcactcagtggcccaggctggagtgcagaggcatgatctcagctcactaccacctccacctcccaggttcaaataattctcatggctcagcctcctgagtggctgggattacaggggcctgccaccatgcctggctaatttttatatttttagtagagacagtgttttgccacgttggccaggctggtttcaacctcttgacctcatgtgatctgcctacctcagcctcccatacttaaattttccttcttccttgggaacaccaattattcttaggtttgatcatttaacataatcccaaaaacttcttgaaggcttttttcattttttaaaattcctttttcattgtctttgtcagattgggttaattagaaagccttgtcttaaatctctgatgttctttcttctacttgttcaatgctattgttaaaactttctagtatattttgcattgctctaagtatgtctttcattatcggaagttgtgattttttttaaatttatgctatctatttctctgaagacttttttcatccatatactttattatttttaaatttctttaagttgattttcacttttctctagtgcctccttaagtagcttaataatcaacctcctgaactctttttctggcaattcagagatttcttcttggtttggatccattattggtgagctagtatgatcttttgggggtgttaaagaaccttgttttgtaatattaccagagttgtttttctggttccttctcatttgggtagagtatgtcagaggcaaaatctggggctcaagcgctgctgttcagatgttttgtcccacagggtgctcccttgatgtagtgcttctccccttccctagggatggggcttcctgagagctggactgcagtgattattattgctcttctggaggtagccacctagagaagctaccaggctccaggctggtactggggagtatttgcaaagagtcctgtggtgtgattcatcttcagctctctcagctgtagataccagcacctgctccagtggaggtagcaggggagtgaagtggactctgtaagggtccttggttgtagttttgtttagtgtgctgggtttctcgaatgctggttgtgctagcagtgaagttgtcatatggacagactcaggacctctggttttccaggatgttgcaggtggtggaattagcttccttttggttgttttctcctttcttggagcaggaaaaaataattttattctgaaggagaatgactggttgttctagaataggaaagcagataaaaaccggacaaaaactgagaggatataaaaaataaaaaatgttgtagaaaattttcaaaaaaggagtttgtgtggttgagctgctaagattgagtggatttatctatgagttaaaaaatgataagtcttagggtcaaaagggtactaatataaaattaaaatggcaatgttttttcagattgttagtctgctcttaataaattgtgaaaggtttttttttgtctctgagtaatctccctagaaaacaaatatttttgtgttttattaaaaataattttctgtgcttcttgtctttatcaggtctttaattacctaaggaagctgactcttctcaatattaaaaaaagctagcttttgttctcacctatgtaaccttgtatatttgcctttacagtattttattatcactttatttaaacagatagctaagtattatataataataatctgagattatatcctaggatctgtgatcctaattaagtattaaaaccttttgattttttttacatctcaaaatcaaattctaaatgtggcctttttttttttttttttcttaccttgaactaactttgatcttttcttgggggctcctggaaaaacttaaaattttttttgctcttacaaaaagatatatgttaaactacttaggcttacttggtagttaagttacatggaaaacattgccaaataagatgtgatgttgaattttctttaagttatatttgtatagatatgtagtattaatataagtgtttcagaaattctgtgaggtcaacaaaaatttgtcaataccctagctgtttatgacagtcaaccataatgttatcaggtgactgataaggacctctctgatggctcatagaacctccttctgcaataaacatacacctggagtgagctgataaagagaagatgaggcttcctcaggttttgaattttataatgatctaaatggagaacctttgttaaaaatctgtgactttaatttaataaaaataaagtgtccaaacagtctcttaaaatcttttgtgtaatgattgcttgtgggactctggaagtattgttttaaattgcctatgttgtgaatatattgttatcctggattctttctcccacatccctaagctgacatcttcatagtcaagcttgaacttgaccatgaagaagcaaggaaaaatgaatattctctccagcccctttctagattgtctaatggtcattggtttctaaatgactttgaataccactgctggtaggaaaactcttacatttaaacaggtttctccactgcagaacttgttagtagaacttttcatctgcgcaattgaaatagaaattgggacctaccactgatgactaattaacagctgtatccaaataggttggtgtgaacttggaggaaggtcattaagacatttgtgtgaaaaaaaatctgaatgtctgaggctagcttaatgcaaaaactggtaaaagcaaatgcactcatagattcccagagctctactgttagtgtgcaaaatgtaaactgttactttttaagtgtgtacaattgtgaaggtgagagattcagagctagatcatatctccgggtatgaagcttgcagatgaccaagacagaatgtgatccttcttcaacctgagggagatattgagtagaggggaggcaggttggatgtatttttccagattcaaaacagaaaagattctggtatccagcatattttggttcagggtagaactttaataacaggaaggaatgttcttttcttgacatccacttctttcttcttccctttgttgcggagactttggtaaacaatccaaagaggtaaactgtatcagcccagtgatatatcaatgaacaccttccagaggtcaataatattatcaagataaaaaatgtttgtcttgaatttttgattttctttgaagaatctgaagaaataaaatatcttccagagattctgtcaaaaatctgggagtgagtctctgaaccctaggggtctcacactgttatcgacaataggttggatctgagatcctggcaggacgataaggtcctagggagaagaagagggatatgagaaatagggagcataaactttaaataataaagttcagaaaatatgattaaacattgagattatccaagcagaaagcttgaggatggccacttgggaacaccaattccaaaccaatggaatcagcattccaaagtggagaagttacggtttcacatatggattagtccattttcacactgctgatagagacatacctgagaccgcacaatttacaaaagaaagaggtttaattggacttacagttacatgtagctggggaagcctcacaaaatcacggctgaaggcaaggaggagcaagtcacatcatatgtaaatggcagcaggcaaagagagagattgtgcagggtaattcccatttttaaaaccatcagatctcgtgagacccattcactatcacgagaacagaatgggaaagacctgcccccatcatctcccacccggtccctcccacaacatgtgggaattatgcctacttatgtaggcagagacagagaaattttacactttccatacaagaccagtgcatagttacaaagatttgattggttacaaattgctacattccaaggaagattattactcggtgaggagggatagtgatctgagggagtcttatctctggtgctgtctggtcttcctaattatttacaggaagaaaatgcagcagactgtatagacatacccccttaagggtcagaataatttaacgttacgacagctttaagtacaattatttaatttcacattttccccttttcattaagatctttcaaagaaagtcttgtagataaactcaaatggtttgggctccttttggttcaggagtttaatcccacatcactaggaaggctaattcttagagtgtcatgtctcacagaagaaggagtttgtcaggctctaaagctgatggggtataggctgaatttaaagcaacataaaggaagtggctttgagacctgagtcaggctgcatggctacaacttcaattaatgcaattctttgaatgacaattattttagtttttttcagttgtgcattgactacattgtgaaagaatgcctcagcagcagtaaagacaaaacaaaacaaaggattatagttttgagaacaagtaaccaccaaattctgcaagatccaaaccagctgctcagccaatcttttagagaggatattggatctgaaagggtagttttttaagctttcatattggtgattaagttagtgatgatctgactcatctggggtacagacataacactcagtttttatgacagcacaggtttctccttgggctgcagtgagtatgtctgcagcccttctcataagagcaatgccattgtttaataacgagataaccatgcagctatcatttagggcctcattttatatagttggttagggcctctacatgccaaatggcatactcaatacacagttgggcagaaagatggaagctaaatgatcatactgatgggatacagaacaaacccattgatattataaatgaggaagatttgcaggccttgaaggaatatgaactgctcaaccttgtgcccaggcataacccaaagaacaccgtcctaaccatcctaggggtaaatgtgaccacagattggtgccacacagccaagatacagccatttagagctagccagtaaatacccactctctgtgcccattcaggggcatgtcaatcagtactgtgtgatatactgatgtggttagacatttccttggttatccatcacatatctctagtgctattgagccatgtatctttggtgtgattctttcattcccaacttaaatctgaccaaaagaggaggtaagccagctaaaacagttccgaatttgtattatatcatccccaaattcagttgctttatctctcagttgggtcagtgccagcattaaagctaataaattggtctcttttactgaaatgctcttcccatgtgctttgctttgtatagtattattaacaggccagtgacgcacgtcatcctttgtcatgctagtatgaagcagtgatcactgttcttgagaaacatggatatatttctgacattctatctaatcttgtctttggaaaggagatatccaccatggcaggcagaaccactggagaagggcatgaggccacatacccaacaagtgtttttctgtaatctgctagcatggtcctgagcccactgaaagaagaggtttgctatgggcaataactgttgatagtggcaagaaagcccaagaactagggacataaaaacaaaaaaagaaatttagtgggaacttcaaagaaagatattctccatctactaacaattattaatgtttagcatttatatagatacaggattagtccagtgtcttaggaaagctgtttatctcagatgttgtctttttctcattcttgttggttctggagaatttttttagatcaccagtttgagacaaagttcaaattggtgaagtggctttctttttttcttcttcttcttcttttttttttttttgagatggagtttcgctcttgttgcccaggctggggtgcaatggtgcgatcttgcctcaccgcaacctctgcctcccggattcaagcaattctcctgcctcagtctcctgaatagctgggattacaggcatgtgctaccacgcccagctaatttttttgtattttttagtagagacggggtttctccatgataatcaggctggtctcgaattcctgacctcaggtgatccacccacctcagcctcccaaaatactgggattacaggcgtgagccaccgtgcccggtcaaagtggctttctttaaatgggtgacatgagtcaattccttttagcttagtggcatgaggattggttgggagcacctgataattccctttcatcttggctggaggaagtcttttaaaagatcttatttccaacagacaaaatctcctggttgaagtccatggtcctagaatttttcatcctacaggaggtcactgtggaaagagtcttttactaaattatagtttctagttggctgccttataaagctgttgcaattattcaacatattcttttaataccatagattcacagttttctggaaataatttcataggtctgcctgttataatttcaaatggagacagttggtatttaccaaaaggggttgagtttaggcaaagtaaaaccaatggaaaaggtttcagacaaggaattctacaaagctcagcaaatttttgccaattgagttttgattattctatttgtgttgagagttaaactctgaccttttttcttctgttgtccaaattcctacctaaaaggtttggggagtcatgcactacacaccataaagtctcctcagaagggcttatttaacatagcctgctttccatcctgactctggcataacattacatgacagataatgaaagaaatcaaaatattttaactccaaatgtatttccttgccatattttgaaattatcctgcaaagtcatctcttgaaaaacctatgttctgtagagaatccccttttcctttccaggcatttttcctgatccaggagagaatcagctaagagtctggcacctttttaagtctgataagaatcatttacaatctattgtctttgaaacccactacctgggggattcatttgcataataagaaccttggtcggctggccacagtggctcactttgggaggctgaggtgggtggatcacctgatgtcaggagttcaagaccagtctgaccaatatggtgaaaccccatctctactaaaaatacaaaaattagatgggcgtggtggcacacgcctgtgatcccagctacttgggaggctgagacaggagaatcacttaaacctgggaggctgaggttgcagtgagccgagattgaaccactgcactccagcatgggtgacagagtaagactccatctgaaaaaaaaaaaaaaaggaaacttggtctccacaaccccttatcttaacccagacatttcctttcgattggtcctaggtttttcaataaagtcttttaaccaattgctaatcagaaaatatttaaatctaccaataacctggaagccccgcacacccaccttgagtggtcccgcctttttggaccaaagaaatgtacatcttaaatgtatttgattgaagtctcatgtctcctaaaaatgtataaaaactaagctgcaccccaactgttaatggtggagggtctccaggtacttgacatcttgaacaaagaattggacaaaatgcacaaacaaatcaagaaaggaatgaagggttttattgaaaatgaaagtacagtccacagtgtgggagcaggcctgagcataggggctcaaaggccctgttacaaaattttggggagtttcaatatcctttgctttgggtatgccctatgtaaatgaagaggatgaagtaaagttacaaagtcatttacttggactacactctatggagaggctatttcctgtcacagctgaagtgtgaatcggccttatgttcactgcctccagaccctattttcctgcctcatctccccaccgagagatgtgatgaacccaaagcccaaggtcctgaagttttgttgtagtgtggatggcaaggaaactctccaatgttctcagaagatccaaaccataaaaagcctttttacctggtgaaaatacactgcagcataataatctactgttataacatcagccatcttgcatgagaaagctttacaaccagaaaacatgcattgaaaataacaatcaaatgaaatccctttataacgtttaaatggcctaccaggtattttcttttcttttttctttttttttttagacagagtcttgctctgtcgcccaggctggagtgcagtggcaccatctcggctcactgcaaactgcacctctgggttcaagcaattctcctgtctcagcctcccaagtagctgggattacaggcatctaccaccatgcctggctaatttttgtatttttagtagagagggggtttcaccatgttagccaggctggtcttgaactcttgacctcaagtgatctgcccgccttggcctcccaaagagctggaatcacagacatgggtcaccatgcctgacaaaatgtacgtgaagctttaattgttttcccaggaatatggggtcaagcattggttataaactattttaaacaatttcagtgtcagctggcttaacatgaaaatctgacaaagtattttcttggtatttaattaatttttgggttagtagctttatacaaggaaatttggttatttctgtggtttacaataacataataaccataattataattgatagcatatactattttagaaatcccatataagtttggaacatatgttagattattcacaaaaatataacctaaagaagattgaacaccattttggcaatcccatgtacctaaacatgtcaaataatcctgtttacctcttctctgtatgttttcagggccctctgatccatccagaaagccaggcattaggagagacaattttgaaactgaagttttattttggaactccatattaccataaatcatttattttgccaaaatgatgactcagaaattataaagaagcaaaaaccttttataaccttttacaaaaagggcacattctcctgtttttacatgccttgtatgtgaaactgtttgtagtagtcttaaatgcatgttacagtggtaactcttagcaattttcactttagtgtaaaacctagtaagttatgttctgataaggtttgactatttccagcatagctggggcatggccaaccccacatgttcctaggcctcacctagctggaaagcaggtgagttaaacaattttcaaaagcaaaaaaagcagcctatgaccttaaagcatatagcaaacctaacatttcaacataatttagaccacatgtttacattttgaagacaattgtattttaccaataatctttaaaaccctcttttttttttttttttttaagacagagtctcgctttgtagcccaggttggagtgcagtggcatgatctcagctcactgcaagctctgcctcctgggttcacaccattctcctgcctcagcctcatgcgtagctgggactacaggcgcccaccaccacgcccagctaattttttgtatttttactagagacggggtttcaccatgttagccaggatggtctcgatctcctgacctcgtgatccacccgccttggcctcccaaagtgctgggattacaggcgtgagccactgcactcagccctaaaaccatctttatttcccaaagattgctaaagtcatgtaagctaaaaggcattacattttctacatttctgacaaaatatttgatttaagctcttattgttattaaaccaattaatttaaaagtttacagaggggataaacagtgactttttctttatatttaatcagtttacacagacagaaagaggccagaaactgactggtgagaaattctcacccttttgctggcatgccaggtttctgggttctctctccctaagcagccctggcagccctggcagccctgcttgactgtatgcaaaaaaacacattgtcatgaattaagaatattcacaaatagtttacaaatgttggagaaattaggcagagggagaaatatgactcaaattctatttatgaaagtatactcagcccatttaaagtatcaagaagcctaaaatccaaaaagttagtttatagctggtgtgctccatcaattcctgcagcttgacaaaagtagcttataaattccaggtaaatgaagtgaatgatgacttgctggaaatgccaaggaaacaaaataactattcatagaaccaaataaaagccttctactagaaactaaaaagcatcagggttttatatatatggatacacaagcaaagccagaggagaataaccagcaaatgaatgaaaactagaagcaaaaacaaataaacagaaaaccaatcctaaattttcctacttaatttaccctggaggctacagtgttacctagggccccccaaaacccacataatgaatattttattcctgatacacaattcaatacccttaaattcaccaatatcattatacttccgtgcaatcaagaagatggattacttgaggtcaagagtttgagaccagcttggccaacatggtgaaacctagtaccactaacaatacaaaaattagctgggcatggtgatatgtgcctgtagtctcagctacttgggaggctgaggcaggagaatcgcttgaacccgggaggtggaggttgcagttagccgagatcgagccactgcactccagcccgggcaacagaaaaagactcaatctcaaaaaaaaaaaaaaagaaaaagaaaaagaaagaaatcctctttaggcacatgaccaataagtactctaacactagccacacaaaacagtaaccatagtgtgaaacaatgcaagcgtgtatgtgaaatttggctttacactaaatccagcttcatgtttaactatattaaaaaaagaattgccaaactgccgatgcattgtacaatactttttattttattttaatcaagattaagagatttaattacgaaaatgctaattagccaaatgtttccaattctttatcaggttttaaagaatattttattatttaaactttttccacatctttctccctgtttaaaaattccttactacattgtttcataaataaccttttgaaagctctgtaatttgagctaacttttagataacttctgaataggcaaaataattttttttccactaataaccctttctggcacgttttgtatacagaattacgtgttaactagaattgtatccctagtaacctaaaactttagcaaaactctaaaaagcaagaaatcctgaactattagatatgggcattcataaataagaacaattccacaattttagaaacatatttccctatattacaaccctttcttaattggaaatgacccagatattaaatgaatgttaaaaataagattttaatttacaaaaaaagtttacctaaaacatttatcccattcactgtacttaatttttttttacttttaacaagggagacatgagatatcaatcaacatatgtaaaatgaacattggttccatctggaaaggcaggacaactagaagctgggagggggttagggcttccaggttacaggtaggtgtgagaggaatggttgcattcttttgagtttctgatgagcctttccaaaggaaggaaccagatatgcatttatttcagtgagactttgaatagcttgctccaagcagctaccagcttgaattaacactgacattttaaaatatctagcaaagacaaacataaaattcagacaaaatgtatgttgacaattctgaaggcatttctatttttatcccaccaataattttaaagctagcttgtttagtaaaggtatactttaagtcacatgaacttgaaattcttagacttatttacttaatttatgagtgctcttttacttataagccaatttgatagacacaacatatgtacaacagtgtacatacaaataaacacatctagacatgtatacacatacataaatgaagatccaatagcttggaaccttagccatgagatagcaatacaagcttgctggttttactttgccccaatagataatccaatgaaggctgtgaaccaaaatttcagataaagcagtctccatggcagtttgatttttttttttttttgagaccacatcttactctgtcacccaggctggagtgcagtggcatgatctcggctcactgcaacctccgcctcccaggttcaagcctttctcatgcctcagcctcctgagtagctaggactacagttgcccgtcactatgcctggctagttttttgtatttttagtagagacgaggtttcgtcatgttggccaggctggtctcaaactcctgacctcaggtgatccacccaccttggcctcctaaagtacttggatcacaggcatgagcagtgatcccagtggcctggcagttttatttttaaaggccaaacctccccagattcccaagagcactggggccaaaccaagccaaaggagggcgtcacacgtgaaccaggccccctgcttagaacggcagcacaaaagtctggatacatacaatgctattccactttccattcaacagtaaactccagattccaaacaatgttggagccaaacagcattgccactgtgagagaaaattctaaggagggttaatactagacctcagaacctctgacgagagcagcccttttgggcaggctgaggtctgctggacccccgggagcgtcttcctgtggggcccgatcttagagtgccagacatctctggccttaggtgggtgccacatgcaggttttccccgccagagcctattatgagctttataagaacagacatgaactgtaatgtgaagaactggatgccgggtgggcctttttgttcctcagccagttgagtatgatcagggaaaaatttagcataggaaaagaaggtttacgtcccctgaaacatgtgcgagtttgctccaagctgtgcttcatgtagggatcagggaccatgcgtggaaaatatttttaaaaagtccttcccccttcggggcagggcaattgtaaatggcagctgaaagaccgaaaaagaaagaagggaaaaaaaaaagaaagaaaaagacccaagttccttaagccaaccaggaggtggcagtcaggcttctccacatggaaactccttagtttcactggccacggccagaaacctgcagttccttccatgtttgggcgctgcccaccaagggtcccaagttgaaaaggaaaagagagggagagagagggcccctgcatggagcagaaaggaaagggagaaaaatgaatcccaaactttgggcttacatcttcctcctggctggctgagcaaaatctgctaatggtggaaggtgtccaggctcttgatgtcctcaacaaagaattggacaaaatgcacaaacaaagcaaggaaggaatgaagggttttattgaaaatgaaagtacactccacagtgtgggagtgggcctgagcatagaggttcagaatttttgggagtttcaatattctctacttggggtatgccctatgtaaatgaagaggatgaagtaaagttacaaagtcatttacttggcctatgccctacggagaggattgtgggagattggttatagtggtgggaaaaatgatagggaaagggcgcaaaccttctgaaaggtcggagattctgcagagcccatgggagaatagctgaaggcagctgttgtataaccctgatgcagggggcaaggagtaggtacaagggaatgcaggcgaatttatcataaacaggcttgtttacttatgttgaccaggaactgacctttgatcatctgcatgcctgacattctctgaaaggggaacaataaatgttaactacctacagcttgtgtttgctccaggcttttggcattatgcctgcactgaataaaagcaagcagctccagcttctctgggctgctctctggccactagagccaggcagtcacctagctgctcttacactgcatgcctgtgtgtgagcactcatttcatctgtcagccagggtctgcaggacagacctggcaggaggtgccctgtgtgaggaacactgcaacggatcacgacagaaccctcaaaaatgaaagtgaagtgactgtgcagtaaataattggtgcctgctggggattgatttccaagtttgaagggattttcaagctggggtttcatcatgggacaacagttatcagcttaacagcaacagtatatgaaagtgttgaaaccgctgattaaagctagcaaagccttgctctcagagtcccagttaagggacctaatgcaaactgttgttttccataatccatcattctcagaaggcacactagacttaaagctctgggaacaagtaggaaaaattcttaaataacattatgtacaacgacagtgagtcccagtaacatctttaacgttatgggccttagttagggctgctttggccctgctttacacagaagagcataaaaagggaggggaggaagagccatcatctactttaccacctcatcctcctccctcagccctgctgttaccaggtaaaggtgccacagaggggacagattttccctgagccccctccctcagttaattggaaaaaagacaagggatacactatagttatgggaccctgtcttaagcaagtggcattagaaggggagctcttggcttgcctggtgatgcaagatcaacaaggcaatggggtacatgaacccattactttcaacacttataaaaaataagaaaaagcattagagaaaatggagccacttgcccatttacaaggggattaattgaggccatagcagacaactaccatatgacccctttctgataatagccactgttgtaatttctcccctacccctgacatggctccaatttgggacatgacaagatccagtttgggtagaaaagtggccttaaaagggagacaagttaacaatgatcccacgaattagttgagggacaattaacagctggccatatagaaccatcaaacagcccttggaattcatccatttgtgtcattcccaaaaattctggtaaacggagacttttgtatgacttacatgctatcaatgctaatttgcaacctatggggccccttcaacagggggtcccttcccctgcagtgattctttgagattggcctggagtcattattgacttaaaagactgcttttatgctattccccttgcagaacaggacagagaaaaatttgcatttgcaataccagctatcaataatgaaaggccagctcactgatttattgaaaagtacttcctcaaggaatgttgaacagtcctaccatgtgtcagtatcatgtaaatcagactttgctccccagtagaaaagaacttcctaatttcaagatcatccattatatggatgacattttactggcagccctaacggagccaatacttttgagtttatatgcctctgtcaaaaggaatacacagttaagagctttaatcatagcacatgaaaaggcacagatgtcctccccttggaaatatcttggatatatactaactttctggtcagtaagacctcaaaaggttaaattgaatactaacaatttacataccttaaatggctatcaaaaattatcaggtgatattaactggcttcaccccaacttgggcataactaccgacaaattacagaacctgttttctatcttaaagggcaatgcagccctggactcccccaggtatttaacccctgcttcaaaaacagaaattgaggaaatagagcaagctatttctcagaggcaactagattgcatagacccacaatattcagtccaattatttgtatttcctattaaacaacaggattaataggacaccttcagatagtactctctaattatgcaggccatatagaacatccccttcactgatgaactattccaattcttatctcatactactgtagttatgcctacaaaggtagttcactcccccatacctaacactttaatgctttccactgatggctctggtaaaaatggaaaagcagctatctggtgggaaccacataactcccttactcgatctggatttactagtactcagagagctgaggttggagccctaatattggctctggaaaccttttccactcagcccatcaatgttgttagtgactctgcttactctgtttatttattctaaaaccttgaaacagccctcattaagtccactcttgagcccaccctgtgcatcctttttctttgacttcagcaatcgctgggtcagtggacacattctgtttttatcacacacattcggacccacagcttgctgcccggtccactagttcacggcaatgatcaagcagacctgcaggttatgacatcactgcttggccaagccacccaatcacatcaatttttccaccaaaattggagaaatttttctaaacaatttcagttaacctaaagactagctaaacaaattatcctgcagtgcccagattgccagctcacaggcaagtccccttcctcaacaggtatcaaccctaggggactagaaccaaatcagtcatggcaaacagatgttacgcatgtccctgaatttggaaaactaagatatgtacatgtatccatggataccaattcccacctaattgctcttcctggagagtctggctgatatgtcattaaacatcttcttctcttttgtgtttatggggttgcccacagagattaaaactgataacagtccagcttacaccagctcacaatttcaacaattttgtcacacatggaatgtccaacattccacaggtatcccatataatccccaaggacaggccatagcagaacctgcccactctacccttaaaaatatgctcagaaaacaacaaagggggaatatgagtaaggaccctgaaacactattggcacaagccttatttacccttaatttcttaaatttagaggataagtttcaatcagctatagaaaagcactttgcaaaaatcactcaagatataaaaccttcattttatggaaagatgtaaatagtaatgtatagtgtggtccaaatgatttgctaacgtggggaagaggatatgcttgtgtgcagaccccctcaggtcctctttggattccagtatgatgcatcaaaccatactgtggtgtggctagaacccaacctggtaccagaaatgaaggaaatgaccttgcaggacccacagccctggatgatgcagcttcctcgggcaacacagaccctggacattttgctggagaagataactcaggaggcttagcaaatcctgctccagacacagataccattcactccagataatttgttccttgctatgctttctgttgtacattgcatctctcatagggtattaatcttttttagtctcttactttgcctgctacctctacctgctacactctattgggcccatcttctagatctgccttttttccgccctgttacttgggcagacactcccttcccagcctctaacaacatgaatgattggctgggagggactgacataccaccgatggggtccctcagtaatggcacacattggactgaggtgccaagtaacactacatatcgctctttgattggaaaggaataatactgattatactcatgtttgtcttatgttatttactggttctaggatgcaaagccggaacatgagctgtaactgccgcaccagtcaaacctgtcactgtgcacatcaacaaaacctgatgcagacaaaacgaaacaaatcaaaacaaaacaaaccagaaaagggggagatgtgggggaccagtcagagtggtgggaaaaactctagggaaaggacacaagccttctgaaaggtcggagtttctgcagagccccatggggagaatagttgaaggcagctgttctataaccctgatgcagagggcaaagagtaggtacaagggagtgtaggggaatttatcttaaacaggcttgtttacttatgttgaccaggaactgacctttgatcattcccctgaaaggggaacaataaatgttaattacttacgggttgcatttgctccaggcttttggcattatgcctacactgaataaacgcaagcagctccagcttctcagggctgctctctggccactagagccaggcagtcacctagctgctcttacactgcatacctatgtgtgagtgctcatttcatccagggtctgcgggacagacccagcagaggatatttcctgtcatagctgaagtgtgaataggccttatgttctcttcttctagaccctattttcctgcctcacaaccaccctgggcacatgttctcaggatctcctgagggctgtgtcacaggccatggtcattcatatttagctcataaggagctggacaactcgaatcaggtggtggggtctgggcaacttccaggctataggtaaatttaaacatttttttttttgagacagagtctcactctgttgctgggctggagtgcagtggcgctatcttggctcactgcaacctccaactcctgagttcaaacgattctcctgcctcagcctcccaagtagctaggactacaggggtgtgccaccatgcccagctaatttttgtatttttagtagacatggggtttcaccatgttgaccaggatggtcttgatctcttgacctcttgatccacctgcctcggcttcccaaaatgctgggattacagatgtgagccaccacacctggccataaactctgctttttttttttttttttatcttgcccaaattcctatctaagtggtcaggggagtcatgccctacaaaccataaattctcatcagattggttttatttaatcctatgtattgtgacttactttccaacctactctggcataacattatgagacaaggaacaaaatcaaaatattttatcccaaaaacatgtttctttgtcacattttgaaatggccctgcaagctgtcatttgtggggaaaatttgcctctggaaagaatatctattaagataaacagaccttttccttccaggcccttccaattctgaatcagttaactaagagtctcacaccttttaaaaggtcttaataggaagcatttgtcatctattgtttctaagggcagctgctatgagacttcaaaagagtcttggtctccacagtcttttatcttaacctgaacatttcctttctattgatcccaggtctttagacaaactcaaccaattgtcaatcagaaaatgtttaaatttacctatagcctggaagctgcccagaccccaccaccggattcgagttgtccagcctttctagaacaaaccaataagccaatgtatttcttaaatgtatttgattgaagtcttatgtctccctaaaatatataaaatcaagctgcacccccgcaaccaccttgggcatatgttctcaggacctcatgagggctgtgtcatgggccatgttcactcatatttggctcagaataaatctctttgaagattttacagtttgactcttttcgtcaacactcaggataaatctcttcaaatattttacagagtttgactcttttcatcatcagtgtgttccactaatccagatgactggggatgactggcacaaggaaaatgttgtagaacgggccatatttcacatgctgactggattgtttgtccaataaaatgagtgtcccatacactcataaaataagttcatttgagagaaagtcccaaagttgaaattatttttttctaagggaattttacttatggccaaaggtgatggtggtaggcgaataaactctagttgccatacctcctttcatgcgtgtccatgtgaagagaccaccaaacaggctttgtgtgagcaacatggctgtttatttcacctgggtgcaggcgggctgagtccgaaaagagagtcagcaaagggagataagggtggggcagttttataggatttgtgtaggtaaaggaaaattacagtcaaagggggtttgttctctggtgggcaggagtgggggtggcaaggtgctcagtgagggtgctttttgagccaggatgagccaggaaaaggactttcacaagataatgtcatcacttaaggcaaggactggccatttacacttcttttgtggtggaatgtcatcagttaaggtgggacagggcatattcacttcttttgtgattcttcagttacttcaggccatctgggcatatacgtgcaagtcacaggggatgcgatggcttggcttgggctcagaggcctgacacctccaatcagcctttaaggaaaacaaccttgataactgtgtaaaggtttccacggattatgttttgggcagggatttttactcacacaaagggtgggttcaattgcttggtgggtgacagttcacttgaagtggcattgatgtctggggtaaataccagaggttcgttgtctcacaggagggaaatcaaggacgtgaacatacaaaaagtgagtttaagagtggaggtttaatagacaaaagaaaaagaaaagagaattgctctctttcttgcagaaagagaggagctcctgagtgggttttctggaccactgcatagtgcatggggtcttatagactggcttgagtaggaagtgtctgattaacatggggccaaaagattggttggaccaggtgtgccatttacatagcatgcaaagaagatgaccaccccaccctaatcttttattatgcagctgggttctctacctggccagcgccctgttgtctgctccttactgcacacatggttgacaaagaaaagagaagatgttgggaaaaccagccccacaccacccggtgggtaccctgagtccagcggaggcaaaggagttagaaagagacagaataagagtttaaaaggcaggttcaggagacctgagtgtcagaggcttgctcatggcccagagttctcgggctccacctaatttattggtttacaagctctttgttcttagggcagatgggagggggaggaagggatgaggaaaaggattaatcagtgaaggagaactcttgagtcattcaataagatgtagagcagtggtggtttctgtgaatttcctgagcaaaggcatgtgtctaaactactaagatctttaagttatctggactgaaatgggtgggagtgggtttcaggaggagccaagatgtttgattatactccactgcttcaagggagtgttatctccctgagcaacctgtggaatgccgcggagctgttatgctctcgggcataaagacatgaaggcaataaggagacttttctcctcagaggccgcccatggctccccctgggtgtctcacacaggggagaccaactcatctggcaccctagaaactctctttcccacagaagatggagccaccatgttgaacatgcctagcccccaggtagccttttcctattggcacagctgctgacattcacctgtgcaagctcccagcttgcttatctatgtttgcagctcgattttacaggctgctctttgttaaaaaaagaaatgatttggccgggcttggtggctcaccaaggctgaggtgggtggataacttgaggtcaggggttcgtgaccagcctggccaaactggtgaaaccctgtctctactaaaaatacaaaataattagctgggtgtggtggcatgcgtctgtaatcccagctactctggaggctgaggcatgagaatccctcaaacccgggaggtggaggttgcagcgagtcaagatcatgccactgcactccagcctgagtgacagagaaagaacttgtccaaaaaaaaaaaaaaaaattgggggctactttttattaaaaggaataccttaccaaggattcttaccctcactatctgcctaaataatttctttttaactcctgtgtcacaatgaccacaaccaaggaggatttaacaggggttttgttatttgtaacaagtaaggaggacaccaggcatagttcctaaagcagtgcttccctgagcgatggtggaaacagggcttttactgggctggtgagctgagtcattgtatgtagaggtaaagtcaagtcagtgcaggtgcagttgctaatcatgctactacacacatcgcatgtataggaaaagttgagtaagctcctccctgggtgaggattttagtatggtaatgaggggagttcactgaagttcatttccaaatctagcatctctggatccaactgttttttgtttttcaggtgctgggcttcttcatggaattcaaggtgcaatagttacaagtgggtagtttttcacagtgctaccccaaaactggggacccagggttacaatgcggcagcacttgtacttcttatgagccacagttggaccgagtttcctattatattgtttgccccaagcaatcaaatgattggggcttcaaagagttaaatcttgcatataaattaagaaagattactataatttgattgggagtatgggtagaccatttggtctataccatagcccagtttcagaggagtgtgttcccccttttgtttcccagttttctttttgttttgaaacacccttggcaatgtaaagcattgaagtgctagatgttacttttacaagtcctcagagtgtgcattatgtaactgcttgcctcctcaatcctgtaatccttccccctgtttgtgatggctttcacccttccttccttttcttccttttccttttcttccttccttcattccttttcttccttccttccttcagtcctcccttcctttcttccttccttccctccttccttccctctctccctccatgcattcttctttcctctctctcccttcccctcccctcctcttccctactactcatcctttccttcctttccttttccctttctcctttcctccctcccttcccttttttttaaaaaaaatggatcataatatatttttctgacatttaaacctgtaacttaaaaaattttaataattaaaaagttatatctgtaaaatgtctctaaactttaagcaattgctgaaaacttcaatagcattcagtctagcaaaaattttgcaaaactggaaggatttttctcatttcataatatgaaaagccaaaagaattcactttgtatctaattaatatatttaaattaaaatatactatagagccagaatatgaaatagaatattaagaaaaagtaccagctggttattgagaagtgaaggaaaaggtcactaaacaaattgtgtaaactctaaagtgatacagattaataatggaaagagtaccaccttaatgggtcttaattttctttaaacaaatgagaaaatgaagaaaaaagcgtgttttaaacaaccaccattgaagcaaaaccaattctattgtttcaaaaggtagttatcagctttccatgtcatacgagcagaaatccaccctcaagtcagagatttgatctgtagttaccctcaagacagcaccaccatagtttattcatttcacagtttttcttttctttttctttttatgagacagagtctcactgtgtcattcaggctggagtgtagtggtgtgatctccactcactgcaacttctgcctcctgggttcaagtgattctcccatctgtagctgggattagaggtgggtgacgccacacccagctaatttttgtatttttagtagagacggggttttgccatgatggccaggctggtctcgaactcctggcctgaagtgatctacctgtgtctgcctcccaaagttctgggattacaggcatgagccaccatgcccagccacatttctcagattttctaaagcagatcttttatgactaatgggccagtcctgcctattatctagctgtttgctgaaatcatcaatcctttgatccttagcaatccttaaaagatcagactgtctgagaaccactggagttgacagggatgtcctgcaaaggggctggggataagggagagagagggtcatgtcagagtccagagtttgcatcattgcctgctctttaatagtaagtgagctctgtttccagagcctcagtttacctcaggtttcctgaaatgagaaaaatgttcatgcccgtatcggccttgcagggtcattgtgaagatcaaggaaaatcattgaataaaaattatttgtagactgtttgacaaatggaagcccacacagggctcccttgagttctgtgaagatgggtacctcctttctctgtggtctggcagtaccctgtgttctccactattagagaaaacctcatcatagcgtaaatattgaaatcttccctttattaaattgtgagtttaaggagagaggacaacttacctttgtaaccagtgcttagtagagtgttcagaacataggaatctatttgataacagtttgccaaatgggtgtgagcaagtcattctcaggatttagctgcaagatatttttatttaatgtcacacaaaatgaatcctattcttgctaatctccaaataatcacaatctgaatggcttgcttagtgataattttattcatgtaagaattatttatcatatggcatagaggatgttgtccctggggtgggggtaattactgtggaaagtaaatgactcccttatgctttttgcctttgggattgagttaccttgaatcacatgggattcaggtgtgttcctgccaagcaatttcactgccctgcaggggagctcgaattaacaggaaagagttgaagcaattagtccaaaacagtgattctccatgtgtagctctgaaagaacaatgtaaatattacttgagaacttcttaaaaatgcaatccttggtcctcagacctaagaaattagaaagtctgtggatggaactgagtaatctatggtttaatcacctgcaagtgattctgatacccacttgtgtttgggaacaacttccaaaaccaaggaaaatccagcgagttctctgttaatgaaggttcttaccatctcatgtaggatggcttcatctccaggtaaccatcccaactttgactgacttcacaattaagaagttaattatgtcacattacaaggggtccagatggagagtggattcagaatcagtgtggtgttggaccgggccccaatcccacttctctgtggttctcctcactctgccttcctttgtggattgactttgtttttgtgcttggtgaatggccatggctgttacagatgtcacatccaaaacaaagacatctcgtctggtgttctcttctcaacagttaggaaaactttcagtgaagctgcagttgaacacctcttcctatgtgttttttggcaaacatggagtcacgtgggaactcctgtaccagttctatggaaagaggtggatactactttgacagatcagttgagttttgatttttaatctggatattcaattcttctctgtgagttccatgtgtgtgagaactggtcaccagaacaggagaagactgaagctctgcctgcaagtcttgtttttgtaattttttttttttaacatacagttcacttttttggatttactgttctatgacccttttaaaaaaactttttattttgaactaagtatagacacaggaagttgcaaagatgatatggagggatcccatgtaactttcctgcagtttctcccagtggttatatcatatgtaactgtagcataataccaaaatcagaaaactgacattagcacaatgtgcatgtacagttctgtgcgcttttatcacacatgcagattcatctaactgcaatcaggatacagaactattctatcacctcaaacatctcccttacgctagccctttttagtcatgtgcaacacccccattcctaatccctggcaaccactaatatgtgcttcgtcttaatactcttgtcattttaagactgtcatataaatggaattatatagtatgtgactttttgagattgacatttttcattcagtaatatccttgagattcatctaggttgcatgtatcaatagtctgttcatttcctttatttttattttttattttttttggagacagagtctcactctcttgcccagactggagtgcagtggtatgatctcggctcactgcaacctccgtctcctgggatcaagtgaatctcttgccttagcctctcaagcagctgggattataggcgcccaccatgcctggctaatttttgtatttttaatagaagcaggatttcaatatgttggccaggcaggtcttgaactcctgatctcaggtgatctggccatgttggcctcccaaagtgctgggattacaggcgtgatccactgtgtccggccatccattcattttcattggtatggagacaggttgcttaatcattcacctattgaaggaaattttggttgtttccagttttgcactattactaataaagtttctgtgaacattcatgtacaggatcttgtgtgaacatgttttcattgtttaaataagtgctcacgaatatgattgctggattatatggtaagggtatgttcagttttcatttttattattattatttttgagacaacatctcattctgttgcccaggtttgagtgctgtggtgtgatctcagctcgctgcagcctcaacttcttgggctcaagcaatcctcccacttcagcctcctgagtagctgggaccacaggcatctgccaccacactcagttaattttttttttttttttttagagacaggattttgccatgttgtccaggctggtctcaaactcctgagcttaagcgatctgcccaccttggcctcccaaagtgctgggattataggtgtgagccatcactcctggcctgtatgttcaattttttttttttttgagactctgttgcccaagctggagtgcagtgcactctcagctcactgcaacctttgcctcccaggttcaagtgattctcctgcctcagcctcctgagtagttgggactacaagcacgtgccaccacacccagctaatttttgtatttttagtagagacagggttttactatgttggtcaggctggtcttgaactcctgacctcaggtaatccacccaaagtgctgggattacagacgtgagccactgtacctggcctgtatgctcaatttttaaagcaactaccaaactatttctggagtgggcataccatttagtcatctcaccagcaatgtatgagatatctaatttaactgcatccttgctaccgtttggtatttacattaatttttattttagttgttttaagacttgtgtagtgatatcccagcttgattttaatttgtatttccctgatggctagtgatgttggacatcttttcatggtcttatttgctaatgtgtatcttcttcactgatatgtctcttcatgtttgaatttgaaaaattcaaattataattttttctttcatgaattattctttttgttttgcatcactgtattctttattgtttttttttttttttttctgtgctaatatctttctcctcttcttcaggctcatcattgatcagaatgttagagtctttggtatggtttcatacattcctcaggctatgcttttttttctcaatcatctttttccctctgttgttcatattagatgatttttattgctctatcttctagcttcccgattctttaattttcatatacattcagttattgagcctctccagggaattttttatttctgttattttatatttcatttccgtaattttccatttggttctttttttatagccactaattctttgccaggaattagtgtaattgtttcaagagtgtttgctgtcacctaatggagcatggttataattgctttaaaatatttatctaataatttcaacatctctgttatcttgggattgccatctgttaattgccttttcctctgagaattttaaaaaaggttttcctggctcttatgtatgttggataattgtggattctctcttggatattttgaatattatgttacaagattttgggtcctaataaaatcttctgggggaatgttgattttttttttttttttttttgagacagggtctcactctgtagcccaggctggagtgcagtggtgctatctctgctcactgcagccttgacctcctggcatcagttgatccacctcagtggcccccaagtagctggaacttcaggtgtgtgccaccacaccttgctatttttttgttttgttttgttttgcttttgcttttgtaaagatggggtttcatcatgtttcctaggctggcctcaaactcctgagctcaagcaatccacctgccttggcctcccaaagtgctgagattacaggtgtgagccacagtgcccagcctgttttgctttattttaacaggcagttaacttagttggctttgctctgcaagtcttgacccattttctttaggctgtgcattcaatgttaatttaatttcaaagctgttgcagtgctattttgtctgctttacatgtgtgccacctaggggccagtctgggtcctggagagtgttcaatgttgtagtttagttctcaaagtctttgctatgttgattcttgtccattccatagctcacggatgatctcaggactttacacattgatctaaaggctctcgtctttagctccttctactctgtgatgttcctcacacatagcaattcttagggtcactctttcctggtgccctagttaggaagctggtactttagcgtttctgtgctgttgcatgcttcctatgacagcgtgcacttcagggcaaagcagcaagtcatggaggctgcggggctgctatcaccactgccaccactgcaggagtccagatttgttatgggtgttcaccggaactagggttgggagacgcgacagagctccatactgcagggactcttttgtaggttctctggtgagtgtaagagtgtgtgtttttattttttctctcccttggagccttttccatatgtcacaattccaggatttcggttgccccaaactctatgtaaggcaatatgagaggaaccaaattttaagaaaaagggaaaaaaatttactgccatctgggttatttgctgagtttgatttctctgtgcagtctctctgcttctatttacttttcaacattcttcaataacttttttctatactattttaagacatattagttgcagtaagtgggagatagggtgggatggtcttaatccatcctaactggaaacagaaccttaaatcttggctttgaagtaaaaaggtcatggtccagatataaggcaggataatttggaagaatatttatcaaattttaaaaaatttactctctaggagtctagataaatttgtctaaaatacaaatggatgagactattaggaaaaactgaatggaaatagttttaagagggaccctgtacccatctcttctcccctaccatgttatctccaaggtggagacaacacagccccaaatagcacttgggacctgagtgtagaggaggctagtgctccacttccacctgaagacctgggcggtaaaagccttccagggaatctgtgctctcatggcatgagagtggtagaatagagatgacagggggtcattgaggcagagatagtcccacggagttactcttggtaccagggatgtcaaagaacagctgagggttctctatgtctctgagaaaagggggagagaggtctcatggtcaggatgagaggtcatagcaacaaagggcctgtggccctagagacaggagcccaaatttaaatgtgggcatttcagtagagttcagcagtgagacagggagatgtggcggattgctcaggaccatccaacatcgtgaatgttggtaaggggagagatcagacctgtgtacaaatttgggagcagtgagtgcatgagtggtatggtatttaaagccatgagcttggctgaggtgtgggtgagaggagaaactggcaaacgctgagtccaggacactctgaagttcagaggatggaaagaggaggaggaaatgatagagactgagaaggttgggccagagaggtgggaggggaggtaagataaaatggtgaggaagaatgaagtactgtgccaaacaccactgctggggtcacgcaggaagaggttagctttggtccggctcttatatgtggaaacatggagcatggagatcacagaagaaaagtcagtggagtggtaaggacagagcttgacagccatggatttaaggtggatagaataaagagttgtggacagaaacaatatacacttgatcttagctaaaaggtggagaagcaatgacagaagattgacaattattttgaagaattctgatgttaataaagatacagtgcagtacttggaggaactgatttttattgtatggtagcaatcttagcgtgtttgtgtgctcattaaagggtgtaaaactgatgatcctgcaaagggtacgagatgcagccagtgcagcaggggggagctgtctttaggtagggacaaagtgagtcaagccattgtgtcaggagggaaggcagatggtgttagtaaagacgaggcaagctggtccatttggtggagggattctgtgaaagttttattctaactgcctctgtttactcagtgaaatatcaagccttagtttttgcatttgtaaaataaaacatgtaatacctacctattttattggtttagtgagcatcacagagggcccatttaaacatattttggaaattgcaagacattgtacaaatataatcattgtcattggctttgataaagttgttccctctctttggatatcgatgttttcttcctgaggtcctcaggattctagaatgttgatttgggaggcatcagctcctcaccgccctagcctgacaacaactcctttagggtgaattctcttccctcatccttacactgaaggaatggtaatccataagtcctattgctaattgaattttagattttgcattatattctgccatcctatgctttcaaattagacctagaggctctgacaccagagtaaacagacattgcatttcatattctcacctggagaaatacaattttgcttgaatggaagatgcaaggagcatggtttaaacctcagattctctcaaagagatgaaaaggagaattctactcaatgcccttaaaatctaggtgttggcaactttcctttcaatggataaaagtaattgttagtagacttttgaggatttcttttaaattttcttagctcagtggacactaaatagcattaaaagttgaaaaccacttgtccctatccatttattatcttttgaagagacattctttagacagaagttgaaattatgtttttttattagtgtaagaagggaaactaattcagattaatgagaaattacagaaattagcaagagagaatttcagcatcagaaaaaagtaagttatttaaattacctttgaggcgattattttcaagatttataaattacaattaaatatgaagcatttgagtcatgaaagttctttaagctatgaaacttctaattgcttattgcccctaattttaataaagctttttaacagagacaaagaggcaattttacctgaaaacacggaatattttacttacaactttgaaaccacattaccataacctttcaaaggaatcagtcaagtgtttcttgatcatctcatgcattcaagtcgattgcatgctcatctgacagtttgctaggctctttgggaaccactcagctctgaccaactcaatttatgtttgaaacttattccatccaagcagcattagacttaagtgtagctgggaaagagataagttagatttggcctgcaggggcctttgttcttcattcctttctttcctggattaagccctcctttcttccttccctctctggtctgtgcggggcttcatgtactcttacccatccacttctctaaggaataaaacctccattcaaataatcaagtagaatggcttcagtttgaaaaggtggggggtggtagaggggcaaaaaagagcagagactgggagcaagttttgttattagtcataaagccaaatgttacttttgtaaaccaatatgagatgtcttgtgagaaagcaccagtagacatggaattctgatttacaatgactgatgcatgaggcatgcggtctgtcctacacagataatttgtgattctgtagtgagtatagagggaccggttctcctctgagggaaattcagctttagacatgatttccaaaaagttccatcctctggatcctttcatataaagacttttctgctaactccatggttttctcagcgcctttcagggtcaaaggaattccctgatctaggtaaggtgtgagcatcaaccttaaattccttagtaagactcatcttcaggcacccaaatgcaagtttaggttgcacatcccctttttaacccctttgtgttagtccgctagggctgccataacaaaataccgcaaactgggcagcttaaacaagagaaaactattttctcacagttctggaagccagaagcccaaactcaaggtgccactaaggttggttcctggtgaggcctctcctcctgacttatagctggccaccttctagctatgtcctcacatagcctttcctctgtgtgtgtccactcctgctctctcttcttttcctgtaaggacaccagtcttatcaaattaggtaagactaagctttatgatctcatttaactttattgacttccctaaaggctccatatgcaaatacagtcacattgggggttagggcttcaacattaaattttttggggaaggcaattcagtccataacaccctccttcccttcttggactcttcttgtgatataggtttcatagtaaatgtctcatttcctaatcaccgttgaactagcaaaccttcgcttttgtgcattatagtagaagagagactgatgaccttgctttcgtggctttctcctttgattgtcatggctgcatatggacttttaatgctttcctctttgcacatcatccactgagtagagagttgtggaagaggtggttgctgaggcaggtggctgacatcagggaagatggcaagaagtgagtcagtcttgggatggaagaatctgggagcaggtagcattaggagaatgagggttgtattaagtatttagtcacatttcatccatggtgttctcttcatgttgtactgattgaaacgataaagctgtggatggccaaggtcacgctggtcattaactgcaggttggacctggaactcccacctggatgattccagtgccagaacctgacttcccttggaaatccagctacttactattccccaaacctcccacctccactttttcactacccttggcttctcctccttctctccttctttgaattatgtcatcattaattcctttgtactttttccatgtctcagcccctgccaaaggcccttattcccttctccttggacagttgtgatagccttcttcctgctggccttcctgcctctaagctgtgctaaaggggaggtggatagttgagatggttatttacagagaaagggaaggacagaaagcagggctcccaggattctctatggacaaattctgttctctttcagccacttgtatcagtgaggcatcttagtgagataagagagacagagagacagagagagagagagaggcagatgctccttcctgatgaccatggcaggccggcctcaaatcctgactcagccattcccctagaagctggtttttatgaaccatttggtggactatgtatcaacaggatcaacaagaaaaatacaagttaatgttgcatattataaagagataaattttaatgtagaaaacttctataggtgatggaagagccaagaagccagggaggcaatggtgaagtgactcagaaatcggcaattagggtaacaaatggccaatgggggctccaggctggaggaacaagggcaggagatggaactgctgcaactcagggtcacttatgcaggctggagccctgacagggaagggaagtgcagggggaaggatggagggtggaggagaggagacagggaagagaatttctctagagaactctgccacactggccgctttaactcactaacacccacacacaactggctcagctcagggctgcttgtttctgctcaccaaggagcccaccagatgctctttgctcagggggttttgacacatgtggggttccagggcccaggctgcttcaatcttgttctgccatcccctagggcctctaatggagagaggagaacattgactgacactgagggcctggacttggaagtgacaacggtattcccctcaccttcagtggcaagagtgagccacttggcccagtgcaagggggctaggaagtcccttgctgagcatcgccctgggcagcggctcagcactgtgtgaggagagtgccatcctaagggacattggtcacctctgcctcatggcttagatactattttgcttgtgaaggaaaccaaaatatttcatatatatatatatatatatatatatatatatatatttggaaatatttagagatagctattctgagggactggaaatacaagagtagcagaaaagctgtccttcttgggaagagctgtatctgtggagaaattctgcatcccccttcttggggtaaacagaacttacagtgtcttttatctagtctgccaggctgcctggttgctccctcaggaataacctcctatgtgtctggatcatataaaactgtctgcagttgctcagtgttgagatgtgggtcccacatcaatccaaatgtatgcttttctgctctgtaacatttaaaaccaaagatactgcccctaaattggtcactcttgtaatccattttagtaaagatgtctcaggaagctgatattactgatctacaaaatggaacaattccttcacactataccatttggtttcaatagttagttggttcgcccttccttcatattgattattttcttggtaaccacaagtctcagaggtactttctgttgttcctgcataatattttcctttgttgttgactttgaggctagaatcctgagctcagatggaccacatctgagtttgatccagcttcaagttctgactcagcaccctcttttactttcattttagccattatagataacagtcaccaaaagattgaatattttttttttccttattagtttgcatttccttatgtatccaaagaaacaattcctggagagtaggatccatctctaaattccattggtaactttcacctttagtaattgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaacttgcattaagcttgaagtttttttgccaaaactaaaaactcctacatttttatatgagatgggaagaagcatcctttctattcttcctacccacagcttgtttacagagagcggtgtctggaagcttggctgtgcatcagggttatttccactcagtgaatggggaagcttgtgaatcctgcagctatatggctgctcagagccattctgccttgaaacatgagtactgaccctggaagaaaggtgttagatataaaggtttttccattttgtttgattctttttgtctgagcccttagatctcctttaaattaatagcaaggttaataatataataatatgatgttatatattacaatttcaactcaacaggaattccatttctggtagcaggtatatggactcatttcttctttgcatctatttctaggttatttgcagccccgagatctacccagctgtggtgttatcccctttgttcaaagccttctttgtaacactggatcaaggtgtaggaacttcagctatgaagggtcaatggagcatcattttcggtaagagaaacacaaagatctttttcagaaatctcagaaagctgatacatagaacaggcttctgctttttgtaaagcctcaataatttgggataggtcagagatcatgagaagtatagaaattaaagttttattaaattcagagtcatataattctgcctccaactaatggttagcttccagcaggagatctttccactgtcacttgcgggactcacagagtaataactgattagcaaatgccatttgcatgtaataatttgttttctgtaggttaaaactcttgacttcaaaattacttgtctagccaacttttcattttagtgccacatgcccccagaacaattattttttgagctacctactgggttttttctcctgtgctactagttgactagaatcttgtcgccagctgagggaaaataaaactgggcagtaactctttatttgtcataaaccacctaaacggactacaggacagttaagttgccttctctgagtctctgaatgctgagctatgcctgtggttgcctacagtgtcagttggccttaaactcaagaagagaaggagaagaagatatttcatgtgagaagagacaaagtgagggggtttaacttgggggatcctgaatgccctggaaacttctcccaggtgaagttaggaagggaaggaagtggctagcggattaagatagtttgaatttatcaggtatgaatgatctgagttttatttaatctatatttactaatattaaacaatctaagatatttaaatgtaaagcaaatgttgacatatatgatctttattttccaactctaagttacaagaggaaaattaaaagtttccagataattttcggcatatcaggtacaatatttataaatggtgttgttttagttcatttgggctgctataatgaaataccataaactgtgtggcttataagaaacaaatatttatttctcatagttttggaggctgggaagtccaagatcaaggtgccagctgatctggtatctggtgagaaccctttccattataaatgacaccttccagctgtgttctcacataatggaagggatgaggcatctctccagggtctctttaatacgggcactaatcctattcacgaaggctctgtcctcacgatccaatcacctccgctatatcatcttaggggttatgtttcaacgtaaaaatttggggatgggagatgccaactttcaggtcatagtaggtgcttactttttctgagacaaatcatatagaaatatgatataaagaggctcatttgaaaatactgtaaagtgataaccctgaaaagttcaatggtcttttcttgaatgtgtggagaagggaaatatacaaaactctgtctttcttggaagcattagaagagcttgagacttagcagtgtctttatttcaagtctttcttatgtctcttccttacttggattgggaggtttaaatgatgttgaagtggaaagaatatgattttgtggctaaacaatactggctctgttacctgtggttctgtgaatctgtgcaaattaattgacctctttgaatctgtttactcacttcaagtgttgtgaatgttaaagacaaatatagaaaacatctagcgcaatgcatggcacagaggcattcaaccaatgggagttgataataacaaattcttattactacggctgtaacaattataaaaatactacttgaaggccaggcacggtggctcacacctgtaattccagcactttgggaggccgaggcgggcagatcacctgagatcaggagttcaagaccagcctggccaacatagtgaaacccagtctgtactaaaaataccaagaaattagctggacacggtggcagatgcctgtaatcccagctattcgggaggccgaggcaggagaattgcttgaacccaggagggggaagtcgcagtgagccaagattgcgccactgcactccagcctgggtgacagagcgagactcattctcaaacaaaaaaaaccccccaaattacttgatatcaggaaataatctacctttgttttctttgtgtttttccacatcaacatcctcacttcaatgtgcagaaattcaggggttataaaagcaacctggtgagattcttcacctaacattctgagagtggtagtcaggttaatagctcaccagcattgcaaagcctttaactttgagaacgaagaatgaaattcctcactttgtctggtagtgcccaagtcagaggtataagaaatacaaaataaaatagggaaaggaaattgtaaggagtaaggaaagagggagagggagaaaggagacaagaaagagtgaagcacgctgtcagtagggcctctggtttcagactcagccacttgaccaagcagatttcatgcgttttcatattggagtaagtgtggattcaattgaagttcaagcccataaataaagactcactcctgattattttgtggtaattgtctcagttaaaaaatacctgaaagcggctgggtgcagtggctcacgcctgtaatcccagcgctttgggttgttggggaaaccagccccacaccacctggcaggtaccccaagtccagcggagacaaaggaaatagaaagagaataagagttcaaaggcgggtccaggggtcctgagcatcggaggctcgctcaccgcgcagagctctcaggctccgcctactttattggtttacaaagctctttgttcttagggcagatgggagggggaggaagggatgaggaaaaggattaatcagtgaaggagaactcctgagtcattcaataagaagtatagcaatggcggtttccgtgaatttccttgagcaaaggcgtgtctaaactacttaagatctttaatttatctggactgaaatgggtgggagcgggtttcaggaggagccaagatgtttgattatactccactgcttcaagggagtgttatctccctgagcaacctgtggaatgctgcggagctgttacgctctcgggcataaagacaggaaggcagtaaggagacttttctcctcagaagctgcccatggctgtctcacacagaggagaccaactcgtctggcatcccagcactttgggaggctgaggcgggtggatcactaggtcaggagttcgaaaccaccctggccaacaggctgaaaccctgtctctactataaatccaaaaattagctgggcgtggtggcaggcacctgtagttccaactattcaggaggctgaggcaggagaagagcttgaaccggggaggcagaagctgcagtgagcagagatcgcaccactaaactccagcctgggcaacagaacaagactgtctcaaaaaaacaaaaaatcttgaaggcaaatatcacagttaatttagttcataatgtgtctggaattggtgggttcttggtctcactgacttcaagaatgaagccgcagaccctcatggtaagtgttacagctcttaaggtggcacgtctggagtttgttccttctgatgttcggacgtgtccggagtttcttccttctggtgggttcgtggtctcgctggctcaggagtgaagctgcagaccttcacggtgagtgttacagctcttaacacggcgtgtctggagttgtttgttcctcccggtgggctcgtggtctcgctggtatcaggagtgaagccgcagacctttgcggtgactgttacatctcataaaagcagtgtggacctaaacagtgagcagtagcaagatttattgcaaggaacgaaagaacaaagcttccacacagtggaaggggcagcctggctgctggctagggcagcctgcttttattcttatctggccccacccacatcctgctgattggtagagccgaatggtctgttttgacagggcgctgattggtgcgtttataatccctgagctagacacaaaggttctccacgtccccatcagattagttagatacagagtattgacacaaaagttctccaaggccccaggagaggagctagatacagaagtgtcaattggtgcactcacaaaccctgagctagacacagggtgctgagtggtgtgtttacaaaccttgagctagacataaagattctccaaggccccaccagagcagctagatacagagtgtcgattgttgcactcacaaaccttgagctaaacacagggtgctgattggagtgtttacaaaccttgagctagatacagagtgccgattggtgtgtttacaatccctgagctagacataaaggttctccaaggccccacctgagcagctagatacagagtgtcaactggtgcactcacaaaccctgagctagacacagggtgctgattggtgtatttacaaaccttgagctagatacagagtgcccattggtgtatttacaatccctgagctagacataaaggttctccaaggccccaccagactcaggagcccagctggcttcacccagtggatcccgcaccagggctgcaggtggagctgcctgccagtcccggtgccgtgcgcccgcgctcctcagcccttgggcggtcgatgggactgggcgccgtggagcagggggcggcgctcgtcggggaggcttgggctgcacaggaacccacggaggtgggggaaggctcaggcatggcgggctgcagtcccgaggcctgccccacgggaaggcagctaaggcccggcgagaaatcgagcgcagcgccggtgggccggcactgctggggaacccagtacatcctccgcagccgctggcccgggtgctaagtccctcattgcctggggcctgcagggccggccggctgctccgagtgcgggcggggcccgccaagcccacgcgcaccggaactccagctggcccgcaagcgccgcacgcagccccggttcccgctcgcgcctctccctccacacctccccgcaagctgaaggagtgggctccggccttggccagcccagaaagggactcccacagtgcagtggtgggctgaagggctcctcaagtgccaccaaagtaggagcccaggcagaggaggcgctgagagcaagcgagggctgtgaggactgccagcacgctgtcacctctcaataagtttccatgacctccctaattcctcaggtaagttcactttgggcagaaatcctgggtaccatctgatgtagcttatggttatgaaaatcagcttcctcattcctgcctttgttggggggtttccccttcattttaacaagaggatttcagagcagaaatatgaagcactgcaggcaacagaagtggatattcttgtgttagtggtcactcctattttgtttaatttaaaatgctttgtaatgcgaatgtgctgtctaaacccgaccctcacttccctttcactgtctgacaaccttcgggaggcggatcgccatacccatgctggggcactcccacccttagtctacagcacccggtgccttgccttctgggctttgattgggtgacctttcatttccagtttcttgaaatgtttccagccatttcctactggtctcatttggtggtcatcaatattttaatttatttttttctccattctcaaacatgcccagaccccctgagaatcatctgaccctctctgcctcttttccaaccaccatactgcctggttctcagccttatttgattatcacctgctgctgcctcacctcagcttctcagtttgcttttcactctcttgacactcttttttttttttttttctgagacggagtttctttcttgttgcccacgctggagtgatatgatgagatctcggctcaccccaacctccgcctcctagacttataattttttttttttttgagacagtctggctctgctgcctaggctggagtgcagtggtgcgatctcggctcactgcaacctccgcctcccgggttcaagcgattctcctgcctcaacctcctgagtagctgggactacaggcgggtgccaccatgcccagctaattttttgtatttttagtaaagagggggtttcaccatgttggccaggctggtcttgaattcctgacctcaggcgatctgccccccttggcctcccaaagtgctgggattacaggcgtgagccaccgcgcccggcctatccttgtttcttaaatggctttcctgacatggagacgtaacagcattagattcgccagggagaaggattccttctgtgcctgccgtcccattccgatgctttggggccctccacaatgatgagtactcccctccccttcctccgcaccttccaccgcatggtcggcctttctctttttgtattccccatctgtccagcccttacacagcccaaggtcttcctcttctatatgcagtcagctctgtcgtggtcagctacctgctcgcgatgcagcaccatggcttctgcacactgaggaaagacagctccggatgggtctggggtttatttcccagcccctttcataacttagtggagagctggcccaggaggggtgagtgaagaaagaaaaaacgatccaagctcctgagcccagagtctcccctcctgacccagccacttgcctaaggaagccctccctgtaactgcagtcacttgtctacctgcaatagagcattttagggctgggtctctgtcctggggttctctccttgccctgcctaggcatgtctcttgatggactgttgaaaacttgggaattatgtgctttttgctaggtttttatttttaaatttctcctccaataaaacttattttatttttacaccgtgtttagtatttcaattttgttttctttcctacttcaggttataaagataatttcttacattattttcttaaagtattatagtttttcctttcacccgctggtctggaattcatctgggttttacgtctatgtatggtgaaggtaatgatttaactgcattttttttccatttggataagtattttttcagttgtattattaaacagtttatcaatttcacattgatttgtaatcccattgtgacatgaattaagtttttgtatgtggtgcatctgcgtctggcttctccaacttgttatagccccagccattccttgaactataccctgctgtcttactgtagctttctaatgtcttgatatctgaaggagtaaatgtctctatcttgcacttctcctttagggaagtctttgttcttccatgtaagtgtaacaaccttgttgtacaagtcagtgaaaaatattattgggatttttattggagttgcattgcatcttgagatcctgatgcattatttaatttatttaggttttctttagtgtctttcaacatagctttatagtattttttcatgaaggttatgcatatctttcattaacttacttccttgttactttatatttgttgttgctattgcaaatagtattttttaaaaagttacactatgttacttatcattgcttgtgtaatggaaataaagttaattttaaaaatcaactttattgatctatacaataacatttaagagtacatttcaatgaatttgacatgtctatgcacctgtgtaaccaccatcatgattgaaatataaagcatcttcattttcctcagaattctcctgtgctctatcccagcccaacctacctccactcaccccacatcttcagatccaggcaatagcttgtctgcttttggtcatctagattagatttgccttttctaaattttatataaaggatatatccttggtgtttggcttctttcacccagtaaaatgttttgagatttatttatgtggttggttgtattagtatggtcatgcaccacttgacaatatttcagtcaacaatggactgcgtatatgacaggggtcacatagaattataataccatatcttaactgtactttataaatgtgtagacatgcaaatgcttaccattgtattacaactgcctacagtattcagtacaatgacatgctgtacaggtgtgtaggctaagagcaataggctacaccacatggctaggtatgtagtaggctccaccatctaggtttgtgtaagcatgttctgtggtgttcacacatgatgaaattgcctaagaatgcatttcccacagtacattctcttctttaagtgacagatgactataattcattcctttttatttttcccatgggtaaggatgacccgggatgttcttttctgtttttttggttaatttttaaaaaaaattttgtttctgaatatatattttaaaagtctttatttttaattattgtggatacatactagttttatatatctctgaggtatgtgcaatattttgatacaaatacacaatgcataatgataaaatcagggtaatcaggatatccatcatctaaagtataaatcatttgtgtgagtgtgtgtgtgtgagtgtgttaggaacattccagtttcactcttttagttattttgaaatatgtaataaattattgttatctatagtcatcccagtgtgctactcaacattagatccaactccttctatctaactgcacttttgtacccgttacttatcccctctatatctcccacctcaccactacccttctcagcctctggtaactatcattctactctctgtctctatgagtttaattattttaagctcccacatataagtgagaacacataatatttgtctttctgtgcctggcttatttcccttaacataatgccttccagttgcatccttgtcgttgcaaatgacaggatgtcattcttttttatggctgaataatatacgtactacattttctttatccatttatatgttgatgaacactaaggttgattccatagcttggctgttttgaataatgctgcagtaaacatgagagtgcagatgtctctgttttttttttccttttggattggatttatacacagcagttggattgctagatcacatggtagttttatttctagttttttgaggaacctcccttctgttctccatagtggctgtactgatttactttcctgccaacagtgtacaagagttcctttttcccaacccctcactaacatttgctattgcttgtctgtttaataaaagccattttaactgggatgagatcatatctcattgtaatttggattttcccttcttggatgagtagtgatgttaagcaagtgttcatgtcctagtgacccatttgtatgtcttcttttgagaaatgtctattcagatttttgcctatttttcattgaattgtttgtttgttttgtattgagttgtttgagcttgttatatattctggttattaatcccttgtcatatgtgtagtttgcagatcttttctcccattctgcgagttgtttcttaactttgtttgttatattattttctttgctgtgcagaagcttttgagcttgatgtgatccatttgtccatttttacttttgttgtctgtgcttttgaggccttactcaagaaatctttgcccagacctatgtcctggagtgtttccccaaagttttattctattagtttcatagtttcaggtcttagatttaagtctttaatcaattttgatttttttttaatatggcaagagataggggtttagtttcattctgcataaggatatccactcttagcagcatttattgaagagactgttctttcctcattgaatgttcttggagcctttgtaaaaaatgaggaatttaatgcttggatttatttctgggttctctgttctgttccattggtctatgtgtctgttttcatgccaatactgtgctgacttggttactaaagctttgtagtatattttgaaatcaggtaatgtgatgccatcagctttgctctttttgctgaggattgctttggctattttaggtctttgtagctgcatataaattttaggattttaaaaaatgaattttttttctatttctatgaagaacatctttggtattttcatagcgattgcattgaatctgaagattgctttggggaggatggacattttaataatattgattcttccaatccatgaacacggaacatctttctaactttttgtgtgtcctcttcaatttctttcatcagggttttatagttttcattgcaaggattttttgcttttttggttaggtttattcctaggtatgttattttatttgtagctattataaatggtattgctttcttggtttctttttcacattgttcactgttagtgtatatacatgctattgatttttctttgttaattttgtatcctgcaactttactgaatttgtttatcagttctaatagtttcttggtgaagtctttaggtttttctaaatatgagatcatgttatatgcaaacaaggataatttgacttcttcctttccaatttggattccctttatttctttctgttgctggattgttctggctgggacttccagtgttatgttgcataaaagtagtgaaagtgggcattccagttccaaatcttaaagaaaaggtcttcagttttcccctgttcagtatgctagtagctgtggttttgtcatatgaggtgtttattgtgcttgattgtgttccttctatatccagttttttgagagtttgtatcataaaggaatgttgaattttatttaatgctttttcaacatctattgatatgattatatagtttttgtcctttgtcttttgatgtgatgtatcacattgattaatttgcatatgttaaatcactcttgcatccttgggatggatgaatcccacttggtcataataaatgtaatattaaatgtaatattatatttacatgtaaatttaaatgtaatattaaattcagttaaatgtaatattaaattcagttttgttggtattttgttgagaatttttgcatctatgttcatcagaaatattggcctctggttttcttttttgttatttttttgtgtatatgtctggttttggtatcagggtaatactggcactgcagaacgagtttgacagcattccttcctcttcaaccttttggattagtttgagtaggattagtattaattcttgtttaaatggtaaaattcagcagtgaagccattgtttgggtcctgagcttttctttgatgggggaatgtttattactgttatcttattacctgttgttggtttattcaaattttggatttctttgtggttcaatattggtatgttgcatgtatctaggaatttatttatttcttctaagtttttcagttgaagaggacacacaaaaaatagaaagatattctatgttcatggattgcaataatcaatattaataaaatgtctatgcttccaaaagcaatctgcaaattcaatgtaatttctaccaaatcgatgtattgatatatagttgctcacagtagtctctgatgatcctttgaatctttgtggcatcagttgtaatttctccttttttgcctcaaactttatttatttgggtcttctctgttttttcctatgtcagtattgctaaaggtttatcaattttgtgtatctattaaaaaaactttttgtttcattgatcttttaaagaaaacttctgctctgatctttattatttcttctactaattttgggcttgttttgttcttgcttttctaattctttaagatgcatactgtattagtcaattcttatgctgctatgaagaaatatccaagactgggtaatttataaagtaaagagatttaattgactcacaattctgcaccgttggggaggcctcaggaaacttacaatcatggtggaaggggaagcaaacatgttcttcacatggcggcaggagagagaagcatagagcaaagggggaaaaagccccttataaaaccgccggatctcatgagaactcactcactatcatgagaagagcatgggggaactgcccccatgatctaattacctcccatgaagtccctcccacaacacatagggattacaattcaagatgagattttgggtggggacatggccaaaccatatcacatagttaggttgtttatttgaagttttttttctttttttaaaacttttgtgatgtaggcatttattgctataaacttgcctcttaatactacttttgctgtatcccacaggttttggtacgttgtttttctattttgatttttttttaaacaattttaaaatttccttcttaatttcttcattgacccagtggtaattcaggggcatattgttcactatttctgtgtttttacaacttgcaaagttgatcttgttattgatatctagttttattccactgtggtcagaaaagatacttaatataattttaattattttgaatttttttagacttattttgtggcctaatatataatatatccttgagagtgttccatattctaaaaagaagaatgcagattctgtagctgttggatggaatgttctgtaaatgtttattaggttcatttcatctatagtgtagataaaatcaaatgattcttcattgcttttctgtttaaatgatctgttcaatgcaaaatatggggtgtcaaagtctccagctgtgattatattgagatctctctctctttagctctgttaatatttgctttttatatatggatgctccagagttggatgcacccaatttatattattatatttatattacatttcgctgtctgagaggtcacatatctctgtcactgcaggattggtcactgattacttagtttgtttggtgaggttgtgtttttctggatgttcttgatgcttatggatgttcattaatggctgagcattgaagagttaggcatttattccaatctttgcagtctgggcttgtttgtacccatccttcttgagaggactttccaagaattcaaaggggaataaatgttgtgacctaagcctgtggtcactgcagctgtttcagcactagctgtttcattcctaagcccaagaatgctgcaactcttgaagactcccagataatcagccttgttggacttagggaagttaagagagcattctctgggttaccagttgaagtctcttgctctcttccttctgtttcccctaatcagaaggagtatctttccacactgggctgcctggaattgggggaggggtgatgcaggcactcccatggtaccatgttgggtcacacctgaagctcatgttcttcctgatgagtacagtactggggcttacccaaggcccatggccactacttcctggctgctgctgatgtttattcaaggttcaaggtcaccttactcagcaggtggccaatcctgctgggactgggtccatcccatcagggcagcagattctcatctagcctagatgggtctagaaatgccattgggaagcaaaggcctggaatcaggggcttcagaaatctgcctggtactttattttacagtggctgaactggtatccagcttgccagaccaagtcctctgtaatattccttctcccttcctcaagcagaagtctttccccaagctcactgcctggagttggtggagggttgatgtaagcactctaatggctactacagctggtattgcattggtactgcaactccactgccttcaaaaccagcagaacaccagggcttatctaaggactgcagttcttgtggcctgcctgccactcaaatttatttgggatctcaaaccactttatcagcctgtagtgaggccagccaggacttggatacctcttgctgtggcacaggatgctcatctggctcagggctggtctaaatgctccctctgtgggcaccagtagaattctgccctttgttgcattctattgtgatagggcagcactgagtttcagtacaaagattcacacttagtttgctctccctccctcaagcacacagaatctttctccatgctgcactgcctgggattgagtgaggagaggtaggcaacgcaagactgtcctttctatcttcttcagtgcctctttccatcttaaatgttatgaacattaaaaaataaatctgtgtgtggacaaatattttaatttttcttgggttaatacctaggagtagaattcttgggataaatgtttagtgtatgtttagctatatagtgtatgtccaggctgtttgttcgaaagtgttgtgcaattttatactcccaacatcaatacataagaattccagttgctccacattcttgctaacacttattatgttgttctctttaattttagccattatactgttgtattgtgctttctaattgtagttttaatttacattttcttgatcaggaatgatgttaagcatctttttatgtgtttattggccatttcaatattttttgaggaaagtgtctgtttaaatattttatgcaattgattttttatttttggttttattgaattcttagagtttttttacatatactggtcacaagtctttaatcatatgtatacatattatacatgtattgcaaatattattttctcatttgtgctgtgtcttttgaagagcaagggttattttgataaaatataatttatcacttttttctattttgagtagtgctttttgtgtttttctttaacaaagaaatatttgcctaatatttttgaagattgttcagattttttcctgtattttctatgtttaataattttagcttttgtttataggtacaatttattttcagtttatttctttctatggtgtgatgtaacttttgaggtttatctttttacatatgtatatacaattctagtagcatttgttgaaaaagctattctatttcattaaaatacattgggacctttgtttaaaatcagttgatttgttaatagtatgaagggctgtttttggactctcagatcttgtaggtttcatttcacaacatcagaatatagcaaatattgcaataaagtgagtcacataaattttttagttttccattgcatataaaagttatgtttacactatattgcagtctgttaagtgtgcaatagcattgtctaaaaaatgtacataacttaaataaaggaacactttatagctaaaaaatgctcatgatcatctgagccttcagtgagtcaatctttttgctggtaaagatcttgttttgttgccgatgactgctgactgatcagggtggtggttgctggaggtggaagtggctgtggctatttctttaagtaagacagaaatgaagtttactgcatcattgactgtttctttcatgaaagatttctctgtagcatatgatgctgttttatagcatttacttacagtgggacttctttcaaaatgagagtcaatcttctcaaactctgtcactgacttaccaactaactttatgtaatattctaaatcctttgttatcatttcagtaatgttcacagcatcttcaccagaagtagattccatctcaagaaaccactttgcttgcttatccataagaagcaactcctcattcattagttttattatgagattgcaacaattctgtcacatcttaaggctccacttctaattctagttcttttgctatttccatcacatctgcagttactttctccactgaagtctggaacccactcaaaatcatccataaatttgaatcactatctatgactctatagctttatgaaattcatttcttaaataataagatttgaaatttgaagttacttcttgctccacgtgctgcagactggatgtttgttagcaggcttgaaaacattaatctccttgtacgtcttcattggaactcttggataactggctgcatggtcaatgagcagtgatattttgaaaacaacatttttttctgagcagtaggttttgacagtgagtttaaaatatacagtaaaacatgctgtaaacagaggtgctgccatctaagctttgatattccatttatagagcacagaagcagttgatttagcatagttcttaagggccctaggatttttggaatggtaaataaacactggcttcaacttaaggtcaccagctgtgttagcccctaacaagagagtcagcctgtcctttgagactttgaaggtaggcattgacttctcctctccggttaatgaaagtcctagatagcatcttccaatgcaaggctgtttcatctgcattgaaaatctgttgtttagtgtagacacttacaccaattattttagctagatcttctggagaacttgcttcagcttctatatcaatgcttacatcttcaccttgtacttttatgtaatggagacggcttctttcctgaaacctcatgaaccaacctctgctaacttcagactttccttctgcagcttcctcacctctctcaggcttcatagaactaaagagaattaggacctttctctggattagactttggcttaaggaaatgttgtggctgatttgatctatccagacctttaaaactttttccatatcactttcttatcatttgtgttttcactggagtggcacttttcattttctttaagaaccttttctttgcattcacaacttcattaactgttagtgaattgcatttattaactgcttggtgaaaaagtcctagctttcagcccatctcagcttttaacatgctttcctcactaaacttaataattcttaatcattaataaacatgggaggtggaggttgcagtgagctgagattgtgctactgctctccagcctgggcaacaagagtgagactctgtctctaataataataataataattctaataattctagcttttgatttaaagtgacagacatgtgactcttcctttcactcgaacaattagaggtcattgtagggttattaattagcctaatttcaatatcattgtgtctcagggaacaggaaggcccgaggagaggaagagagatgggggaatggccaaacagtggagcagtcagaatacacacaatatttattgattgagttctccatcttatatgggcatggtttgtggcatccccgagcaattatgatagtaatatcaaagatcactgattacagaacacaatagcagatataataataatgaagatttaaaatattttgtgaggattaccaaaatgtgacacagagacacaaagtgagcacatgctgttggagaaatggcattgatagacttgctcagtgcagggttgccatgaaccttcaatttgtgaaaaatacagtatctgtgaagcacaataaagcgaagcataataaaacaaggtaggcctgtacacaattcaataattgttagtatattcagagctgggcaaccatcatcacagttaattttagaaaaatttccccaacctgacaagaaaatctaaatgtattagcatacacttctcatttcctcccaatctcccccacgcctaaccctgggcatacaactaaactactttctgtctcgatagattttactattctggacatttcctacatatagaatttgtataagttataggctttgtttggtgactgccttctttcacttagcacgatgtttttaaggttcattcatgttgtagcatctaaaatccttcattttaaaattgatgatcaactaatattcccttgtatagatacaggacagtttctttatcttttcctctgtcgaagtacatttgagttgtttccacttttagcctattatgaataatgctggaatattcatgtgcaagttttaaaataaatgtatgtttttgtttctcttgagtatatgctaggtcatatgatagctctacgtctaacattttgagaaaccgtcagattgtttttcaacgtggctctaccattttgctctcccatcatcagtggtagaaagcttcaattactccacattctcaccaatacttatatttctgttctttagattgtagccatctaggtggatataaggagttatcccattgtgattttgatttacatttccctagcggtttatgatgttgacaatctttttatgtagtttttggccatttgtatatcttccttggagaaatgtctattcaaatcttttgcccattttaaattggattatttgtctttttattataaagttgtaagaattcttcatatattttacagacaagtcccttattagatatatgatttccacatctttcccccccattttctgggttatctttccactttatgattgtgtttttgaagtaaaagtttttaattttcatgaagtccaacttatctttttcttttgttgtttgtgcttttggtgtcatatctaaaatgctcagcctaaccttcaatcataaggatttcctgctatgttttcttctgagttatacagtttagcttttacattttagtctattatccattttgagttgacttttgtgtatggtgtgaggaagggatacaacttcattcttttgcatgtggatatgcagttgtcctaaagggttaccttctatctatagattagtttggagagaattaacattttaaaaacattgaatcatccaatccatgagcatgatatagctctccatttattttaagctttctggaatttctctcaggaatgtttttgtagctctcagttctatgtatatttcattaaatgtattcctaagtagttaatattttttggtattgttttaaacattttgatttctcaaagaactaagaatagaactaccactctatacagcaatttcattactggatgtctatccaaaggaatataaatcattatattaaaaagatacctgctcttgtgtatttactgtagcacaattcacaagtgcaaagttatggagttgacctagtactgtcctcagatccttcctctctggctcagatgaatgggagcagtaatgtgagtcagccataacaaccttcttaggagaattacttctgcctttggatctgcttagagataattctcatttgataacaatttgccctgtttgtctaagcaaaaattaacaaaaattgtaatagaaagaataatcatattgcttcacattccttgcttattcttgtagtccttacgctgaaaatgcacatatctcagtgttagtctcaccactgccgcttctcttcctgcttatttacacagtgctgggtgctggatgatcctcacaccaccctattaggtaggtaatattttgatcttattttaaagataatctcccaagtgtgacactgctttaaacacattttgactccaagggagctctcattgggtctaagttttctcatcttcaaactgaggaagggacctgaataatgatttccaaggccccatgtacttctgacaacctcaagtgggtccttcacagaattgcaaggatgtctctaggtgcagcattggttcctggccctttgaaggggtgattctcagtgtcagtctgagggctgggaaagttcagtcatctctgcccagtggccttctcttgatctccccactgtaatctcttttatccccttccctttgcaagtcttttcctagcctggcaggtcaagcattacctgataaaagtctcaataaagacctgtactcagaaaggaggaaactgctctccacccaaatcctattatagctctgggatttccctgctgctctggaattcactctctctctcacacatacacacaaattaacatttaatcaggattttctatgtatttttctgctataaacatttctcatgttaatgatagttcctaatttggtcttaaggacaaattgaggtacttttgagataataactagaaaaagaatgtaaaacctgctcattattacaggggaaactcatcttgaattacatcagtttctataatctgataattctatggtttccgaggcgaatctcatgtatgggtgaggcaggagagtttgaatcatggttcatagctttcagaggtcatttttagcctttaatatgaggcctcagtagagaagtaatttcttgttgtgcttttgaaattctgatccattcaagttgaaggccacacttaaaaggtaagatttctggctggtcatggtggttcatgcctgtaatcccatactttggaaggccaaagtgggaggatcactggaggccaggagttcaagatgagcctgggcgatatagcaagatcctctctctacattttttttttaaagcaaagcaaaacaaaacaaaaacaggtgagatttctgttgagtgtacgtagcaaccacctgtagtagaaggtcctctaagccagtgctcagttctctgggctccagacctagctttgctgcaaacattctgcttgcttttagcaaattcactttgattgtctgggccacatttcctcatctctaaatagctgacttgaaaggcattgaatttattttattcatcagtaaatgttgaacctgctctgacttcattataggttgtgagaattaagtgataatatttgtggaagagatttactgtaactctttgtgatgtaagctttgttattttttcatggtagatatgcatgttgacaactgttaattcattttgactatgttctctaatttgtaaaataaaggcatggaattaaaaaactaaaacattctccgtaattatctctgtctcctcctcatgcacagatcatatcatgtccgtactgttcactgatgtatttattccaggcaccgtgtgcagggcatgctgtataatatgtgttaaataaatttaaaaaatggcttataaacataaaatggctaagctttcagataatacagagaatgagaacgattttctaattttaaatttgtgaagattttttaaataatgatttctcttttggatgagggtcaggtgaaatgggctctcagggtagatgatgagagtgtaagttggtacaagtttaattgaaagcaatttggtatcaagaatcttaaaaaatgccaaggaaacttattcttgttaaagagtttcacttgcagtatttattctgtttaaagtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccaggcaagtaaacctctcataactgtgacactacctacctggacatagcttaaggagagctgtggaggctatgagaacccagaatgctaaatgctcaactcctgcctgtgctaaactttcatagtgagtctttgatggatgaggccagcacctgcagacggttgtggagggtggagctggattctctctcctcaaccccctcggaaggcaccttgtgcagtgcacacactgcataaccttcagagggctgcagcccatcctgactttgtctccacagttaccttctcaccactctgcctactcctttacactcttcggctgttgtcttcctttcttgctttctcttattctgtttttaaaatctgtccccaccttccccaaacacacacacacacacacacacacacacacacacacacacacacacattcccaattcatttcctccttcttgtatatttggattggtcttttccatgttagtaaccctttaagactggccttggatgatttatttactttgattacaaaccttttggattattggggtggattattccctaaacaaaagcaatttctgtttattataaagaacatccacattataaatggcttcatcttatttataatctatagtagggaaagttaggatggataaagatcttagagagttttgcttacaaatggagaagtttgcacctcagaaataggcagccagttgcctctcttcacatccctgagtcattgcctattgtgatatttgttaataaatgggggcattcagttaaatttgaaatttaaataacaaaaatttgttaatatatgtatgtcccaagtgttacatacttgggtaagaaataatttatttctaatctgaaattgaaatttaactggatgtgttctattttaaatttgctaaatctgataatcctaagtatatagctccaactataattcctatgtaattttttctttcttcatggagtgtatacaaaaccacgaaataaagagtttggcagaaacatgaagaatgggcttcccaaggcagatggcattatgtggtatttttaagagacaaaatagcacctttgtccaggatggggcagggctggccatggcctgcctgaaagctgatttcacaatggacccaaaatgtatcaaaatagaccagaatggttccaaacaccaaatgatggagttcttatattacactctattttggggtcattctacttttataaaatttgattttcaaatgaggtttttaacatgctatttaaagaagaattaaatttttttgagatgaagttcccactttatttctagttttctattatttgagccattttctgtgagatatgtaacttaaaataatctgaaaaattataatttcacttttttctcttcaagtttttccttcatttttttctttttaaaaaaattttcatttattccctctctcctatcctgaatttttgcaatgcccagtgaaattagatactaattaaataatacaataccctttggcaaattgttgaaatttggtttaccagttaaattttttccatgaatatacttagatttggaaatctatggtgatagctttcttcagataaatcttatgaagatagatttattcttcagttttggtgtatttgatttttgggccagggctcttggatactccatttgactttagaattaaaagtaggcatttagcatgtgctttttcattgatgattgaactaatatctcttaaaccttctttattatagattcttcttatggttccagtttttttacagtaagtatcttaacaatagtttgaaaattagtcttcagagacagaatggttaagtttacaacactgtttttaagtttacattttcaaagattatttctaatgacttgtataacaattgtatagaagctggatttgagagagccaaggtctttgtagatacgggctaaaagacaagtttgaattttctgaagcaaggctctgggtctgtgaaaagcagaggtgaaacctgaggccagcaggtggtgggcgatccacagagttgctttgtaagatgggtacagagtttatctgatcccagggatggtctgagatttgtgcttggcacataagcggtgactccctcgaggcacgaagccctcagttaaggaactagttatcaacaggggggattttgacctccaaaggatatttgtcaatgtctggacatatttttggttgtcataactgtggaccagtggggagggtaatattaacctctagtgggttgaggccagagatgtcgctaagaatcttacaaagcacaagacagcttctacaacaaagaatcatctgacccagaacatcagtagtccggttgataagcctcaagttaaggtgcaaccctgacaatattaaaaattcttccttgctcatattgcagcaccagacactgactgactgtacaggactttgtagtaacattgcattaacagaagcatatgtgtctgtatctgtttaattctaagaaagatttagacagctcaaaaaaaatatgccataaaaccattaggagaaaagtaaaagaataggggccagctaatggattggaatgaagcaagaatgtcagtgcatccattaaataatgacactagcaaagagtattgaacaaacactcatcttaacttggagatttctgatgcaccaggtcaaaaggaaaatatgggacacacactcaaaatcttacaaataatgaaagaacttaaaaatagaataaaccatcactttaatgattaaattagcatttaaaaaagaaattataatacctgatgcttgtgatgttgtagcttactgatataatctcatatggttgtgacaatgtaaaaagatataataatttttggaaaagcaacttgattttcttgctctgtaattgttctgaaaattaatgttatgtataatacaagggaaataaaaagctgtatgcataaaatgttcattgataatgatggataattcaaatttcccaaagtaagataagttgaccttggtggccttcttagtacagtcacttaatagtgagtatggtatgtggaaaatgagtatgttattagatcaagtgtaaaaagcagaggacagtatcatatccatcgtatgtttgcgatgtaaaaacatttcggtgcaaagaattgaaggaaaaaagatttgttacaatgaaagagttctatgttgcttttttattatagaattctgataaagatgttataccgtttgattttcactgagagtgaaatggctatctgaataatctgagcagaggaatggtgggacttgagttatgtttttggaggatttctttggacattgtgtcaagcagagaccgacggtagccagagcggaagtgggagcccacgtagggaatcagctcatccttctatgcaacattaaatggaggtattttagaacagacgcacagttagtgagggaggtagtgagatgtgagggtggttttgatatattttggaggtaaaatcagtaggctctgttgatgaatgtgaggtaggttatgagagaaagagaagaatcaaagatgactctatgtggtttgacctcagtaattggaaaaatggagtggccatttactgaggtggggaaagactgaaacaggtttttctgaggggagaggaggagagggtataaagggaaatcagaaattgatttgggggatgtcagtgagatatccaagtggcattgccaaggaggttgtgggagtttccagtttggagctgagataaactctcttggctggatatatcaatttagaaagtgttggtgcataaatgagacttcaaggtcatcaagggagagtgtgtagacagagcagagaaagagggctgagcaccaagcacttgcatttgaaaaagagtatcaggcaaggaggaggaaggtgagaatgtggggtgttgtggaagcccaggaaggcaattttctaggagatggggatgatccattgtctcaagtgtggctgattgatcatgtaagaagaggatggagaagtgccactgggattagcagcatggagttcattagtgatgttgacaagaaaggctctgatggaatgatgagggtaaaagcctgactggagtgggtttaaaagagagtgggggcactccgggctcagtggctcatgcctgtaaccctagcactttgggaggctgaggcggtccaatcacctaaggtcaggagttcaagaccagcctggccaacatgatgaaaccacttctctactaaaaatacaagaatgatccaggcgcgtaatggcaggtgcctataatcccagctactcgagaggctgaggcacgagaattgcttgaacctgggaggcggaggttgcagtgacctgagattgtgccactgcactccagcctgggtgacagagcaagactcggtctcaaaaaaaaaaaaaaaaaaagagagagagagagagaatgggggcaggtaagtggagacagagagtgtatatgactcaagatggtaggctgtgaagcagtgaagtatggggtggaagctgctgggcattgcagaggcctttgctgtctgttcccaccctgctggctctctaatttctccccagctaagatggacagttccccgagagctcagacatctggtcacagggccccatgtcaaacacatgctgagagtattttgctttctgttcttccccgaagtcagttcagcttgagagggcaggggagctaacaaccccattgcaacccacagctggggtgaccaccagactcacattgcctgggactgagagtcccttgttccaggaaacatctcagtcctgggcaactggggaaggttggtccaacttcccccagcaatggttcaactctgggcagtacctttgttcctgagaggctttgaggattcaagccagcatggcctgtgcaggtccttgatggctgcattgacttttccctctttccctctttccccactgcaacatggatgttgcagtgaaccttctccagaccattttgaagtgagtgaaaaagaaaaacataactaagtatcaatatgttgtttttttaccttatttttaaatgggaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatatttcatatgttgttatagtttataaatggccagttttaatcgctgcagcattctttccacctcctcagctccttcttcctgggaccatctcctgaataagccacctatatacaagtccttgttgcaggggaacctaaacggagacaggagatatggatttattttccttctttattattattattatttttttagagacaaaaaatgctctgtcgttgagcttcaaactcctgggctcaagccatcctctggcctcagcctccctaaatactgggattataggcgttaatcaccatgcgtgcgtgcctgcctgcctgcctgcctgcctgccttccttccttccttccttccttccttccttccttccttccttccttccttccttccttctttgcttccttctttacttccttccttccctccctccctccctcccttccatctttcctctctcctttcttccctccctctctccctgttcagcacagatggaaccatccatttttttccctaaattttttcaatcgatggtttattgaatccaaggatgcctaacacacagttacgaaaggctgactgtacttcactgtatacttctgaaaaacaaggtcattcttgaacataaccacagtacaattattagaatcagaaaattaacactaatacaatagaattatttaacctatagactttttccagatttgccaattgttctaataatgtccttaacagcaaaagaaaatcttggatcatgtattgcattcagttgtcctgtctttagtttcctttgttctggaacggtctttgtttttatttcatcatgatttttgaatagatcacttattttgtagactatctatctcaattttggggttgcctgatgtctgttcgtgattgcatttggggttttgtacttatggcaggaacagcttgtgttttttaagatggcagataataacatgctgataggaatgaaccgatagaggggaaaagagagaattgctggatgatgctcttgaggggtgggagagcaggagggctgagctcagcctgaggactgaagcactgaatttggctggggatagatttttttttcttttgccagtggaatatatgatagattgtgagaagagaagagagttgagtgggtattcaagggaaagatcatccaggaatggaccaggggcacgagggcaatggggacaagaaagaggtgttggcagaatggaatgtggggcctggtagggccaaagagtcattagagttggggaactgtagaaaaggagtggggttggtcatcgaagagtgaggtgcataaagttgtagctattgataatgaaaacaaaatgaagattttgaccagagaaatgggtgattcaagcaggtggaagaaaatatcattggatggaagggagataaagtaacagaggggatttgaggatcattagatatggaaattactgagaatggtggctgaagtcatgccgaaaagcatggtagtgtgctagaagccagaatcctccagaaatggaaagagctcattctgggagcttcccaggaccctgctgagttctgagaccctcttttcattccactgagagtggtgtgaggaagagggagtgtgtctcgtttggagtagttggacctctggagaatgcttctttttctgtttgtttgttttaactctatctcatctgaaagataaatgctgtgacttttatgagtggtctaaaatgcaggactcacttttattgaagaaatgggaactaggcagcaagaagagaaccagcaactgcggagcttggatcacagagtgtggggtagttgttactgggatgtcatggagcattggggtgtttttccacctagggagagcatgcgggctcagtgaggcactggagacccatgttccttctatttttgcacttagccattcttggcatataataagaaagcctcgggtatctagagaaatccaaaggctctatactatgggccagctgcatttgccttctgatcaagccatcagtgctcagtgaaatgttgggtttttttgttcatatttgaattactctcttttctttatcatttacatgtaaagaatagatcattacattcttatccaggatctatgtcacagactttgttgcttcaaaaactgtagaagttggtacagcttgttacaaaaatcggccttctttgtcttcttaccccatccatatttttccctccttgtccatatttttaagccattaaaaaaaaatcctccaactgcacagaatagttttaacattgtgttcagcagattggcaaatctgttcaatgtagtgatatattaagtgtgagtttctactaggagaatgtctacaattttgcacctttgtagcatctgtctgtctcatttactttattaataaaactccagagggaaacttttggtgtattttttttcccatcagatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaagtgagtgaaaaagaaaaacataactaagtatcaatatgttgtttttttaccttatttttaaaatgagaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatattttgtatgttgttatagtttataaatggccagttttaatggctgcagcatatatcattctggtaaagtactatatactgtaatttacttaataaatttggcattggatttttggttgtttctgagtttttcactattagagataggcttgaatataataatttcaactaatttcttaagaaattatgccatagttgcccagtatagcattcagaactgataagctcagttgcttcagttgtgtaattcagttagctggacgttggtctcctatgctggatttgacccccatgttacctggggtgacctttgggagcatcccttcccgtggtgggcttcttatgccttaatcagcatggccctcttttataaccaattgaattattttgtgtaaactcattgtatgaataatgggttttattatttttcattagcaaaggtttatattcttctctgttttttaactgttacttattctatctgccattggtgagagccacattacccttaagctacaacaaaaagggccctgtcctggggcctgtgctttggggaggtccccgttctggctttccctggactgtgcctctgctcatggctcagactgcccatggggtgaaggggatgtgtccacggagcccacacaccctgattccctctcaccctggagttccctaatttaatgaccagatcatggtcaagcctcttttctggcccctccttctgagggcaagtcttaacactggactgtggctcctgcagcccaagggtattctagggatggctgcagccattggcaggagtgtggggtgggaggcacgggtgctgttgggctttgtaggctggaggacctacctatgtgcactgaggccccttgaggtacagaccaagctgagggtggggagcacataggggaggagtggactgaaggttggggccagggacaggtgctccccaaactcccacattctggtgcgtaactctgaggatcacaaaattctaaatttgaatgtagctttccaagttgttatgaagatctatttgtcaatgtaggaaaatggaacgtattttgatagttagttagcttgatttataacttaaatatttgaacatatttgaaatgcctccctttgtattcttgcccgaagctctgactgtgttagcagtgaacaacgaaaataattggctattctgagagatgcaaaatttaaaatgagaagatattgatgacagttgttgaaccatatcagcttcagtataaattgtatttccatatttggcttcagtggcatgatatcaagaaaatctgcattcatagaagtatttgcaagtggtaccaggtttcagtgatatatcttataatcctgggatacgcttcaatacacaaagttgtcataaaagatttttcttgatgaaaatctacaaggaaataatctgtttggaagcacagcttatgattgtgttggtctcatgttgctaaaatgcagatatattccaacttctgttgagtgcattttctaatctacaaatttaagcatatttatttataaaataaaatattaatattttaaaaataaaattaatatgtatatgtagattctccctccccaaagctccttgttctttgaaacagtttaacagccactgattaacccttgacctattcagatccataggttaagacagggtggaggattgaggtacatggtattgccccccaaatattagactgattatctgaacttgaagcagccaggctgactgttcatttgcttttctaacatagcagccctttgcaccctggctggcctcatcagctgccctgcggcaggaagaatcaaggctgagtataaaataacacctatggcagagccaatgcaaacttgagttctgtgtcaaaggcagagtggaagatggcctaagttctcaagtgtttcaagagaagaccttacctcttacatttagttactagttcagggagttagggtcacattaaagccacaaagaatgctgacatgtaaatggtccagccacatcttgcaacagcactaggggcccagtccatgggatgtaagtaaacctagaattgatgctacttgttttgctaactacccactcatattgctttttgttttgttttggttctagttccttaatatccctagaagatttagattggcttccactcaaccaaactttttcccaggtttctgaacttgtactgaatgtgaccatttcgacactgacatttctgcagcaacatggagtagcagtcaccggtatgggtgccttgtagctattgctatatttcaaaacgtttaactacttaaattcattgacagttgacatagagctaaaatgatgttcaaaatgatttaattaaaatttcaaattcaaaaaagtatcaattgtttctgttaatacaagacaaaaatagaataaaaattttgaactcgaaactgaatttgactttctaccactgttgacattctgcagtcattgctaatataaatgatatttttaagttaaaaataactgattttaaagttctttgactttatttcatctaatattagacctatcactagctctgtgattttaatctttcctctctctaagctcctattgggaggaaatattttaaaaatggcaaagctagtaagaggaggcaggttgatgtggacttacagagtccctaactaaataagcagccctaccacaggggagggaatggaattatatagctcttttcttgatccaggatattattatttcctgaattaccaattgagtctgagctttttacttttaattcccttcttttctctatttttctatctttggctatttctctaagggaaatacagtgagagaacaacaaagttggaattcatccacccatttatctgttcatctgtccatccatccacccacacatccattcatccatccatccatctgcctacccattcacccactaaacaactcatcaacctctttatacatctatccatctattcgtccattaatccatccatctatccatctattcatccattaatccatccatccgtccatccatccatccatccatccactcactcatccattcatctgtccatccacctccccattcatctactcaccaacccaccaacccattcatctgttcatttatttattcattctctcattgaataaacaacgagcacttcctatgagccaaacacttccccagagagtgggaataaaaagctgaataagacatagttctttaatgagaatgcatggacacagggaggggaacaacatacaccaggtccagtcgtcgggtcgggggagaggggagggagagcattaggacaaatagctaatgcatgcgggtcttaaaacctagatgatgggttgataggtgcagcaaatcaccatggaacatgtatacctatgtaataaacctgcacattctgcacttgtatcccggaacttaaagttaaaaaaaaaaaaaggcatagttcttactttcaaggaagtcatgtttagtaaaggagagagatatgtcaataataaaaaacaaacaaacaaacaaacaaaaaacaaagaccacagagtaaggatctgacatctgcttcaggaaaaacttcaaggaggagttttgaagggtgagttggagtttatcaaagagatgagggagcatttccaggaagagagaagactgtgagatacttgggcttgctgagagctgtgaatgtttgacattcagtgtgtctgaggtacagtgggcagtagcagggggtggcatagaaaggagcccaggccaaaacacgagtggccatgggagcagtagaattagatctgcattatagaaagacactcctgggccggtgtgaggagtagattggaggcaggtagttctggggttcaggatcctgggagcaagtcttccatcagccactttctcctgaggtctcagtctcctgaactattattattattattattattagagatggagtctcgctcttttgcccaggcggcagtgcagcagtgagatcttggctcattgcaacctctgcctcctgggttcaagcaattctcctgcctcagccaaccaaatagctgggactacaggcgtgcatcaccacgcctggctaatttttgtatttttagtagagacatggtttcaccatgttggccaggctggtctcaaactcctgacctcaggtgatctgccctcctcggcctcccaaagtgctgggattacaggcgtgagccactgcgcccaaccctgaactattgtacaatgagattgttatacacagagatttctacaatcccattcagaattttgctgcttcatggagcaaactaacatgaaaccctctatggccccaaattccacctttccacctgttgcttctttcttcttgttgcttgtgactcagcacagtgagacccacatggaatttttttttttttttttttttttttagctttctgtaagagaaagctagctcattaacgtttaactccattttcaggttaggttagttccactgggaagtatttcttatgctgagaacaaaacccagaggtggggtgcgagatgaataaaacacctcatcgaaatcttcccagtgaccttaatttaacagactcatttagaagctcaagtttttgtacatcatccaaattacaacaacaaatttgccttacaattgaaaatgtaattaccgttaagaatgtaattaaaataaacaattttctattaactctccagcgagtcaaagctaaggaacactattacaaaacatactttgagaggtaactaaaaattgtcttcatgtctcttgtctccaagaaaaattcttttgcttgatgagccaattccaatgtgaagaggaagggatgagtggcctcatgtggctttaggctactggtccaattatgttatgcactaaaactgttaatctacacattctgaattctctgttgtttagcaacaaatttctgaatccaagttgtctttcactttttgagaaagattttatacttttataagtatgctacactgatgtcactattttttctctcctttctggaactctgtgagtaattctaataccttctgagaccagtagagattaatagttacagctcagctttggaagccagatcatttgggtttgaatcagaggcttaatctaacaagtgggactctaagaaaaaggggataattacagcacctacctcatagtgttgttggaggactaagtgagacctcccatggtgtattcttagtctaggtcctagtacctcttcaacatacaataaatgctggttttaatctcagacaccaatcttttttcctcccatgatgccatgtaaaggcaatcagactggaaacaaaaaatcttgtatttctgggattttccccatctttaacaccttcctgaagtccccgttgacttggtctgtctttgtgaatgtcatggattgtgcttttttttgtagacctcactgcaattataaggatcctatgagataatgcttgtgaaaatggcttattagtggctggcaggtgaaggggctcagtcaatgggtgttgaatcatcatgatctgaaacaatctaatttctaaatgaaggttcaagattcaaacacaccaagaaatttatgtgtttttatgtttgcagttgctgaggcatactccccagagattttgtcataccttgggggtcttcgatttatattttgaatgtgtcactactagatagtgccatgggttttttgggtagctcatgaattttatatgttgataacttgagttaggggaactttttcttatgacttcaaataattattgagaatacagttttaaagactccatagtattttatgctatggatatactataatttatcctttccctggatactagacacttaactggttttcaatattttatcagtatagaaccaataaaatattgtcgtaccttaatttttgctcagatatctgattaagcttcttgagaaagacttttagaagtgaaattattgggttcaatgacttgaattttataaagctcttgaaatatgttttaaaattatcttctggaaatgttgcaaccatttgtgccagggagcatgggacacttcaccattctctctatagcagcaagtgtttattctgtttgctttttctatctgatgccccagtggtgtttggtcttcatttgctcttcctttagaggtgaaaaaaggtattttttttctggattacattaaacatatcaaaatattcaaacaactgctggtgtaaatcttttgttattccaacagagccagtttaccacctgtccatgcagaatatagtgtgggatccacagaaagtccagtatgatctcaaatcccagtttggctttgatgatcttcacacggaacagatcctgaactcttcagctgaactgaaggaggtacacatgcttgactgcttctcacaccgctgggcctttcctggagactggatctagagcatgctgctggggcagggtgagcgggtgccacgggagaggcagccagacaggagagttcggtcaaaacccgagctccttacgcagaagagacccctactgtctccagcttttctagaagtgtctctttcttcttaccatgtagttttatcccagaatggaaaggcagcttagaaataatatgacacttgattgctctgggaactagcagtgggagaggccaggtcaagtgagggtgtgagattctgaagacagcgctagtggggtccaggtaggaagatggtgcaccagctgtagtgagtggggatacaagtgggtgaatttccaggtaaagagatagttttcattagaagagtaggagctgtacgttatggatgcctgctgggttcaccaaagttgagcctcttccctaactaggtgaaataagggagttggactggatgatcgatccccaagacccagttcactgttggtattgctgaggttctgggagatatcttttagttacagagtcccttttgtcactccagcccatttgtaggcacttctgctttgcatggtgcaggtccaagaactatgcgggacctggagctttggtccatagactccacctccagggttagagcatttctggtgcagctcctaggtcagtgttgagttaggaatgtttggagaggacccactctcttccattaggatctcagtccatgctggttatgtagattttgctcacttttttgtgagttccccacaacctggtcttcccagatagcacttttcacatttcagtgcagctagtttgtgttcagactgttgctttcagtatttagactctggatctgtgctctcagtctcaggggttagatggttgggttgcagccagcagaccctcatgctggcttggtgtttgaaaacccagttctaccaggtaggtttaggcttcaccaaagtatactaaattttgtgcttcttgtatccctggcacaattttattaatcatctcacaattttatgaactatctacctaccacaggacttgaaattgtgacccttgggttttctcatggatgctgatgtagatggaatatgaaaccccagttggctgacttttattctagttttctccatctttataaccccgttttctcattatattatagtttgagtgaactatgtaaaacttttaccttagaatgttcaatatattgagattagaattaaaaggaaagtgatcagaaaataccactgtgtatatcaacagagctccatggaaattgtacatcatgtgtgtgagctttctattgctgctgtagcaagttacccccaacatagtgccttaaggcaactgacattttcttttatcatagtgttctggaggtcagatgcctgaaatggtctcactgggctagaatcaaggtgtctgcagggctgcaatccttcttgaggtcaaggggacatactgttgtgggggaggaaaaattctttttttctctattattccatcttcaatggctggggctcatgaattaacctgataaaagacagataaagaagaggaaaaccagttattgtgtaggtatgtatgggagttcacaaagagaaatgtgtagatcttccctgatgaccattctgtttttcactttcagtatagtattcaataaattacatgagataataaatactttattataaaataagctttgtgttagattatttttccaattgtaggctaatgtatgtgttctgagcacagttcaggtaggctaggttaagtttggttatgttttgaggttgggtgtactaaatgtattcttggcttatgatattttcaagtcatgatgggttgatgaggatgtaacctcattgtagatcaaggatcacctgtattttaaggaagcagccagattattaaggcttatatgccatccaaggctatctatacaaaggaaagggggcttggggtttctgagtagcaaggcaagttatgggaaggtgaggggaggaaatatatggtgaatgagttatcctgttttgcagagaaatctcccaggtgatcagagttatttggagaagcagctctctttttggtaggagacatctttacagatgaaaattatcttaataatgtaaattttctttataaatctaaatttcctttaccaaaaggaaatttatactctatttttaaacagttagggaacggtaagaagtttttcctgcctctgctggttttcagtttgtctttagctcaaaataatccatatgccaaagaaacatactttggggtggcgtattctgttttcttgctttttccagcttccagtggccatccacattccttgggtctgagcctctttctcaatcatcaaagccagcaatggcaggtctagttcttctcatatcccatcacttgggcactgacatttttgcctcctttctccaataaaaacccttgtggttacactgggctcaccaggttacccaggataatcgcccatctcaaagccaggtgataagtagccttaatttcatctgcagccttaaatctcacttgccatacaacataacatattcatgggctcttgggattgggacatggacatcttgggggaacattgcctgcttcccacccttcgtaagtgtaattgcctggtgagctcttcctgcccactgcacagacaaaaccaattcattgagactgcagtattgcagtagagaaagggtttaattaatgcagagctagccaagggaaaaaactggagttattactcaaatcagcctccttgagaactcagagggtagggttttttttttttttttttttttggataatttggtgggcaggggactaggaaatgagtttcgccgattggttggggatgaaatcacaaggatgtggaaaaatgcaaaagtctgaaaaacgtctcaagagaccaatcttgggtttgacaatagtgatgttatctataggagcaattgaggaagtcacatatcttgtgatctttggccccatgactcctgagcagcaagggattatagaaggcaagctagggaccagtggctgattatcatttagctacacctacattttagcagcattcaagccactctcataatcttaatcttgtggccttttattagtcttacaagggcaggttctgtacctgagaaatgaggggattcatcttagggagggactactatcaaccttgctaaaaagttaaactacaaactaaattcctcccatggttagcttggtatatgcccaggagtgagcaaggacagccagcctctgaggctagaagcaaggtggagtcagccatgctagacttctctcactctcataatctgcaaaggtggtttcacagggccctttccatctgcatcagcctgtgagcctaggccctccctggggtctgtctgactcctgaccctgtcactctctgggcctgctgggggcctcagcacatgctgcccctgcaagagaatagtcctcctctttccctgcctctgcctcctgaattggaaaatgatttatctaacctcacatcctctgtggatctcctgtgacctcacttcagcctctgcctctacttcttcaaccttctataatagggcatgtcccagggagcctgatggctgcatatctgcctctcataggctgtgagcatctgagtggggacttggccttatctatctaacatgatacatggtattgttgattatttttaattaagggaaaaaaatagaacaaaacatcagggaccctgtgctttgacagtcacaggttaatattttaaatcctgatccaaaaggaacctaaaagtgaacacatgggactaaaattaagctttctgactattgtcattgtttagtcaattcaggctgttataacaaaagaccacagacttgtaaacaacagaaatttatcttggtgtgtcctcacgtggtagaaggggtaagggaactccctgggtctcttttatcagggtgctaatcccattcacaagtgttcaccctcatgatctgaccagctccccagggccccatctccttataccatcaccttgggggctaggatttcaaaatacgaattttggcggggaggccacaagcatttagaccatggcagtcaccaacagaatctcttaaagatggcattataattgttgtaaaatgatgtaataggggaatgtgcttcattatatcataaacataagtatttacaaagcagtgttacaggaactctgttgaagttctttttttttttttttctttaagacagagtctcactctgttgcccaggctggagtgcagtggcacgatctccgctcactgcaagctccgcctcctgggttcacgccattctcctgcctcagcctcctgagtagctgggactacaggcgcccaccaccacgcctggctaatcttttgtatttttagtagagacggggtttcaccatgttagccaggatggtctctatctcctgacctcgtgatccacccgcctcggcctcccaaagtgctgggattacaggcgtgagccaccgtgcccagccactgtgttgaagttcatgtataaaataaaggagatttggttcaaaaacattaaacagtttctgacccaggacttcaatttgaatctttccaattttatccacttttgatagtcagaaaagaaaatgttcttggcaaaacaactttgttagtccgaagtatgaattaaactgggctgacccatgttcacttttggcctaagaatgaaaagaaacaagatttgatgtcatctccatgtccttggcctggagaaacagctgttcctattgtttgtggatgaaactgaaaaatataactttttttttttaactaccaagtcttccctcaaggtaaatcacatagatatcatcacttacttcttcaatcaagcaaatgtaagaacttttactgtggcaagatcgtggtgttatttttagaagaggaaggttctaggaaaggagctttatgtctaaatattttttcatattgttgtcagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgctgtcccctctctctatgttctgttcaaaggtgtgccagtttgagtgtccaaatccattctcctcccctgccctgccatgtttactgttggattttatgtccctccaaggaaagggccttaggagccccacatcctggccattgagtgcaccttgtcccatgtgcatcaactggctccagctccataggcctaggccctcaacactcatcaccaaacagtctatcctaggcttgcacacacaccttggcaactcagaagttcctagacccatgctctgttattggtgcatgagattgccctggagtactatgaccagctctttggacatttgcatgctagcattgggcatccctctagcactttaagctctgaactggccttgtctcttcactctggttttgaccagaagctctgtgcacaaacagtgactgtgatttcagtgaccataatttaacaacacgaagggaggctctagtctgtctttatagggatgttggtgtggggcagagggcctgagtgattagattgctcctggcctcagaagctcatggagccctggctgtttcacagctttgcgcttcttggggaggttttggagactgtgaggcagagctcccctggcagtcacttcccatttgttttatcaggctttgccgtctctgtctcatgtttttccttaaagaacacacctctttaactttgttctccgctaatatgtgtcatgtataaaggccaaaatctcaaatggtagataaaacatccttaaaaatatataggtgttgtcgtctgcttcgtggcactaaagtcatccggcactaaaataatcaagggacagtgctgaaatgaccagcatccaatggtctagtggacacacttgctttgtgcattatctgggtaacataactcatggttaattaaggcatagttagcacacatacatgtacatcgtgcacctctccatgccatcaggcttgggcaagaatgatctatttttgtgtaatgttgatgacaaaccacagtgctaattgacttcagtatcatcctcaccatgtccgtgtcgtaaaatgacacttagtaaccatgtattaactttggtatatatttaaaaatatgcaaatatatttatgctatcctaaatatgttcgtttaggttttaaattgtatttcatttgtttagaggtgtatgttattcccttctctctttttctcttttgggggaaaaaagagaaataaggcagagattataaagttgtgtgcatccattgttgcaacatgaaatctttaatttctgagtagaaattaaatcatactgcaattgctaacagacattttaatttaccaaaaaataaagattggctgtctgtcatctagagtggtatgttaatatttcttaactaaatactgttctttccaatttgctattattaatgctagtattttggtttccgaatttgtaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatgtaagtcgcatttccctgtttgattattgattaggtagatgacacagaatgttaaagagtgcgtgatgatactgttagaaacacattctgtaaaactacagctaaataatgaatttcttgttagcaaatgggaaatcagaggctttcattgtggaccatcaccagggtagaagtcttggcagcactctggatgcctattcagaggctgcaatcgaccgaatacgggagcaatgtttgagaaggtgtcagtttcctagattttagattttatgtctttggcatttgtttaaaaatgaataaattcatttcggaggcatttttatgtacagaactaccttacatgagtagctcttttcctagaatcttcctcttcaaaaaatatgtttttatatttacttaaagattttgtatagttgaagtgtttacataaggtccagaaatattgtagaagtaggaaatggtggaacttgtttcttcctttttaagataaccacaattgattcaccaaaatagccgactagatctttttccttagtaggtgtggcagtttgtagtaacttgaatcttattatccttctgaagttaaggctgtctttggaaaagaagaatatgatttctcaatattatctcaaaaatgtgcatttcaaaccaggtcacacaaattcttgctctctgtgtaccatgaaggagagttgtgatgacagaattggataggaccatattgtgttcttatgattacttaagaaatagcaattctaaacacttccagttctttcacattttctggaacttttagcaaacaggatcttgcttttgaaggtcctatttcctaacttttacttaagagatgttctggggcctgaggtgcttgcgctaaaggcagaaatacagttccctatccgggccataaaagctacaggaggatggatgcagggagccagcaaggatgccttgaagtagtgttctaggcaaagggcagggacaaaacatctgtcataaatgaacaaatgcagggacattgcactggggatattgaaaacctccctgctggtctgtcacttaatgcacattaatagaaacaccacattaagtcaccgtaattatcctacaaatctcgaatgccccctggcactttagcctaggattttgcctgctctgtgccaggccaggggattgaagccccaggaagctgtacttggctcttagtcctacagagatggggggaagctgaagactataccacactctaggtacaaagctaggatagcccacattcttctgcccccatataaaatttccacacattctcagtgccaggaagatgaggcccaaacactggctttgctgtccatctgctgtttttttttctttgttttgttttgttttgctttgagacagtcttgctctgttgcccaggctgaagtgcaatggcgcgatcttggctccccgcaacctccacctctcagactcaagcgattctcctgcttcagcctcctgagtagctgggattacaggctcacaccactactgcccagctaatttttgcatttttagtagagacagggtttcaccgtattggccaggctggtcttgaactcctggcatcaagtgatctgccctcctcggcctcccaaagtgccggaattccaggcgtgagccaccgcagctggccaccttcagccttatttaaatctttctgagattcacatgcacccttagcagaaaattgtatatcttttatcattagctttggtccaagaaaccccatccctttttcactaccttgtcttcatagccaattgttcatatctttttctcttcctaagctgcaaagttcacccaaaataaatggaaatcacaccagactctcagttttctactgagtttttcgtgtcattacagactgccttttctcctccaggttctttctggttcctgcccacgtccctgcagtacgggtggctgaggtgtgggagctcttcacccaggctctagcagatagcgtggattttggcaaggcgaggactcacagaggtgcctctgcgccttccagcaaggactcacccttcaatgtcgcacgttgttgtgaatgtgaagtgtctgttcacagatgtggggggaatagtccctagggtctggccatgtggtatccttgcttgtcagagtttaaagagacttgacagtaagatccaggttccaagccacacagcatttcttttttccttggggaaaataaaataatctctttctcactttctagctctttccaagtgccactctgcttccttctcagtgtaatccaaagagtcagaacaatgactgacctaagcccagttcattctgcagatggccaattccaaaagccatgtgtccagcttcactctagcatgaggtgtcaggagtctggtcagcagccagaaagcccaagcatgtggctctgatggagcaattgctccgccttgtagggtgatgacgtggggatgggtaccagttcctgctggtgtcttgtaggagaattatcattgggaccttgctcactctctctataccctttacggtgcttgggtccatcagctctccagctagagaatagcagcaactatttatcaagcctgtgttcaaccccaaactatcaagatgccatgaagagactgaccactatggcacagaagtcgaaatggacgccaggcactcaaagcagtgggatggctccagccagtggaacattttgcttgggcttcaagtagctacatctctttctgcttttctccttctgtagcttgcttcgtttatcacaggtgaggattccatgcagttgctcaaagacacagaaagcctggactcacctgctctgggcagttctgctgcccacagtgtggctatgccttgcttctccctctcccgtatttattcccaatttcaggttcttcacattatcaaactcattttctttccagcttctcttctcagttgtttcttccatgtctggagcccgttagtctgacattctagggactatttgtattgagctgcctgggtggtcgttcttcctttgaccttggagaatcctacaggcattgccaattggctcaagttgggaccactgcgatgggtcctgtataccatcacacaccatctctatattttgaaacttttctcaaaatatttttctatatctcattaactataggcttcaaggcaaatgtttttagaccccatgtgaaactttatcctaaccctcacttcttttacacacacctaggaatatactttcccattttggggtaaagagaatgtttaatccatattcagtattgaaagaatctcccaatcaggtgactcaatgcaatttgtcaagaacctggttgtgtgatgaagtgtgactttcagtctagtgaacacacttctcaaagcagtggaatattttcctttgaacggaatttttatttccctaattggcacttcgaactacttttcattttatttcatttatttatttttgccctcagattacagcatctgtggaaattgcaaagcttgctgcaaaacctgccccagtggccggcactgaagagatttcttcagcttgatggagctctcagaaatgcgatagctcagaatttacattttgtccaaggtaagctagctttggtgttatttgtccctgactcactaagagtaaatgtgaaatttattggaaaatggacttgaaactgcctgacacattgtaaagttgggagataactttgctggtgtcatatgcatatttatgctttactctgatgccttctaggggatttaaaatacagcacaccaaggctaaataaacaataagggcacagtgaagagcgcatccttctgttttccttaagcccatgctgtggcctatgacaagcagtgtcctaaggctgggttgactttcacattcacggcagcatctgtggttttcaggctggaaagggaccagagtgcgttgtgaataagcgtatcttttgtattctgttccttctactgcctcctcccaccaatgcttcttggtgtccggtagggagagtgtgttccccctgggtttgcagaatgcccttctttgaactttcttgactatggtgagcattattctttcttccctcttctgaggaagttgggtttggacttttgcccagatgggctgcagccttttcattttctcagggaggagagggaaaaagtgaggggggatgttactttagaagtaaaaactcattctcactagtctttggaaaggacaaaatgatattacaatgactcctgttttcctttctaaggaagagaagaaaatgtataataataggtcaagtttttaaaaaatccatgttttcaggatccagtttattgattcatggccatgtataaaagtcaagcttacttaccttaggtgaataataatcaatttgtctactttgcagaagtcctcatttgcctggagacatcagctaatgattttaaatggtttgaacttaaccaattgaaactggaaaaggatgtgttcttttgggagctgaaacaggtaaagcacaacaaataattataaataagcatttttaataaaacattcaagaagctcatgcaatattcagttttgctccttttgtgaattgtgctagctaaaaaagggaacaatatgcaggtttttcaaaactttatgttgtgtttaaaatgtttatcattgcttattatatttgcagttcttgagcccatgaagagggtatctaagcctctttaaatgttactccttcccactcttattaatcttttagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgtaagtattctaccatcttagctcttctaagggcacaaatttaagattaaattcaccaaagatgctaatatttaacctggagtttcgatgaggaaagttttgccgtaagcccacacacttaaaggaagctggctctctgaactccagctgcccttcaatgctggcctttctgtctgactgaaaggttgtatgccacccgcctggccaaaacctacttgaaattcctcaaactttcaaaacataccacttcttcttttctggcttcctggatccttgatctgcttcattcttggctgcacatgctaagaaaagcagaggagtctctggtgattagtcaatcccagcaaaactgtggctttgagtggttacaagctttaaaagtcatattcctctcatgtaactgcccaggacaatgggctacccctgttcagcgctcaagtgggactgcagaatgttgaacgatttgtttggaaagattattttgtcaagttccagccctattcttcttactgagaattaaaattacaatatttatatttttagagttcatttttctctctcagtattaccttttttttttatatccttatataccatggaaataaaaccagtgaaataatgaaactagtgaaatataaatggtgtctcagcaaaatgaaaattgggatagtaattgaatagtgtgcataattcaatcaccgatttcttagcatctactctgtgcatgacagtatgctgaagggagtacaaacatgaagaagacactatcttggtagagaagggcaaacaacagtgagagccttggagctcagcatctaggagtcttcccaaataagtcaatgagccttagatgaggtgtaagatttggaagcaaagagaagtcaggagaggatgctaagcaggcagaaaattatatgtgaagggctgggcatagtagctcatgcctgtagtcccagcactttgggaggtctaggtgggcagatcgtttgagcccaggagtttaagaccaacctgggcaacatagctaaaccccatctctacaaaaatgaaaacaaaaattagccagatgtggtggcacatgcctgtaataccagctactcaggaggctgaggtgggagaattgcttgagcccagcaggtcaaggctgcagtgagccatgatcacaccattgcactccagcctgggtgacaatgtgagaccctattaaaaaaataaagaaaagaaaataaataagaaaagtgtatgtgaatgcatgcaggcacaaaaaacattacctgtttgcaaatacctttcttgctactagatgtcagctctttcctggcagaaatcctatctcaaatttatttttatctgtaaagtctaacttgtagtctcatacgaagcagggaactatgtatttataggttacatatacttgaggtagccttttggatgatgcctacgatacgtatcactaacaaatcaccccaaagctcagtgacctaaaacaaaacacattattttctcgctcttctgactctgggttgaccagtctccgtggggtggttcttctgatggtcttactgggcatcattcatgtagttgcagtcagatggccgtgagggctggagtctggttagctaggatactgagacgagggcctctcatcctcctctcagactcaagatgtctcttctccaggtaacctctccatatggcctttcagcagggtagccagacttctgacatggctatccagggatcccacacacaagcaaaaacaggcaaggagggagagtaggagctgccagtcctcagagaaggtagaactagaactggcacaattcacttcagctgcattctatgggtttacgtgagccagatctcagcctagaggaattgtggaaggtggtactgagagtgagactctcagggggtctggttcacaggctacttgttgcaactagctaacacagatagctatgacactgagtcccatcctactttattattggattaagttttatttttggacttattaacctgaacatgagtaaagattcaagtctagaactataacttagataattaccatgccatagggcacgatctttgatgtacagtttgagtggaccccttgtttagtgatacagggtcaaggctgcgtctcaaatacccacatctgaattgctttatttattataagcaatatcttcttttcttgttaaggatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgtaagtacatgtttggtgggaaacttataaacaattgggacatcagaatgatttcaactgccccttctacacaaatgatagatcaatatggtagattatattttgaatagaaagaggttcaatttattttaaaaatattaacctactggtactgttggaaagcatctaataactgtaaaatatgaaagagttcccttaatgtttaaccactgacttaatctttcattagaaattgaggatccctggtaagtccaaggtatgcatgtgatggaagttcttgttaattactcagaaattgtgcactaagtacaaatgggaagcttctcttgggagctgtaactctacagaaaattcgccttgattttattttatgactctgtgaattatatgtgtgatcaatttccattttccttgactgctaggatgttcttcgtcaaatatgtcaaatagggaatatatattttcttaatatttaagttcacttcctgttatggcctttaattttcctctttttttgtccttcttgatttattgtcttatattttatgtattctcataaattgcttttccttatttttcaaatcgaggtagaggagtttgtaaacaaacttaaaaaattagtagaactatttgaaagattctatttccttacataagtggactgccatgcatttgcatatatttgtttttagaaaaatttataatgatctgtcatctgcaagatcatttttaaattttaattttctctggattctttttgattgcaggatatttcatacacttgaaaaaacacaatttttcctggaacaagcatattattggaaagccttcaaaaagtttatcaggaagacttgcgaagtggcccaatatgtaaatatgcaagagagtttccagaacagactattgggtaagtcagtagcctaaactacaggaatgggggatgctttccccttttagtgaggtgacataatttcctgagagtccatcctatttaacaaagcggggcttaaaatgggtggctctccaagcacaatttggcattgtgattacttcatataattttttctcatcaattatgacaagacttaccagaagtcctggtttgactgagctacattgttcctgcaaaatttataatagtgactgcttttactctcaagactgtcctggtttgggtgataaatacttctatatgcagactagtcatgatcctactcacaagagtccagattttctgttgtggcccttctcactttacttagcattaagattgatgctcacactggggacaactccccatgaacctatagaagaaaacacaaactgtttttctctatacacacactcaacacttccaacactgctgtgaccatatgtgtggatttgttccacaacaagcaattctccacttctccattgacactaactgggtgtcctacaattcgattcaattctcgcactgtctgcctggaattagcatcagatcctgcaggttaagggctcagtcccacaagattgcccctacttcagacgccaaccccaagtccaggcttcccttctcacttctgatcaattgggtataaatcaggattcccatgaacccctcgttgtgttcagtaatttgctggtacaagtcacagaatgcagaaaaacagcttacttcctaggttactggtttattaagcagatataatttaggaacagtagatggaagaaatgcatagggtgaggtatgtgggggcatggagcttctatgccctctccaggcctatcaccctcccagcacctccatgtcctcatcaacctatgagcactctgaacactgtccttttgggtttttatggaagtttccttatgtaggcatgatatattaaatcactggacattagtgattgactcaacttccatccctctctcccctacctagaggttagaaggcaggtaagggaatgggaggagggagaacctgaaagttccaaccttctaattacagggttggttcccctgacaatcagcccccattctggggctatccagcgcctctagtcaccagtcattcattagcctacaaaaagacaccacttcctacattccaagggtcttagcagctatgtgcctgtcaggaaacaatggcctagaccaaatatatatgtatgtttttattatgttaatggctcacctctttccttatcagcttcataaaaccaaaaattccctaaaatataaatattacaaactcataactgtatgattcacagggagtcctcctgttccccagagatctactttttggaaagatgccagcatgtaaaacttgcacttctgacctctgcttttttactctagagctggttgtctatttccatctctccttgggaattatcttctgccctggttttccagcatgccatgacactgctccatcacagtggggttatcagcttctccttagaaagcctgcatcttggacgtcagggacttggacaggaaatgggagtttctcattccttttctgtggctattacgaccttgccttttcttatttcatgctgttttttaaactgctacttttagaggctgccagagatactccctctgtagctctcagtatcaaatccacatatggtaagatgggcctttgcattttctacagattacactataaaactcttctgtatagcagcagtattgggttgatggtaacttctccaatgagttggccatgttcttctgggttgagtactcatcctacactttaactttctcctatactacctgtcctcattatcacttattattgcccacttttgactcttttcagaaacaggctacagagagtgatatgcaatagtggcaacaggcttgtggttcagaagtctcaatgatactgataattgcaaatatttattgtgctttctatgattatcttgtttaatcctcattcaacctgtgagataggtaccattatgatttcattttcagatgagaaaattgaggctcagaaagattttattcctagcataggtctcaaaagtattaagcatcaaagtcaagaatgcaaatccaggaagtctcactctggatcctgtaagcttaaccactctactttctttggacagacccttgctgggggctgatctctgtgaaaaggcttgcactgtcacagaaatataactagtcttattaagaaacggaatttaaaaaaaatatttttactaaatatgtatattattttattaatttattttttatctttattattttctttcttctagtaaatttagtgtgattgttgttctttttcttgttcttgactttcagattttcttattttctaataggtacttttaagacaataaattttcctctatgccgagctctaggtatatttcacacattttaatatgtcattcaactgccttctggcatgtaagagaagtcagttggtaatcttataaaagctccattgtatgttatgagtcatttttcttttgctgcttttaagattctcactttgtctttgactttcaatagtttcattatgaggtggcttcgtatgggtctctttgggtttatgctacttgaagttttttaacttcttgcatttgtatatccatttagttttcaaatgtggggtgttttcagccgttaattctttaaatacactctctgcccctttctctttttctcgtcttctgcatgtgtacattggttggcttgatggtgtctcataagttccttgggctgtgttcatttttttttctttgctcctctgatttgattgtttcacatggcccatctttaagtttgtgggttctttcttttgcctgaatttctaaattcagttattctattttttagctccagaatttctgtcgggttctttgtaaatacagccatgcatcacttaataatgtggatgcgttctgagaaatgcattgttaggcaatttttccattgttcaaacatcatagagtatatttacacaaacctagatggtatagcttactacatacctggagtatacggttagcctattgttcctaggccacaaacatatacaggttattctactgaatactgtaggcaattgtaacatgatagtaagtatttgtgtatttaagcctatataacagaaaggtaaggtaaaaatatacgattataatcttacgggaccaagcatcattatgtggtatatgactgtaatctctctctctttgctaatattccactttgtttataaaccattttctagatttagttttgtgtttttcactgtgttttctttgagttcattggccatatttaaggtagttgttttaatttatttatcaagtaagtcagaggcctgcatttctttagcggacaatctctggagatttatctggttcctttgaatcattcatgttactctgttttattttggtatgtcttgatacgttctcttgagatttggacacttgaaaaaaatttccacttcccccagcttttgtagcatggctttgtgcaggggaagaccttcattgcccaaaatgttttaaaggctcagggtcttttaaatcttttctgaagatgtgtattccctaagcctaagtgtgtgtttttattccacttccctgcatacatactatctgctttaaaatgtattattcagtctcctggttcatctcaaaagccttggatgtttattgtattcctatgtccataattgattactcctagccgcctgcaggtctgcagactccctgcagctctaacatgccacagtgactgactgctgctttcagtggcctccaacctggcatccaaactatgccacttttctcatctgtgctctacatcaggcaagacagaaaccagtcacttcggcagcccctaggcaagccaaatattgccagcaagttctattttttcccttgtatactgagggaggaacttgaaattgatacacatcttcctgacagtggcatattgtgccatgaaggggatgaagagtgaatgagaaaaatgtcacaaaatttcacaatgagtgtgacattttcttgcattattagggatttacctggttgttgcatcttcttaactgatttctagtgcaatggtgcaatctcacctcactgcaacctttgcttccaggctcaagtgattctcctgactttgcctcccaagtagctgggactacaggtgaatgccacagcacctggctaatttgtatttcttgcacaagtggggtttcgccatgttgcccaggctggtcccaaactcctcagctcaagtgatccacctgcctcagcttcccagagtgctgggattacaggcatgagctacaacacctggaatgtttcttcatatttatccatcttgaggacttaagatgtgtggacttatatatttattgtctttgaacaattccatattactatttctttaaatatttcttttacctcaatttctttttttttcttattaggactgtacttacgtgtgtgtgtgtctgtgtgtgtgttcgtgtgtgtgtcccaaatgtttcttcttttttctatattgttcctcctgttttctttagtctctatgcctcagtctgggtggtttttctctgatttattttctagttaagaaattctttctgcagaatgtgtttaattaagcttactcctttaattcttaatttcagttatatgttctagaattttcattttattttataggttttactaaatattttctgcctgataacttcaataattttattttctgggtgtcagtatctattgtatgcttttcctatttttttccccaattcctattgtttttttatacaactttttttcttttaagaggtagagtctcactctattgcccagggtggaatgcagtggtacaaccatagctcactgtagcctcgaattatgaggctcaagtgatccttttgtctcagtctcccaagtagctatgacaacaggcttataccaccatttgcagctaatttttttattttatttttttgttaagatagggtcttgctatattgcccaggctaatcttgaactcctgggcttaagagattctcctgccttggacacccaaagcactctacataaatctttttattaaatgcatttcagacattatatgtagagataatgcgacactctgcatgatttttttttcctccagaggtgctttagttttgtttctggcaggcagtgagagtggaggcatatcgctttaattcagtcaggaattaaactatttttgagcatgctatgaaactttgtgagagctcaattgtttcttgtcttcttttactactggggtgtagccttctgggggtatcaagctaaatttgtggtgtttactaaaggcaatttttcctcagctgtctgtgaatttcagtttctttcctagtcttgtgaggcttttgaaagttcttattttcgtagcctctcttccctcatttttgttttggaaacaacagttgcccacagtggaaaagtagcttcaaatgttggacttcatctctcctgtcttccctattctgtaatgttggcacacaaattcccagtgcctcagtagctctctgatgccttaaaaatcattaaaaatattgttctcacttttctggatgtttgtagtggaagggttggactacaacaatctagtttgctacatacagaaatttttttccaatttagaattcaaagctgtcatgtcactaacctctgagtgagaaaggctgtgcctgtgactcagtagttcagccttgagaagctttctcagcatgagtagtgttgtggtaaagagcttgaatgctgacgtcagactaattagtttctaatcttggctttgcaacagattagccatgtgatttggtggcaaattgcttcagtttccttatctataaataagtttcataatattaaaggaattaatacttaagacagtatgtgatgatcccatcacccaggtagtgaacatagtatccaatagttagtttttcaacccttgcccacccctctttccctaatctttagctcccaatttctattgttgccacttttatatttatatgtacaccatatttagttcccacttataaatgggaacatgtggtatttgattttctgttcctgaattaattttctgagaatactggcccccagctacatccatgttactgcaaaggacatgatttcattcttttttatggctgtgtagtgtttcatgggagtatatgtaccaccttttctttatccaatcaactcttgatggacatctagctggattccatgactttgctattgtgaatagtactgtgatgaacatatgtgtgcatgtgtctttatggtacaatgatatacattcctttgggtatatacacaataatgggactgctgggtcaaatggtaattctgttttcagttctttaagaaattgccacactgttttccacgatgttgatctaatttactttccctctaacagtgtgtaagtgttcccgtttctccacaacctcaccagcatctgttactttttgactttttaatgatagccattctgactgcagtgagatggtatctcagtggttttgatttgtatttctctaatgcagtggagtattttttcatatacttattggccatgtgcatgtcttcttctaaaaagtgtctgttcatgtcttttgcctactttttaatggggttgttttttgcttgttggttttttaaattccttatagattctggatattagacctttgttggatgcatagtttgcaaatattttctcctgttctgtagggtgtctgtttactctcttgatagtttcttttgctgtgcagaagctctttagtttacttgggtcctatttgtcgattttttgttgttgttgcaataactctgatatcttcatcttgaaatcttttcctgttcccatgtgcagaatgatattgcctaggttatcttccaggatattgatagttttaggtttaacatttaaatctttaatccatcttgagttgatttttttatatgagatgagaaagggatccagcttcaatcttctgcacatggctagccagttattccagcaccttttattgattaaggaatcctatccctattgctagtttttgtcaactttgtcaaagatcgatggttttaggtgtgtggccttacttctgggctctgggctgtctattctgttccgttggtatatgtgttttattttttatttttattattttaccagtaccatgttgttttggtttctgtagccatgtagtatagtttggaggtgggtaatgtaatccctacagcattgctcttttgcttacgattgccttggctattcgggcacttttttgattccatatgaattttaaaatagttttttcaaattctgtaaagaatgtcatcggtagtttgttaagaataacattgaatctgtgaattgctttgggaaatcttaataatattgattcttcttatccatgaacatgggatgtttttccatttgtttgtatcacctgtgatttctttgagcagtgttttttaattctcattgaggagatctttcgccttcctggttagctgtattcctaggtattttattctttttgtggctattgtgaatgtgattctgttcttgatttggctttcatcttggatattgttggtttgtacattgattttctattctgaaactttgctgaagttgcttatcagatctaggggctctggggcagactatggggttttctaggtataggattgtatcatcttgcaaacaaggataaaactatccctgtttggagacttcctctcttcctgtttggctgccttttatttctttctcttgcctgattgctctggataggactttcagtattatggtgaataggagtggtgagagtggtcatccttgtcctgttacagttctaaagggaaattcttctagctctttcccacttagtatgattttggctgtgtgtttttcatcgatgggctgttattactttgaggtatgttccttcattgcctagtttgttaagggtttttaaaatgaagggatgttgaattttatcaatagccttttctgcatctattgagatgatcatgtggtttttgtttttagttctgtttatgtgataaatcacatttactgatttgtatatgttggaccaaactttcaaccctgggataaagcctacttgattgtagtggattagctttctgatgtgttgctgatttggtttgatagtatgttgttgaggatttttgcatctatgttcatcaagcatactggcctgaaatttttgttgttgttgttttgtgtctctgccagggtttggtatcaggatgatgctaggctcatagaatgagttagggaggggtccctcctctgcaattttttggattagtttcagtagggatggtatcagttcttctttatacatttggtagaattcacctgttgcttatttatttattttttttgagacaggatctcactctgttgcccaggctggagtgaagtgatgcagtcgaggctcactgcaccctcgacctcccagggtcaagcaaccctcctgcctcaacctccctagtatctggaactacaggcatgtgccgccatgcccagcttatttttaaattttttgtagagacagggtcctgctatgctgctcaggctggtcttgaactcctggactcaagtaatccttctgcctcggcctcccaaagtgctgggattacaggtgtgaaatactatgcctgacctttttggtagtcttttaaattactgattcaatttcagaactcatattgatcagttcagggatccagtttcttcctgttttgatcttggcaatttgtatgtttccaggaattcattcatttctttcagtttatgtagtttgtctgcatagaggtgtttgtaatagtctttgaggcttttaaaaaaaaattctttggggtcagttgtaatgtcccctttttcatttctgattgtttattgagaccttgtccctttttttctttattagcctagctaacagtctatcaatcttatttattctttcaagaaaccaagctctgcatcattgatcttttgtatgtttttttgtgtgtgtgtcttcattttccttagtttagctctgaatttggttatttcttgttttctgctagcttgcttgcagaaaccatgtgcagaaggggttggtttgctcttgtttgtctagttcctgtaggtgtgatgttaggttatgaattttatatctttctaaatttttgatgcgggtgtttagtgctataaacttccctcttcacactgctttagctatgtcccagagattctttgttgtatctttgttctcattagttttctaagaattttatatttctgccttaattttattgtacctataagtcatgcagaagcagtttgtttaattaccatgtaattgtgtagttttgagcaattttcttggcattagttcctatttttattgtgctgtggtctgatagtgtgtttggtgtgacttttttttttttaatttgctgaggattgtttttatggccaataatgtggttgattttagagtatgtgccatgtgcacgtgagaagaatgtgttttctgttattttgtggtagaggattctgtagaagtctgttaggcccattttgtcaagtgtcaagttcaagtcccaaatatttttgttagttttctgtcttgatctaatattgtcagtggggtgttgaattctccttctattattgtgtggttgtgtaagtttcattgtaggtctctacgaactcattttatgagtctggatgctcctgtgttggatgcatatatatgtaggatagctaggtcttcttgttggattgaacctttaccattatgtaatgcccttctttgtcttttaaattattgttggtttaaagtttgttttgtctaaagcaaactatagcaagccctgctttttttctgctttccatttgcttggtagatttttcttcattccttttctttcagcttatgggtgtcatcgcatgtgagatgggtctcttgaagacacatatggcgtcttacttctttatccaacttccactttgtgtcttttaattggagcatgcatagttttagcctgtttacattcaaggttaatattaacatgtacagatatgattctgatatcatgttgttagttggttactatgcagacttgattgtgtggtttctttgtaatgttaatgatctatatacttaagtgttttttttttgtggcgcccagtaactgtctttcatttccatatttagcactcccttaagtatttcttttgaggcaggtcttgtggtattgaattcccttagcatttgcttgtcccaaaaggatcttatttctcctttgtgcgtgaaagctctgttgttatttccttagcttggtctgttctgctgtgaatacttgcaattgtattatgaaattcttatagtgtgtttttcagctctgtgagtgagatcagttctattctttcttgtaatgaccatttcatttttcagctcctgtatcattgccttatattccttagatttcttggattcagtttcaactttctcctatatctgaatgatctttgttcttatctgtatttctgaagtgtgtcatttcagccatttcagcctggttaagaacatttgctggggaactagagcagtcatgtggaggaaagaagacaatctgactttttgagttgtcagagtttttgttatggttctttctcatctgtgtcagctgatgtttctttaactgtgttgtaatttgaatacagtcagttgactccttttctggatatttttagaggaaagaggctttgtgcagggtctttatttgtagttgatgatagttctgttttaaattctttgagaaatctccaaactgttttaaactgtggctaaactaatttacgttcctccagcagtgtatacctttaccattttaccaatgtagttttatcacatttttgttaattcaatgcgcaggtttagagtgctatgtctatgttaatagtgttcatttcttaattttgtggggaatcaggatcacatattctttcttgcacactgttctatttttcttgagttaataattgtctcatgattttcgtttgacagttttctatgaattaatcaccaatttaacccatacttgtcaaacctgtacaatattaatatggtaaaaacgttagatggtctataaatgtataaatgtcttcttctatttttcctgttgacttaatgctctatggtcttcatgctccatttgtagttttgtggtcccctagagccaggggtcactctctggtgattcttttacttatatccctgaagagtccctactctgcttttctgtgttggaacttgtttcctggattctatgttttatctttcttggtttatactcttgttttagagaagcatatcttccagcaactttttcagggaacactttgtaggtaagtgatttttagagcttgtatgtcttaaaatgtcttttttttttactctcaaatttgattggtaatttagttgggcataaaaacataaatttgaaattagtttgcctcatgtaccatggtatattcaatccagcatgccaatatattgactctctctgtctgaaatttttaggctgagctgatagcttttagctgtgagcaaccctgtctatttactccagtatgtctgaaaagtatttttatttatttatctcctgtcttcaaaaagtttgggaagaactttatttagtttatagtgttcttgttgataaactccttagataaaatttctaatttttcaatgtagcttccccgccgcttttccttctcactgataaactttacgtttcttttttagtccaaatattctgagattgtatgaagacttaagttagtgtgatacttaaaaataaacattttggaaaatgtttttggattacttctttggtaatttcaaaccctgccttgtttttttctttctagaactcctgttagccatcagttgaaccccctgtatgaattcctaactttataatcttttaggatattttttcttctactttctgggatattttctccatttgatttaaaatacttctttaaagattttttaaatcatatttttaatttttgagaactttttcttattctaaatatgttcattaaaatagtttttttgttcttgttgcatcttcttttatcacattgagacagtcctttattttaaagtttatataagcattttcgattcctactggtttttatttttttcttttgtgtgatctgtcttttatgtgtaaactttccccagtttgtaatgattctaggctgttcattcatatttaaaaatgaggcactagaatggtgatggaaagtgccatgtcaaagggggtggcttgtaaagtgggagacatcactctaggataatcgggcagtaagccaatctcccataagatgattctcagttattggcatagttgcacatcttttcttttaggtggttcaatttctccaaagcttacacaatagaattcttgaaatacctgctaacaacacacagatggaaaggaatagacctgactgccagcattatggaaacaaacaaaaaatgaggtgatgaaaatatcattgttcaaaaataacaggttaaattaatccccactatttccagtaatgttgttacatccataccatcagctgtgtctattactggaagctctgtatcagtctggttttatttcttcagactagtcaatctctagctttctactgacataggagaggagtggatgcctggctggggtgatggagagagtgtgttagaattcattcttgctcaaaattttatctaaacccatctgcatatttttagttcaacctctcatgcttatagtcagatgcttatacctctaagtcatgagactttgggggattctgtgaaggaaattaactttaccctcttttgatttctttttcttgaagtttaagcttaaacttttccttctctgctatgccatataccccttgtctatttgctttcttccttctaactctttctcatctgccgttgtttccttttccattcattttatctatgtggttgtatatttttatattatctactctcatttcagtggtgttttggctctacttttcactggatattccacagcttgatagggaagtcctaagaaagtccaagctggtgggaattatacacacatttagaggtgtatgtcagcatagaggtctggtgtacagagcagataacaatttgagttgtttgaaccagaacttgtggaatgagtggaatttgacagctagcaactgaaagaagagtgttcaaatacttgcttgatatagtctcctcacagacatcagacacacaaatctttccatgttgaactttgaaatattatagctttgagtaaatgaatgtatcataaaaatttttcatcatgatacacagacatgggtaaggtgagatgaataataactgaagtaaattaatagactgtgtgttctcttttgcttgtgttgcatgtattgtgcacacctgatttgcttacatctttgctactcaaagtgtgatccctggaccacagtatcaacatcatctggatcttgttagatatgtagaattgtggccccatctcagacctactgaatcagagtatgcattttaagaagacgcctagatgacttgtaagcacaggaaagtttgagaagcactggctgttgttatgcattcatcattaggttatacattctttatttcctccttttcctattagaacaaaacaaaacaactacacatgataagtatgtggtataatagagacatcatttattctagtcaatacattatctgtggttacttaaattcatggagtgcagttttatgatgcagataaagcatgaactgtttggtgttttggcatgggttttggaagcagatggacttggtagcaaacattgcatttgacacagattcttaattacttttacccttggtaaaataaaaatttacatagttttctttactgagttcttatgaagattaaataaaatgatgtttctaaaatgcttagcacagtatcgtaggcacatgcaattaatattagtacccttttcttcctcaccgaaatgagtgtcaaaattttaaggcattacaactaatggccagggaatttgatatggaagattttatttacctattttgtttaaaaaattatttgatactgttgagctttttaaattttttaatttttatggatacatagtaggcatgtatatttatgagtaacatgagatattttcatacaggcatgcaatgtgtagtaatcacatccatgttgacatatacatatatccataaaactgtaatcacaattaagacagtgaaagtcttcatcactcccaaaagcttcttctctattgtcaattccggcttcctgccctgtcaccaggctaccattgctctgctttctgtcactgtatttgagttttcattttgtagagatttttataaatggacatatgcagtatgtacttttttgtctaacttattttacttagcataattaattagcattaattagtgtgagattcattcatgttgtagtgtgttcagtccttttatcactgagtactattccatcatatggatgtatcacagtttgtcaatccattcacacaattcacaatttggttgctgactctttctggctttacaagtaaagctgctgtgaacattcacggacaagtcttgtttggaaatatactttcttttccttaaaattgaaatgttttgattatgtgggagttgtatgcttagccttttacaaaattcacaaactgttttttaaagtcattgtacccttttacactcccattggcagtgcatgagagttaaaatacctccacttccttaccaacacttggtatgatcagtcttttaaattttagtcattccaatagatgtgtagttgtatgctattatggatttaattcgtttatatgagtaataattttgaacacctatcttttcatggacttctatgtcatctgtatttttgttcataaattgtatattcaaatctttcccactttttaaattgggttatttgtttattatttagtttataattttcctgtatatacaggatacaaactctttatcagacatacgctttgcaaatatttcctcctggcctctggactgtcttttcattcttcttaacaaagtaatccaggagaaacattttaattttgatgatattttgtttattttttttgtttgttttcttaatagatcctgcttttggtgttgtagctaagaaacctttgctaactcacagggttgcaaagatttttgcctatatattttttctatgagtttaatagatttatgtcctaaatttaggtctataattcattttgtgttaatttttgtatgtggtgtaggcatatactgaagtttattatgattacttttgcataaggggacctaattactccagcaaaattttttatgaaggctattctttttccattgacttacatttgtatttttgtcaaaaagtagttgtataaataagtgggtcttcttctgaactctgtattttatcccagtgttctatttgtccatctttataccaaaattaactatcttggttatcatagctttacagtaaaacttaaatttaggtagtgttagacctttaattttgttcttttttttaaaaaaaatgtttttaactattctaggtcatttgcctttccatatgaattttagaatctgcttgtcagtttctcaaaattatgctggaattttaaccaggattgaattgagtctatagatgaattaagggagaattaactttttaattattttcaatgttctagctcatggtatatctctccatttattttgtcttctttgtttttccttaacaaatcctgttgtgttcattctaaaagtctttcacgtcttttttcagatttatccctaagattttaatactttaaatgcttttgtaaattgattcttaaaaattttgatcttcaataatttgttgctcatacaaatatatataaatatacatttaatttttgtaaattcatcttgtatcatgcaaacatgctaaatttactttttagtatttttatagatttcatcagattgtctataaatcatgttatctgtgaataaagatggtttaattgtttttgtatgtcttttatttattttattcattcttattacactggctataacttctagtataatatggaatagaaatgatggaaggtaacatctttgtcttttccttgatcctggaagaggcgcatttaatctttggcaattgagtgtaatgttagctataggttttcatagatactttttattaggttagagaaattttcttttattcctactttggcaagagcttttaatcaggaatagatgtcagatttgtcaaatgtttttctgcatctattgagatgatttttctttttaatttttttgaatttagtttttgtaaaaattctagtcatatagtaaattgcattgcttattttaaatgttaaattaaccttgcataactgagataaactccacttgatcaaaatatattacctttttatctattattggatttaatttgttaaaattttgtttaacattttgcatcagtttttatgaggggcagtggtctttagtagtctttttaaaatttgtctttgtcttatatttataggtaatcataacctcatagaattattcagaagtattctcttattttcaattttctggaagagtttgtgttggatgggtattatttctcacttaaatgtttggtagatttcactaatgaagccatctaggcttttagggttttttattagaagatatttaattacaaattcaatttttaatatacattagggccactcaagttgttcaatttagtatcataaggattttttttaaactgtattctattattaacttcttaatttgtatagaatcagtggtaatagcacctttctcatagttgatattcataacttgtgccattttttcttgatcactctgcctagaggcttatcaatcttattattgatcttctcaaacaaccagcctttgatttcattcatttttctctaatgtttttatttttacttccttgatttccactcttctttctttattctacttagttttggtttaactgactcttctaattgctttgcatgggagatgaggtcatcaatttgataccattttgttttctaatgtaggtgtttaatggtatacattttcccctaaatgctgattttagaggcatcccacaaatactggcatgttgtactttcattttcattcagttcaaagtactttctatgtttccttttgattccttttttcatctatgagttatttagaagtgttatttttcaaatatttgggattttcaagaaatatttctgttattgatttccaatttaatttcattttaaccagtgaacattctttgtaggactttaatcctgttaagtttattgggacttgctttatggtctggaatatgatctaccttggtaaatgctccatatgcactggagaagaatatgtattatgttgttgttgggtggcatttttttataaacagcaattacatcaagttgtttgatagtattgtacaaatcttctgtatccttactgatattatgtcttgagcagcattgaaatctcttgactataattgtacatttttctatttcttcttagatttgtattcatttttgtttcatgtgttgtgaagctctgttgtaatgttcacaaacatttagaattgttatatgttcttgattgatacttttatcatcatgaaatgataattatgttatcatctgaaacctactttgtctgatagctttcttttgattagtgttagagtggtatgccttttccatccttttacttgtaacttatgtccttatatttcaagtgcatttcttacaagtagcatacaattggatcttgttttatccaatcttacaaattttgcctttttttgagcatgtaaattatatattaggttggtgcaaaagtaattgcttttaaataaatttatcatacctttaaaagcaaaaaccacagttacttttgcatcaacctaatagtataaagtaaataacataaaccattttatgtgattaatgttcccttctgctagttctatcattcaaactgctgtcatttttgattgattaatttttctcttctttatgggtcatatttttctgcttctttacatgcctgctaattttttattgaattccaaatattacacattttaaccttgttttgtgctaattatttttgcatgcctataaataatcttgaaacaaattgcttgaaataatttgattctttaggatctcgtttttaagatttgttaggcaggactggcaaagtgctcagtttgatgataaatacttcccactcctgaagcaagaccccttttttgtactttactcaatgactaatgaattatgaatatttcagtctggctgatggaaacaaagtgtattgctggtcctgagcaccagaaacggttatctttaatcctttaaaaaaattatttatttatttatttattttgagacagtctcgctctgtcacccaggcaggagtgcagtggcgtgatcttggctcactgcaatctccccctcccgggttcaaacaattctcctgcctcagcctcccaagtagctaggatcacaggcgcccaccaccacacccggctaatttttttgtatttttagtagagatggggtttcaccatgttggccaggctagtctcaaactcctgacctcaggtgatccatctgcctcggcctcccaaagtgctgggattacaggcgtgagccaccacacccggacacctttaactcttttgggtgttttcttccatggtctcaggtagtttcctcaaatgcctgtgttgattattactcatctgaatactcaagcgaagcacactgacaatttccttgccttgtgcagccttctctggcactctgtcctgtggtttctagctgtctttcagagtctaagctttttcccaactcagcacgtccactggactctggtgcagtctctccttcctgtgccatggcctggactcccttaaagcagcaagctgggataatcataggtctcgctctgttgtttactgcctttcatggatcagtatattacattgctcgatggccagtgactggtacctcatcttgtctggaagcacaagtcaaattagaagattcctactcatctttttttttttttttttttttttaacattttcaaccatattaggtgaactactctagcatttttcactttattagatttgtctgttataaccagtttataattaatgtagaaaatgtctttttatttagcttttcctgaggaatctccttgttttgaagaaaacatggattggaaaatgatcagtgataattattttcaatttttgaataacttactcaagtctccaacagcttccatatccaggtaagttatcagaatccaacttctaggtcttgatttaattatcatctgaagataatcaaaacctaattataggatatgcactctttaaaatttatgagcctgatttagatattgacacaatctttcatatgagctgttcaataaatattcctttaatagagtgtgtgactcaagtatcaagttgtttaatagaatgtatgactcaatggattttgaaaggaaatacagatcgtagtaagaagattttccttcaataataacatgatttataatagatgctccaaaaataaggtatttgttttgaaaaattgtcttagctagttacctagagtttaagcaggaaatcaattctatagattctgttagtttcaaagactcctgggagagagaagtggtctttggaactaaatttgtcggactattttctgctgtcctatttcagcacgtgtattgaaatgcagatttttatgtctggttatgaatagtgtgtccagtttaaaggtatactcggttatttgtggggtgtattggaacatgatgggagagatgttttgcataagagcagtaacgctcaaacttgagaatggattaaatctgtgaagactgctaaaaataaaaatgtctgcaccttgccccagtcatatgaaatcttgctctgtgtacaggacccaggtttctatatatttcacacattctataggtggttccagtgcacaccaaagttggagaaccattctgctatatctgtctagaatggggattagtcattcctatggaacttcttaagcccagctattagtaggaacagaagaaaggacaatgggatggatcctctagagaatcaattccttgcttaggtcagatttttaattcctctttcctgaaagcctcaaaaatttaatagccctagaaaaccagcacaaaactagtctatatgtgcacaaggacacatttaattttatatttgtggacccatagcagttggcacagtgtctttcatcatggatagtggtagataattagatgttgatttaatgaatgaaaaatcattgaacattaagtgcaatttatattaagaaagctgaacttgaaatgacaaaacctgggtcgtctcctagtcatgccacataataacagcttgaacctgtcaattaaaaaaataaaaagtttcttttttcatgaaagggaaataatgacgtgtacttcaaaaggctgttgtaggaatgaactaagatagtagttgtgaaagtgctttataaactaaattactaaagtaatataaaaacgtggcaataatactattagtagtactacttctacttcaatttattattctattgctactccataaccctctcagttcccaatacaaataagttttatattctcctctatcaaggcacaatgacttggatggtagttaggcatctattcttagggagggctggatttaggcaaggtttatgttgaattcctaatagaactttcccttttctgatgggattttttccctaggaattatttcaaagaagccattctgtcctaaaaataacaactaactaaattaagaccatatttttgtgtggggtgctcaggtctcagctatcagggaagtaaacagcattcttgcctttgataggtcttatgtctgtcctatgtcagacagtgtgttatacaacaagagcagagggttaaaaaacttaggaagtaatttaccctgtaaggcataaatagccaataaaggtcaaaaattccttacccacaattctgaactcttacaaagtctgaaaatagaggcttttcttatggttgacatcacaactcattcagcaaagatttatcatgaactgatgtgaagcagtttcaagtgtattatcctgcgtcgcgagatcattcacaggtctcactgcgaaagtgttaatacggtgatgatcagggctgtcccagccctcactgagatgcatgaatacatatctgatacctgtatcatgctacatttctaaaggatgaacatcctgaattctgaaacacatgtaaccccaagaatgtcaaaagtggacttgtaagttctgagttagtagaagttagttctgcaagtgtggatttctgttacaagaggggacttacagtgtctgagttgctcttctgagaactctgtattttaaaattaaacacctggcgataagctaccccatatataataatgagtttctgacagtaggatgtatatagtattgttgaaagagcactggaatttgccttccaggactgggagtgcccacaccttgctgaaaccctacaggcatggtttctaatgcactccactatctgtgctacctttacatgccaagacattttgaaatggaattaaatcctaagattcttctggcataaatagcaaacttatctttaataatcatacatattattgttaaatatgccaggggaaaataattgagaatgctttctttttggtggtaggaaacattttaagctaaatatatataacttcattgtgcatttctaaaacactttcaaatcctcacattagtttaatttctgttggaaatcatgttgtctattaaatgtttcatttgtgttttactatcaataaatgagtattaacttggaaatttgataaatcaaatttatttttttattttatactaaaataattctattaatattacagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgaggtgagtatacttttgctttgtgtcatatatgcagttgcgatatatctcaaactactttattttctggagtatagacatgtcaaaaacagtatttgtatctaatacctttgaaagatctttgatgtaaatttgtcttaataaatattttatcaaaatgtcaaggtaaaagaattttgattactgtcatctagtaaaatataaacccagcccagggtaattaatcacgtattattcttacatttttagattatgaaaacaattatgaattctattttatatggatctgaaaaattagttttcatagctgtacatgcatatacaggattgacataatttgaattgctatactaactgtctaatcaccaactaggggcttaagtattctcaacccaatgaatctactgtggtatttgcatttagagacataaaaattgataatcacattatcttcttttcatatatctttaaaaatctcgtttgaagtttgccagtgaaaaggctggagggaaattccaatttattccatgatgtctgctttagtcaagtttcaagcagagtaacaaaaatcatcaaaggatttaatccaaggaaatcagcttacacaattttgggggctggctgagtaagtctgcaatcagtagggctgactgtcaggaagggaggcccacagtaggcaggggcgcccacagcaggcaggggcgctgcgggcatgagtgaaagctccttgtccacagtggtcaggaaggaagaccaggggaagggagagccactgactatgaatacccagcagtggttttgtgcctctaagttacagaggttctatgccctctttcagagttttcctggcccactcaggacagtatcccttctgactaatttaaagttaactgatcagggattttaactccatctgcaaaatctctttatagcaacacctaggttagtgttcgattgaatagctgggagaagatgtacttatattacaaaatggctataactcccatctatcctagaactctcatgagagaatctcccctgtagcccacccagatgagaaacatacaagaaaggggcttcttcagctattgtttagcctagtcatgttgatacatctgtctgagcaatttgctagtacttctaaagctcagaaaaatataaatatgctaaccacttttcagacacttatctcttacatcaagaatcacattgtagtcattttactttctttcctaagtaaaagcccttttaacctttttcataagcaaaagtttgtggctttttaagttgctaggtttaaagaactgtaacagaatttgttcatgaaattcctcactcttttcattatttggcaacaaaatattgagtttcatctgaaattattttagcatgtcatcttttgctcagtattatcttcccatgatgctattataaaacaaataaaataatataaatcactatgtatcttaatatttccactgttaatgtattaaaaattaaattaaaagtatatatatatatatatttacagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaaggtaattaaaaagctgaattcactttgtttttttctctaccgcagtagctataaaatagaaccatgcaggaattacagtgaatcggggtaagtagttcttcttgacttcaactttgtttacactctgaagttggcttcaacatagagcaattcaggtccagtcattctttttcataattcgactcattatttggcattcaaatataattgcagtttattcaaaatatttcaaaagtaagttattttattctcagaagcaaaaacctcttattctattcactcatcccaagactagttgcataaacaatttttctgttcatatcctctggcagccaagggtcctatgactcagtatacacacaagaacatgaagctgcttgcttcacagaaaattatgctttcagttgtagctaaccacaggaaagggccaggcagctgctggcttctgcccttttttgattctgccagacttcacgtggttgatccacctccaagccctcctatcgctgaaagttatgtccatagaaacctgttcttaaaagctccagtcttgctagttgtcatgccttggaagcagtctgttgccttaggttggagaccctgtgcctcttgatgtgcagaggcccagagatgctgcagctgtccctacctgtcctttctgtgggtgaaaatactgttagggtggtccctggtctctgtttctccctgctttcctctctggcccacatggagattggagatgccatgtcaaccctggttcatttgccaggcaggctgacttattttctgttggttctattactccagagatgtaccttgaatccagtcatgttctatgagttggaaagatgtctttagttggtgaaacaggtagccactggcacaaataactattgctacctaggaatttgactgctagttttcagagcttccttcttcatctcctccttgcttctgatgtcaaactatattttgtttgactttagtgctcttctctgaattgtcttttgagctgaggtggtcctggcaaccccattctccaccaatctcaggttttatctcaaatttttcagttctccacagagggagtttataccttagctcttcataccatcatgttttgacaccttttcaacatttacctttgcatttcaaaagaatagaacaaaagaagaaagaaaagcaagtattaagcttattggccacaaaattgatgctttgaaataattctggagacctaaagttttctaaaggtccagaatgtgttatctgtgttttcttatgttcctatgaagaaaatatgattatgcagggagggaggatggttcttacatgtgtgttataacttaacctacacagtagagatgcacatgggttgcacatttttacccttttatgtcattgtatatatttttttgctaagtgttgttgagatttgtgaagttttccagcagactgtgaagccctcagaagccatggagatgctgcagaaagtgaagatgatggtcgtacgtgtgctcaccatcgttgcaggtgggctgctcatataacaagtgctctgcaattgccctgtgccagttttcagaactcaggtgtcagagagatgagtatattgcacttgagtttcttttagaacaaagcacagctgtcttagtctggcaaccaggccttgagggatctgcccctcccaacctcattcccaccactgggcctctactccagccaaattgaacggcccgttcctgcgcctttgctgggttttctggtctctgtctttgctcatggaatgtgcttcccttgtcttcttgacctaaactacagccgtactctgtggcctagagctgggggtgtcttgtccagaagtgttcccccatctcctttactggcaaagaccttgaggagactttgatcacgtgcagtatcgtactttcttctttcttacatttcctccctctgctacagtcaatattttttgaagatagaaactgtgtcataaccttctgtgtgcatttcctgatgggtgctgagtagtccctgcagtaacctgaattccctacagccgtggcacttattgctggtattatagtttttggtgtcttcttttcctgctgcagtctgtaagcttactgggaacaggatcagtctcttgctaaattctgtgtctccataatactcagcatagtgtccagcaatagtgactatattgtaaatgaattaattcatctgctaagatgatacttgccaaatccattcctgcacatttcagtgcaatctcctttcaatgccactgctgaaggagagtcccacgagctgctttagagggtaactagatgatcttagggcttttctgaaaatgtgaacattagactttagagcacacttgagtccatggaatggaccacagttgtttaagtaattcacaggtgcacagaggtgctgccatcctctggcccagtctcctgagcagggctgcccagagccccctcagtgggctactgggcctgagtaccctgtcttagctgatggcagtgggttttgacaacatgaatcgaagcccagaagaggaggggaggcgaggagaaatggggaagccaagggtggatccgatcagatcaagagggaaagaaaaaagtgaggggtcatctgagtagggcttactccatatcctggccccggactccctgccccctagctcatctgatccacatgttcattcttctgcctttccttgatttactcctggatcattattattatttcgattactatcaggttgttatattatgatttgtagattacgtgttatttcctctggaaagcttttcttcacctaccctgtctggggtcacatggccttagctccttgttatggctcttaccaccgtgtgctattctgatgatgaacatgtgtctcttctacagttgtgagaacccagagactgtgcctgtctattgatcactacaaacctggcacatggggattagaacatgggaaatgttgattgacatttgttgaatgaatgaataagtgccagaagctcttctatacttacgtcatgtttcactggaattaccaaatgtgaaatctgttcatgggggagtgctcagcagcgagaagtagtgggtgggctgttggcatgttctgggcctattttgtacgactgagcaaactgtgggggcctggggaggatgttgtagagaggagtctggtttacccaggaaggggcacagtggacgtattcccaacatccactatcagaagaggaagggttaccggccccaggatggctaattggtgggtgtgggccactgagtctgtgagccaggagtatggaccagcatctactggggagcggtatggaggagaaatgagccttgggcagaaccagcatgtcaaatccatttttcaaaacaaaaaagataaatttttctttgtattgataagtgctagaaagaagctaaagtatggccatgagggtgagagtgaggggtggaggagaggagaagaccttgagggtgcagttcagggtgaggacatttcaggtgagacttgcgtagtgaggatgtgtgtctgccatgctcatggttatatcttcccagggtttaggaaacatactgacataggcatgataggcattcaatcaatatgtgtagaaggattggataggtcaatgcatgagggctggcactaggttgggcacttgtgactgcttgagttaatctacacaatcactgatgggcttcagactagtgtgctgggactcgtggtctgtaaggctgcctccttactgtcacgatggggcactcaggattatacaccttcatgactggtaaggctttattgccccaaatatctttgagggcagagtcaaacatgactgttaaaacaagtgatgtcgtgagaagtgctgtaatggaagaagcaggcgctttgagattgaacaggctgagttccttgattcatgctgagtgacacagggtagcttctgaatctctgtgagccttgaagaaaacataggggaacacctatttcaacctatgtgagaggattaaataaaatgagtcacctccaaggggcttatcctaaggagatgccttgaacatgctagttgccctgtcctgcaagttgaagatgcatctccctgcatgccattgggaaaactacttctcagcttagagggctagttcataagtaaaaactggtaatttagggactgtctatcacagggttagttctaatctgctcactcatccctttttttgtaatacaaatggttgtttgaacagaagaattgattggtcattgggtctaagaaacatggaaaaggagtaagaaacagagggagaagtgggacaagcttgatttaaaaatgaaaccccaactgctgtgtaggggttttgcatgtttttttttcttttaagataatctgtatttccaattagatgttatgaacattggtgattaggaatattgctttctgttgtcaaatagaaatcagtaaagtgttacaatctaagtacaagttaggatggttggtacatgatttcagcatttggaagtgtgctcaggtaaaattcaaatcaaacttcttcctcgttcttgaatgcttatcttccatattgaattcagccacgtttgaagacacaattatctggacatttcacagtcagctaatataatggtttttaaatgaattaaacattcattaatgtatgaatttatatttattttgccattctgtattgcagctgctaaattaatatagcatacttgagattacattagtaacagataattaatttttaatttttatattttatttcaaggaaactcaagcataactaacatttaaactgccaccccactgtccttattgaattgttactccatcctgtagaataggagggcagtgacagatcccataaagttaaagggatggggtggaattgaccaatgtgggcaaatagcccctcctctcccatcatataaagggaacaagaataagatctgttattattattgttgctgaaaatgcactatattttcgtcatatcacagagttgagttcagtatctccaggaggaaagtgacaactttccttctcctgatctagtgctttaaagatgccaaggacaatgcaggagagctcatgcaacggaaggagcctcagtgggcagctactttaatcttccagtttccctaattgacgaattgaggcccagagagtgagagtgagtttcccagggtttcagagtgaagcagtcagagcccatttccagttgaagagacctgagagggtccatggggctgaagggaggagaggaaaggggtccagagagcgctggcagatctggaaagccagagtgggtctgaatgtgtccttggagccaagaagaggggccacagcaagtaggaagggctggagccagggattgggagaggcaatgagaggtggagaaagagggtacccgggaaagttggaggagtcaaggctcaaaaccagctcttgttagtgtcgagacagttgtcaagtgtccttgagggtggtgcctttgagggcaggcttcaagacgtgttagatgtgaggcacatggaggccagatggcctgacagcccagcactgcatcccatgatcatatcatccctgacctaaccttgcaggaatgctgggcttggtcactgtcgactccacgttgtcattttacattgaggaagcaaggggctgacacagcccacagcttgcctgatgccatacattacatcagctttttcagggtgcattctctgctcttttaggtttgaacaacataacttataaacacattattgtgtcttcccgagaccagaggatatgtttatgcttaaagataagtgctgtgatatataacagcacattattaccttcatttcaaattttaataagagattacttaagtgacacattttatatttcctacaataaagatacctgtctttgaaattagtaaaataagattaatgagaaaagaaaaacaaataaggcatcaaggtgggttgcttctggaaagcatgactttggatatattgtgtctactctgcattttatgtggttgaaaactgttttagtaattaataaattttatattttagagtagttttagattcgcagcaaccttgaatggaaggtgcagggatttcccatatactcccttccccaccatagcctccctcattatcagagtggcacatttgttacaattgatgaacccacactgacacagcatcattccgagtccacagttcacattgggcttcactcttggtgttgtcattctatgggttaggacaagcatataatgacatacatccagtgttacagtatcacacacagggttttactgcctgaaaaatcctctgtgctctgcccattcatctctcccacccctctagcccctagcaaccacggatctttttactgtctccatagtttttgtcttttccagcacgtcattgagttgaaatcatacaatatgtagccttttcagatgggcttctttcacttagtaatatgctggaactgttttttcccttccttccttccttccttccttccttccttttttcagacagagtctcgctctgtcgcccaggctggagtgcagtggtgcgacctcagctcattgcaacctctacctcctgggttcaagcaattctcatgcctcagcctcctgagtagctgggattacaggtgcccgccaccatgcccggttaatttttgtatttttagtagagacggggttttaccacattggccaggatggtctcgatctcctgacctcgtgatctgcccaacacggcctcccaaagtgctgggattacaggcgtgagccaccgtgcctggctcagaactttttataaaggacttttgagaaacaatttattattcataatttaagagtcaggataacatttttttttctaattaaaaaaagattttatttcttataaaaatgtattttattttctgtcatgaccaagcatctaggaggtacaaagccctgtgctaggtgccacaatgacaggaaggcagtgataagaaaatttgcccgtggcaggtcttgtgcagatggatttatcgtgcggtgggaggtgagcacacaggcatctgcgcagcagggaggggaggggctttgctcagcctgggaaaggtgggtgtctggaggcagaactctaaaagatacgtaggttcaggaagggagagtgatgccttgtatctgatggccttgaggagacaggagggacatagggcatgactgcagagaggtggaggcacctgaggctgcggaaagacattggatgcaacatggagcctttgcacagattcctgtaatgggggatctcctttggggaagagccttgtggatcagagcgtaaggcagattggaagggtgaggtgggagtgggactgttaagagcacagcagtttcctgggcgtgatctatgggtgctggacagacgcacagatggagagacattgggaggtcatgctgagcagatggggaggttggttggctgtgaggaccagggggaggagagtcatgactggcttccaggaagtgacttgtgaggcatggggcatggagaagaccacacatagacagtgtgtaattcatccttcaaactggggcacttttgagaatgacagagggcactgttcataaccatgcaagaataggtgaaaagcaagtctgtcctgggcaaactggggtgaatgggtaccccacttgtaggggatacagggaaaggagccagtttgaggaggtagagataattaatatttacaaaatcaattaggcccagaaaagcaaaatctttattttattacatttggaactcaaaaggcacagctttaccctcatcatctgaatgttcatcttgatgatttaagaaatgtttaggaatttgtatcactttgaatctttaaaaagtgattttgtgagagtggctagttcaggagaggactgtctattaattatttctctgtgtgtttcctctggcagaaaacccttcctggaccaaggacattttgtgtgctactctgagttgcaagcaaaatgggataaggcatctcattttatctgctatacaaggggtcactttggcgcaggaccacttccaggtttgtcgtctttaatatttcagagaatttcatgttcatgactattggcccttgcaaggcagtccagttattcaaacttgctgcttcgttcttataactacagcaatggtgtcatacacagtcttgttgcaagctgggcttgcagaatgactgctcacccttcctccctcttggcctctcccagtggtgtgctgggttgagtggcactgagttgagagatcggattgttaaattttcaggaattttgcaagctggttgttaaacatagatgtcatcattataaataaattatataaacttatgatgaaataaatcatgttagaaacacaagtaataattactcaagattcatcacttcctaattattttagtatgttttactgttatctctcttcctgagatgatttgcttttgttgtatccacatgatggaaatactatgtagtcttgtgctaagtgcagttcttcccttctctacgtttaatgacgttatggtggcagcatgaactgggccatgcaggagcttttgcaccatggaaattggcaagtgctccaaatcagaattttttttttctggagagttagtttttaaatatttaccagcccaacactggctctaactcattgaatacactggctagtaccaaaaattgatggctgaatgggaaccagcatagcaatttcctttttattaaattggacacatgcccaataggctcccatgcagggtctccaactatagctgaatcagacaatgtgtctcttatttgggccccactcctttgtcctagaattaaagacccctgggcccctaggtaggcctgatccccctgacaagcttggacaatggtgatgtccttccaacaatgcagtgaagacctgtctctcttctagttctggttctgaatgttgtttcttgcttttgtgatccatattatctgtgagtatgagattatcacagaaagcagagaaatagatgatgccgagagagatgagagatagccatgccagactcccacagcatggcaagggtgtcgaatgccatgccttggtgaagtgtcaggagggagtgagagctgctgatctctaatcaatgtcttgtggcctttggaggagtggtgcctgtcagcaggaagccctgagcagtccctagcaatgattgactttacaaccccaaatttacattgatttttttagaacatcaaattcttatttccaggttgtgcagatctttgtcaggtattaaatgtggatacaggaaaaaaaaaagccccacagacaatttttttttttttttttgaaacggagtcttgcactgttgcctgggctggagtgcaatggtgcaatctcggctcactgcaacctctgcctcccgggttcaagtgattcttctgcctcagcctcttgagtagctgggattacaggtgccagccagcacgcctggctaattttttgtatttcttggtagaggtggggtttcactatgttggccaggctggtcttgaactcctgatctcgtgatctgcccacctcgacctcccaaagtgctgggattacaggcatgagccacctcgcccggcccctcacagacaattttttagtgatgagtgaaggttataataataaaatagtcaagagactccagctttcagagcaactgactcaaagactgtatttatagttcaaattgttatatgattgtcaacaagtctggctggtaacagttgggttagttttgataaagagcagaagttcctgtctttaatgacaaaaatagtatgttgcttatctcaggatgcaaagcttttaagatgggtctgtggttcaagggcttcaagtatgtgagacttttagaaatacaaatctttttcaggctgtgggatatgaagtcgccaacagagatgggcaaaaagcacaatgccatttgctagttttcagtatctaaataaatattttaaatatagttttctcagtagcaacatggaattcccatttagagagaaagtttcagctgattgaatcgatatgacaaaagtttggggctgtcaactccttaccctcttccaccctttgttccaaatagtagaaagtagcaataaggaaatgaatggggcagaaattaaacttcaaaaatgacagcaagtgcccactgtatttcctgggctaagctgagttggagaatgcagctggaacttcaggttgggtgggggcttcctactgcctctctagatctagacctttgggtccacctgtatacacttatccagcatttcttgattctaggcctgatgtagccggagaaggagagtctgataggtgctgccttttccacgtggtggttttacctgatcccaaaagtatagcctgatgaatttcaatctcaactttggcctagatgcctctgcttacctggagcctggtacacctgtgctgaagaaacttggaatttttcttccggtagtccttgctactggggtagaatgtgcacttttctactttataatcccctctatgtcaaaattattattttattaaatttaagaataacatccatagcaggaatattataaatgcattgaatgaaaattaatttgcatgcagttacaaattacaaactagaggttctttgctataagggaatactccatggcagagccctcatgcagtaggtttaattcaatctatgttctcaggagtgagttggcccctaaggggatactcacctgtatctattgttctgacctagttgtatttctgcattgatatgctacaaaaagggatctctttggagcaaggagaataccgagcctgaaatgcctgggtgagagaattggagaaggtttagagagcttcacactcagggaaaaaaaaaaaaaaaaaaaaaaaaaaaagagaaaagaagaaaaaagcagagtgtgaaagtccaagggcttctgtgcatgttattagaaatgtgcatgtagcttggagtcttgaggctggacctagacatctctctgccttgcagatgctcttcctgagtttgctaccatcctttttctttctgctttgctgtggtgacattcagacatcagacaataaatggggtctgtgcacattaggggcagtgggtgggtgaaggctggaggaggctgtgtctcttctggtagagcagtcagcggaaacctaagtgaagaaaggaaagaagtctgtacccttgagccctgtcacacgttagaaaatggagacgggcttgagctgagcactccttgtcagaccccttcaggtgttactcacacaatgcaggggttcagttgcttggtgggtatcaacccaatgaccacaaccaaggaggatttaacaatgagatttaagtaaggagaacaccagggatggttcccaaagtagtgcctctgagctggggacgggttaggttttataaacgtcatgtaatgtggatctgattgactgggtcctgccatgggtgatgccagagctcaatccagttggatcctggatcctgccatgcaatgtccgcttcttaattcaatccctgctcctcagtccgagcactccagctccccctgtggttgcacactagttcatccaggcatgcccgggttatgtgacctgagggtccatggcaactgaaaaactactcacaactttgttacgtaaaagtcgaaccagattggcctggtgcggctaacatagacagcagacaccactccacctgctcagtccgtcaaccttcacatgcggaatctcactcctcacctccggcttctgagcccggcattgacacagactcagccacgcccatccccacgtcactcagctcccggcactttccctgggctcctcttgcatccttgaccgactgtctccaattccacacctggctcctctatgtggcagaaggacccaggctgtctccagaccctttctgttctcagtctgtgctcacatgctagggaatcttatgcagattcatttgcaacctaaaaatcccaattacttcctgacaacttccaaatttccttctccagccaacacctcccctgaccttcatgctcatgtgttcagctgcattcccactcagatgtcaagcaggcccctcaactttactcatctgaaaaaaaacctcttcatctttccatgtaatttttcccacccctggtgttctttccctcagatgccagggacaacaaccttggcatgcttgtttagtctttgttcttcttatttttttcagttagaaaactctcccttctaccttccaaatgtttccctgatctggccatgttctaccacctccaccagcacctttcagatatgagccagctctcccttccttctccccttgcctcgatccctaatgcggtagccagagtgacccttccaaaacatcatcagatggtgttactcctttgctgagagtgtccagcgtcttccagtcttatttggaataggtgtccgatttctaagggaggccactgctaggtcctgctgtctgggtggcatatctctccttctgccctccccggcactctcttctccacctcgctggctcctttgcacccacctcagggcctttgcacttgctgctcccgcacctgcagtgtgcttccctaatgatgataaggagggttgtacaccttcctcttgcacctccagcactgcccccacccctgccttattttcctccaggtcacctgtgacatgctgaccagtttgcccctacagctgtctgctggtagtgttcctgcactgggttgtgaacctcatggaggtaggagttttgtctcctgtgttcatagctctcagtccggcacctagcctgggcctggcacttggcaggtgctccataagtattttttgaatgaatgaatgaacagtcctataggatttctgttcaagttccactcccaaatcacttgggaagaaaagaaacttataaaatgaatgacaataatagatgaattagagtcaagaagttgcatgctttgtaataatctattggctggtttagttccccccacagtgagattttgtggtttggttgaggcggtggtgacagtggcatgagtgctctgatcatggattaacgttcatcatttcctgagaagtcttcagccccccccccgccacacacacactaaatctacctcagctctgctggggggctccatcttggggcggcctccagagcttagctcccaaccttgacttttcagcagtcttcacatttccttggaacatatatttgtgagcttcctctggccacttgaatgattcatgattttcctttgcaagagaaattgacagtggttttgaaaaaaatattcaaagttttacttcgacagaaatattatctaagtgttgacctacatatgataccttcccataattggtgcaacctggaactatgcttccaatatcagtaagaatatgttgatataaataaaatgtgatgaagcaaataaattctgatgatgtaaaataaagtatttatggtagaatagctgtgactagggaaagtgtatagattcatgtgtatgtttatagacatagatgttatatgtttgtggtgttttctgggttattttaaatattatgttacctatatttgtcatttaattccacatatggtgttttgcattttgtcaattaataggtattattctaaaaggtttttttttggcaaaatgattggttgtttaaaaaactgattgtttctaggaagatacggataagatgtccatgaaatcttagaggtgggggttagagatgtggagagtggggacctacttctggagtctttccagatgttccccagagtcttaggagcctctccacctgcagtggacagaacaggagcctctcaggctgtactgctgaccttcagagcacggcaaatcccggttttatccacctcacataggaatagccacatatgatttctttctaatcattgtgtttgtggctgtgaattttgaaaagcctcaagtttctttaatttttttttcattttcatatttattttttaataatatatatttgaagtgtacaacatgatgttttgataaacatacaaagtgaaatgattactacaaacaaatgagcatatctgtcatctcagagttatctttgtgtgtcgtgcgtgtgtgttaacagtacctaaaatctactttcttagcagatttccagtatgtaatacaatattggcaactataattctcatgctgtatattaattctctagatgtgttcattctacataactgcaactttataccccttgaccaacatcttcattcctcccaagttcatccctggtaaccaccaccctatgctttgtttctatgggttttttttttttttttgttttgttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccgtttctatgggtttgacttttaaaaagtttgactctacatgtaaatgagatcctgtaatagttttctttttgtggctgacttacatcacttagcatatcttctgggttcatccatgttgctgccagtggcataatttccttctttttacagctgaataatattttattgtatataatgtcacattttctctattcattcatctctttagaaacattttggctgattctatatcttggcttttgtgaataatgtaaatatctctttgggacataatttcatttcctttggctttatacccagaagtgggatttctggatcatatggtagttccatttttaatattttgaggaatcttcatactgttttccataatggctgtaccaatttgcatttccaccaacagggcacaaggtttccctatcctgcacacccttaccaacactcgttatttcttgtctttttgataacagccatcctaacaggtatgaggtaatagctcattgtggttgatttgcattttcctgatgattagtgaaattgagcaccttttcttttacctgtttgccattttgatgtcttctttggataagtgtctgttcaggttctttgaccattttttaaattgagttatttgtttttctgctattgaattgtgtgtgttcctaggaacagagcttcaggaagttaagagccaggcgatttggtggagaattgcgtgttctctgctgtgtgttcaagaacaagctgtcttgcttggctggctaacagcggagccaggagtaaaatctgggcttctgtatttccacagccaagggctctttctactactctgcaatgcacagaagcaactgacatgattgttctctgtgtttcctgagactaatgagaataaatcaaaatcttacagataagtatgtgtgcttctaacctatatcattgctatgttttctaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgtatgctctgatattctttcatgccctccccagtacttccattcatagagaggatgtctaggactctttaaaatgtgaatttcagacagtggtctgtataatatactcttaatgtgcatattaatatatattttccaaacatcaaagttttccatgacaatttttgagtggtaaaatgtaacagcagcattaatcagaaggctaactttattggcgataaagatattagatataagaatgtaatccacaacgcttggtggcaaatgcctgtaatcccctctaatgggaggctgatgtgggagaatcgcttgaggctaggaatttgagaccaacctgggcaacatagcaagaccctgtctctaaaaaataaaagcaacaacaaaaaaattagcaggatttggtgctgtgcatttatggtcccaaccacataggaggctgaggcaggagggttgcttgaccccaggagttcaaggctgcagtgagcagtgattgtgctactgcactccagcctggctgacagataaagggcctgtctcataaattaaataaataaatgaataaatttctgtttgaacagcaaatatttttcttttcttttctctttttttttttttgagatggagtctcgctctgttgcccaggctggagtgcagtggcgcgatctcggctcactgcaagctccacctcccgggttcacgccattctccctcctcagcctcctgagtagctgggactacaggcacccgccaccatgcccggctaattttgtttttttattttaatagagatggggtttcaccgtgttagccaggatggtctccatctcctgacctcatgatccgcccccttcggcctcccaaagtgctgggattacaggctgagccaccgcacccggtcgcaaatatttttcaaattaccttcatgtttgatcaattttgcttagtgttctgaaagtgtaaagcaccagaaggggaaataaggaactttaaattctgcaagtgactttttcactgaaagaatgatgttcatctgaccctggctatcctaatttctcgtacgttccatgatctatcctatctattctcttcacagttgtgaaaagccatttattatgcatcctcattcccctggttcatctcggttggcaggagctctgagaaagaaatactggagtgtgggtagtattaatggatattcacatacagatggtattgggagacatgtgggtctaattgttgcaggaactttatggaaatgtgatcttgttatccagtccatctcttgggagctgaggcagtattattcattccaacactgtttctgatgttttagcttgcctaatttagctttaattttctgccattttaggttggccaaaagcctcgaggaaacttggtcatcagggaatcccatcatgacttttctcagcaatttcacagtaactgagggtaagtatgtggttttccaagtttgcttgattaaaaattaaatttagtttctcatgcaaatatattattaaaataaaacatacaacagaaaatttatgctatatgtgatacataatcatttacaacttggctggtatgatgtatttggcatttataaagaaagtcctgaaatcctagggtaccatgttgaagcagaggaacaaagagaagcttctgtggtctggattttgctctggccttgcctcctcggacaagcaattgatgtctgtgtgtctctgtttccttggctgttcactctgtcaactcatgaagcttcttgtagcattaacatgccatgtctgaagaattctggcaaatacttaaatgatccctctcttcttaaaaaagtgagatgagtagatgcatgtatacaagtgagtttcttatagcacttggtcactgctccctaagaagaagctctttctttctttctttctttttttttttttgtgtctcactctgtcacccagctggagtacagtggcgtgatctcggctcactgcaacctccgcctcctgggttcaagcgattctcctgcctcagcctcctgagtagctgggattacagggatgtgccaccatgcccggctatttttttttttttttttgtatttttagtagagacagggtttcaccatgttggtcaggctggtctcgaactcctgacctttgatctgcccacctcggcctcccaaagtgctgggattacaggtgtgagccaccacacccagccagaagaaactctttctaaagtaaatgttcttaaaacatacaggccttagagagagtagaccagtaaccagaaaataccacagaacctggcattttggtttattgtcatataaattatttaagttattcccaggggagtaaggtatgactttatttagtgatttatgggttgaatggtgtgaaagaaactatcctagccaggttgtaatatcaaattttgttttcgcagtcagtaatgatctaaacctttattacacaaatttcttattttccttactttgcagatgtaaaaataaaagatttgatgaagaatatcaccaagttgactgaggagcttcgctcttccatccaaatctcgaatgagactatccatagcattctagaagcaaatatttcccactccaaggtgtggtgctgtttcttgtctgtctgttttgctcatggaaggagccttagcctgaagtcactggcactgtgttgtcctttcttccttcttgccttcctctcctttggctagtgtagtgggttgctgcacaaatgatataattggaggcagaaaggaaacaagagaacaagcaaggaaccaaagggtgtcattgtcccatgccaaaatcttagggtttttaattccataatattttctttatttggagttagaacaaagttggtgattatttattctgttgatttccagccctgatgcatgacacctgggaagggtctcggcttgattcagcaggtgttgcaaaattcttaaaatacccaaaaccaaaaacagctaaaaatatcttaagaatcaactatgacttcctctgagtggagagtgactgggcacagtctgactatgtgctaccgtagtgaatcactgtgaacgcaaatgagtaatggcaggctgtgtcatctccaagctgaaaaatgtgataaaacaatcaaagagctactgcaacaaaccaagggatgagtaacacatacgggccacatggggtatggtttctctgtggaaaaggggaacggggacatctcatgttttccacagcagatatcacctggatccttagcaggagattttctgagacagctttcagcacttctagttggggttttatcttcctgtacagagaaccttccagaagtagtaaccgtggagctgactcgtaagtgaacgttgcaattgaccatcaactgggccccaacacacgtttaatatcatgtcaattctggttaattggggcttattgcaagcttgacgggtggactaatgaagaattaatctaaattaaaaagagattagaagctgggaaaccaaaattcaaatgacagtgtcaccaagttacttataataaggcacttagtatttatcttcaaggaaaaatgtcaaattcagcttattaaacatgcaagagccaaggaaagcagggggcagtgctgaaattgtctcttccctacctcgcatgatgccttatagagaaacaatgaagatttttggtttaaaatctttagttattgaaacgagtaataggggaaagaagcagtggaaggagtaatcggagcagctacctgggaatgttttaagaccagggtcagattagctaacttctggggtccctttcaaattcagttttatgatactttttgggtttgggctcaactgtttttgatgaccactgcctgatgaaacaagtggccactgggtgtcactgctgttctattatgggagggctgtgcacagagaaggctcctgtggtaatgtggtattgtcttgtgtagatggttctgtagtgctttttttgcactctgtgtatctttctctacctctttgtcagtatgaatcattatgatcgcctaaacagctggacagttaagtaattgggaggagtatttaaaaagttgcattcttgcgtttcaaataagtaatgagattatttgctttgatggttaagtatatccataaatgcacatgtatctacagatcctaggcaaggaattaacattaggttaggaggtgacactttggatacttgttttttctagattgtcaggtttttagcagcaccatattatttctagtatccttttcttatctttcttcctgggtttctctaccatagctttagtcagtttgcaaataatcacatcagattcttagtccaggctgttggtggcatgcagggaatactcttcagtggtgctaaagccctggcaaaattgcagaaatcttcattcattcatttcttcctttattcacttaggaggtttctgcatgacaggcatggtcccaaaaacttgggctcaaagcccgtgctccaagggagccaatgttctgtgggggatgacacagtaaatatgcaaacaaaagaaggtcagtgttaagagaccagaaagttctatcatgcaaatagaacacaacaatgaggacaggtggtccctggaagcctccctgaatcggtgaagatggatgtcagactggaatgatgatctgcatatgaagagctatatgagagtcacagagctggggcatttctgtcaaaagaccagagacaggagtgagcagaaggaggcaaatgcagcagatgcatggataccatctcatttttctttcctgccctcttccctggctgcagagaacctgccatgggcacccacccatgggaatttcctttttcttgcagagctctattctctaatatcagcatcacccaattaaaaccacaaatcacaggggcttcctggacactggagcccatctagcccagccttctgtcctgggtttgcatcctgtccacctgccctgtgaagcacccatccacttcatgctgtgttcctatgttttaggcacatgttcaaatcaacaatgacttccttctttgtgttgggccaaatttttattcttttaaaattagcaatgaggccaaagtgtcaggacccaaatagattgagagagcaatcaaaagtcggccctctgtccctttattttctgtggtaaacaattaggcagagttcagaggacttttgcttggaagatgaatattttttcacagtcctcagtggattcattctccccgcgccacaaatcttaaggaggaagggagagggcattccctgaaagttccaatctcttctgggaggctccttcaaatggaaaggtattctgaattttttttctttctgtttcttttgagcagaaatgattgagtttggtgaatctggtcaaatttccttatctcacttggggccggtcctgggggctggttctgtcggttgcgacattaacagagctgctgggcataatttatggagagggagagattccttttaggagtttggaaacattacacattccacttgttttaatacatgaagtttgtttcctggaaagctccaacagatagttcttggtgaaactcatttcagagcagacactggtcaaaatttgctcattcttttttttttttctttctctgaagacaaaaagtaattaatgtgtgactagagttatgggtttctgggatcatgagaagtttggcctgaagtttcctggaagacaccatctgtcatgtgcagagtctcattctagagaaagtccttcctaggccttagactgcttgtctggctctgtcaccacatcaggagattggggtttgtggtccttgtaatccaggattcacagaatgaagtgcacacacccatccaccaccatctcattctctggtgttcttagagtagggcttttctctttgatttgtttgatttgttgtcctaccagagtattctcagtaaatgtggtaggttctcattaaacattcactaaaataaagtgaaattccagctactctccttccattaagtcagctagcgtttcttaggtttatgaaagccacgttaccttatttgctcattaggaattctgagaaatgagtattgtgctaagggcatttgtgtctcatttaactccctctgagcagggcatttctcttctttcacagatgaatgtgatgctgtggaagtcacagctgggagagggcctgaaatcaaacccacgtctttgaacttgaactgtgttattcttccatcacatgatgttattgcttcaatttgttacaaattaatagttctaagaaaattactgcttgccgatgggtttcctcttctcctacttgcacttatgtaaatatttttaaaccttaattccccaattggcattgatctctgcaaaaatgcttcttgctaattttggcaaaatattttttcctttttatttttaaaaattaaacttttattttaggcttaggggtgcatatgctggtttgttatataggtaaactcgtgtcagggggtttgtagtacagattatttcatcacccaggtattaagcctagtatccaatagttattttttctgattctctccctccttccaacctccaccctcaaataggccccagtgtgctttgttcccctctttgtagccatgtgttctcattatttagctccaacttatatgtgagaatttgcagtatttcattttctgttcctgtgttcatttgctgacgataatggcctccagctccatccatgtccctccaaaggacatgaccttgttctttttatggctgcatagtattccatggtgtatatgtaccatattttctttgtccagtttgcccttgatgggcatttaggttggtttcatgtccttgctattgtgaatagtgctgcaatgaacatacatgtgtaggtatcctcatggtagaatgatttatattcctttgggtatacagccagtaatgggtcaaatggtagttctctttctagttctgtgaggaatcgccacactggtttccacaatggttgaactaatttacattctcaccaggagtgtataaatgttcccttttctctgcaacctcatcagaatcggttacttttttgactttttagtaataatcattctaattggtgtgagatggcatctcattgtggttttgatttgcatgtctctaatgatcagtaatattgagatttttttcatatgcttgttggctgcatgtatgttttcttctgaaaagtgtctgttcatgtcctttgcccactttttaatgaggttgtttgtttttttcttgtaaattttttttaagttctttatagatactggatattagacctttgtcagatgcatattttgcaaaacctcccgttctgtagattgtctgtatactctgttgatagtttcttttgctgtgcgtaagctttttagtttaattaggtcccatttttcaatttttgcttttcttgagtttgcttctggcatcttcatcatgaagtctttgcccattcctatgtccagaatagtattacctaggttgtcttccagggtttttatagttttgggttttacatttaaatctttaacccatcttgagttgatttttgtatagcataaggaagaagcccagtttcaatcttctgcacatggctagccagttatctcagcaccatttattgaatagggaatctttccctattgcttgtttttgtcaggtttgtcgaagatcagatagttataggtttacggccttatttctggactctattttctattagttccataggtctatgtgtctgtttttgtgccagtaccatgctgttttggttaattggatattctttcaaggtgttttttgatatcaaattctgatactttaatttgcaaagtatcatttttttctctcaacttcatcagtcaccaaaagatgagagtatcttttatattttcatccaagtcgttagtgcagaaagattaccatggcataggaaggtataacctaacacctatttatttgtttgggctcttaaatcagttgcaacatgtctgtctggggtgtcttggtaatttattagcctaataatttcatcattaaaagaaaatgactttatattgacatggctcattgatcatgactgtatcgacatggtttccagcaattttctttttcttcaagggcttacacataatcttttggataatccatgattagaattcttcaagaattgacattattatctattagtaatttctaaagtctactttacaaaataaaacctggatagtttttatttccatcacgacttcttaaaaactgtagatagtagaactgtcactctttctgaaggcatgaagagggaacagggagagagggaactggaaatggagacagagaagttggtggagaaggtggccagacagcagccatggcctcactgaagaactacagccaggctgaatggtagttctctttaggttctttgagaaatccccacactgctttctgcagtggctgaactaatttacattcccaccaacagtgtataaatgttccctttttctacaatctcacaaacatcttttattttttgactttttaataatagcctttctgactggtgtgagatagaatctccttgtggttttgacttgcatttctctaatgatcagcgatggaacaatagacatgggggactactagagggggactaccagatggggaggatgagagggggaaaaagagttgaaaaaccacctattgggcactatgctcactacctgggtgatgtgatggttcatacaccaaacctcagcaacacacaatttacccaggcaacaaacctgcatgtactccgtaaacctaaaataaaatttgagaaaaaaaggaactgcagccaaatgatgcctgccttactgggcaaggacaccattggcactgccctagaggccagctgccaagatgcttatccacagatctcctaggcatcctgttttacccttccagtgtgaagatgtttctctttaggaatatgaaaaccaagaaggaattaattagttctcttaagtgtaatcatcatccttaatcaataaacccacctaattcttattcatcttttcccttaaatatcctgtaagtcaaaactgtgcttttgctggcagtgactgataggcttcttagtagtaacgtcatttttgagcacttatatacactacccctgagctgaatgctttacatctcatttaattctcccaacaaccctttggagccctttgtcttttattgtcatccctggttgtatagacaaagaaactgaagtgtgtagatgttaagcagctttcaggaagtcagacggtaagagctggagtcaggatccaccaccttgccacagtgtggcttcagtccttctggccaggttctcgcagccttctcctgccctccgatgctcatctcttgtacttgcctctttatcctgtgagcagctctgagctcaaatgggtccccaatggcagagagccacactgctcctctctgaagggcgtagggcctatttttaaatacctgcgctcctttcattgtcttgtcttacaaattctaacttggcagactctctctccccatcatctccagttcccttgaatcactgtccgtgtttcccttccggtcacaactgagctgagggcagcctttcctcccatgctttcccaacctctgagtctacaatgagcagctgggcaacatggaggccatctctggtgctctcctctgaatgcgattcgggtttcagcagatgtccaataaacaaagctcttgctaaaaatgcaaatgcctctcctaaggatcattgtcatttttaaaccacataaatactcagataattatctaagtggccaagtgtgtatgagccaggctcgcagggcagagaggcatcgccctggatcctaagcccccttacagctttccaaaccaaacactgacacacaggaaaatcagcaggaacttggcattctgtttctgataatttgcagcattagcctatgcaaagcccgagataaaaggtgcctgttttactttgaatagaaatcacacaagatatttccaatcaagcacaactcagtgttgtctttgcttttctaatcttcctcccctcctacctactctcaaacaggaacaacgaacgaacgcaatacaatctttaaaagataaatagtaatatttggaaaaccacaggaaaggagagggagcaaatgtgctgctggggctgtggcttctgtgcattgtgactgcggagcttccacatgacagggtgtgggatcctctctatttggtaaaaagagatgtaaaaaatttcaggacaaatattttttgtcctgggactagactctaaaaaacgtattaaatatgatcttgcatggggaccactgtgtgacatgctagaaagtaattaatacaaatgttctatgacaaatgcagaaaggactctcattgggccagcttgggttgatgctcatgaaaagccagggtgattcccctgaattgggggtttggatgaggtccattttgagggatagtttcatgcaaaagcctattttgtgggactgatcaaagagaggctcctcttgtgaaagcaaagggtagatgcctatattctgctcccaacctcctcctgagagcttcccctctgcccagagacagcatgattgaaaacagtggcattaaggaaaacttcaccaatgtgtgtctgcacaatgccagccctatatgaaaaaaggtctttttggtaagttagtgatgaaaatacttaatatcctttcttaaagactcaaaatgcacactagcatactagagtatcatagccattggtgatgattaattttgtgtgtcaacttggttaggctgcagtactcagatatttgttcaaacattattctaaatgtccctatgcgggtattttttagatgacattaacagttaaatcagtagactttgagtaaagaagattactcgtcataatgtgagtcagccttatccaatcagttgaaggcaaaaaaagtaagaaagtcccccaaggaagagtaagttccatctccaggtagtccgcagatgtgagctgcaatgtcagctccttcctaggtcccaaatccgctggcccaccctgcagattttgggcttgccagcccccacatttgcatgagccaattccttaaaataaatctctctcaatgtatgtatgctatgtgtcacttaatgactaggattcattctgagaaatgcatcattaggtgatatcatcattatgtgaacattatagtgtatacttacacaaacctagctggtacagcctgttacacacctaggctatatggtatggcctgttgctcctaggctacaaacctgtacagcaggttactctactgaatactgtgggcaattgtaacatcgtggtaagtatttctatatcaaaacatagaaaacacaagaacgtattttactatacctgttctaaacatagaaaaggtactgaaaaatatggtataaaagataaataaaatggtatgcctgtatggggcacttggcatgaataaagctacaggactgaagttgctctgggtgagtcagtgagtgagtggcaagcggatgtgcaggcctaggacatgcctgtacaccactgtagactcaataaacattgtgtgtttctacatttataaaaaaaaatttctttcttcaatcatagattaaccttagcttactgtaactttttttactttataaactttatttatttatttatttttttaagacagagtcttgctctgttgcccaggctggagtgcagtggcacaatctcggctcactgtgagctccacctccttggttcaagcaattcccctgcctcagtctcccaagcagctgggattacaggtgtacgccaccatacccaactaattttttttgtattttaagtagagacagggtttcaccatgttgaccagactggtctcaaactcctgacctcaggcaatccgcctgccttagcctcccaaagtactgggattataggtgtgagcaactgcaccctgccgaacctttaaaattttaaaaaacttttggactcttcagtgataacatttatattaaaacacaaatacattgcacagctgtacaattgttttcctttgtgtccttattctataagcttttttctattttaagtttttttacttttaacttttaaaatcgtatttttaaaaattaagacacaaacacacagtctagtctaggcctacatgaggtcaggatcatgaataccactgtcttccacttccacagcttgtcccactgggcggtcttcaggggcaataacatgcgtagagctgtcgtctcctgtgataacaatgccttcttctggatacctcctgagggacttgcctgtggctgttttacagttaaattttttttaataactagaaagagtatactctaaaataatgataatatagtatagttagtacataaaccagtaatatagtcatttattatccttgtcactattatgtactgtacataattgtgtgtgtgatacttttgctatgaatgggagtgcagcagttttgtttacaccggcactgccacaaacacttgaataatacgccaggctacaacactacaatggctgatgtcactagaagataggaattttttcatctccattataatcatatttttcatctccattataatcttatgggactaccaccgtatatgtggtttgtcatcatgtaccagatagcgatattttggtcaacaatggaccccatataggatggtggtcccatgagattatactactgtatttttactgtacctttttactgtaccttttctatgtttagatatgttcagccacacaaatacttaccactgtgtgacaactgcctacaggattcagtacagtgacacgctgtacaggtttgtagtctaggagcaatagaccataccctatagccaaggtatgtaggaggctgtatcatctaggatgctgtaagtgcacactatgatgttcacacaattaaacaattacccaatggtgcatttcccaaatgtatccttgtcattatgagacacatgactgcacacacacacacacacacacacacacacacattctcttggttctgtttctctggaggaccctgactactacaccattatttatatcttactgtattttgggaacattttatggcatctgttgagttctccgtgctcttcttcagagagcatggttcctattcacataggttcatgcacttcggcctcagttggcctgaatgtttcacagcaatcatacccatcaggagcaaaaacatggagcaggaagtatggtttttgttttattttgctttgtaatttggcatatcacaaatgtccttaactgaaaagcatacccaaatgaagaggtgtgtcaaagcctttaattgcgatgcatgatagtaataaactagagactaatataagttgtcctcagtgcctccttctgagtgtacttgctttaaaaaaatatataacaagcttggtaatcctgttttcaatctaaaaatgaaggagcaaaaaatatcagcttcacactgatgacggtgaaaagtggaagctgataaactgaaagccaagggtaagacttaatatcagacaaacgagacacagatgctaactacgggggtggcatcggagggtgggggcttggtgggcattcagagtgagcctcgtggagagcagagggacagagtttcagaagggtgatccaaagacctcaagcgagggcaaattttataagaagtcagagaatgatgtgcgcacttcagaaacatttccatcaaaatgttgagaatcgaaccccagtttgggctccccgcatctgcaggtcagtcccgggagttgggaaatccactcttgggcgactccctgccgatgaagctccggtctgaggtggtgaagcacatgacgtcataggtatactcacctctaatctctgtgctttgaaacaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaaggtatggagagcatgctggctgggggcagtcctctgcaggactctgctgtggtggctgcagataagtacagtagtcctaggggtgcggcagtgggagatcagcacctggccactctgcagtggtctccaccagcctctggtgtcacctgtttgctgaatccaaggtggggctcaagaagactttgttgtaataaagggatgttcaggagacccttcagggggtccttggaaataagtgtcagggcattgggacagagttggtggtgatctccatgctcattgtggaaggacccactgcaaaaacacagcaccgcttcctaatgccaggtgttctctcctctgtaagggccacctccctggagcatgtttgaggaggctgggattgtgcatggtccactcctgagcggcccgagttaggtgctgctccctgcacggtggccctatctgtcagcgggaagcatccagctctgccagggcctgccctggagagaatgtggaggggtgggcagcacaggaagcccaatcccctgtgtgtgccggctctgacaagcatgatcctctgacaagcagcagtgtgagggcagggagggactggaggaagctaaagatgatgaagtctgcaggagagagtggagagtgggaagtgaggaggagctggggcaagcccaggcccagcactttccggacgggcccagaacccatgtaggggcaacctagctccaaaccacagctcactgctctcaagctgccccttccagaagcttctcctccttctggcctctactgtttgaatctttacttaagtttccagaagcttcccctccttctggcctctactgtttgaatctttacttaagtttccagaagcttcccctcttacccttaggcactgatcttgctccaagtaccattgttttccctttagggaagtatttcacaacctctgggttcattagagaggctgcagggtttgtactatggtaaggtggctgtaggcaccctgagtttgggtgaacagttttatagtcagcaaagggtagatttgccatttcagccacgcatgatttccttagtttctattacttcaagagtccagggagtaaatgttggaatgaacacacacacacccacacacacacactccaagaacaaatatttgttttcagaatgattacattttaaacccataaggaggagaataaacatttcttgcatccccataatttgcaaacccacctctatcttggtggaattcgtatttttcgctaacatgcttatggtttagctctgcatttgctcaccacagcctctcttccaactttacagtttgccttttgggaaacagagctcccattggcacgatgctactttagtggccactttgttatgtgcacaaaggtccccgatttgaagtaagtgcttgtagaggcccacataattactgtgacaagggccatcatctgtaccaagatttctttgaaggataagatagtgggttggattcagtctcccagacacaatgaaaatgacatcatcattaataacaacagctcttatttatcaggtaccttctatatgaagggctctatgaaagttgattaaatacaagatatggctcaggatgttagggcagcccgacctccatgtgagggccacgtgcaggtgcagctcattcccaagtccatgtactttctgattcactcagctgacaatgaatttctgaagccttcagcaaagcacagtttgctatattaattcggcacatcaatctggtctcttggagctgcgctggatccctgtcactccccaccataagtcaggggccagtcactgtgtgccacttttttttaaagggcagctgcaattagaaagatgagtagaagaagtgacaaaagctacacaccatttctcctgctagagttgtctctatagtatgaatggacagaattctgtcattataagcagagtgcctctgtgaaggatggagctgtgatcccggagccctgaaagtcatctgcagagctaacagctaaaacactaatgagcaaaaataagaagcagtgacaactgggttcctctgccccagcctggaaaacagaaaattcaatatccaaatgacagacagtggaaattagctgtgattttccctgctctgtgcgaagagctggcatttcctcatttatccattcatccaacaaatatttattgagcaactaatatttcctgttgctattttatgcccagtagctacatgaaagatcaagacagaagaaaagccttgcctccagtgtagaactgagaatatgaaaaaaaaaaatcatgtaaaatacagagcatttcagttggtgatagcataagtaagcttcagagggcactgacatttttaaagaatccaggttaaattcacatccctgaacctttctaactgttagacttcaggaagacttttaatctcctcaagccccagttttctcatccacaaaacgaacagtataatgcacatccccaaggtattaggaggattgagatgatgtgtgaatgctatgaatactgtaaagcagtagataaatgtaaattgcttcacatataaggactgctcatattttgagcctcttctcaaatttccaccttggtcacctcaaagatacaaagaaatatttggcaaatgatttgaattttaatgatagatcacatttgtttctggtttacattttaacaatgctagtgcaattcagtgtgctccaaaacacatgagctatatatactctaatgaagataactttcatatagtaccgcaaaggcgtctctgaagttcaagagagaataaaatcagataaacaagttttcacagctcaaaagatgcttctgagtgtaaaaatacagtgttggttatttcatgttgttttgtttttgttttgtcctttagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtgtgtgtttcatctttgtccctagggaaatattcaaatttgccccttctttgtatttgcccctttttgcctttatcttcccacatctaaaatttgcattagacagcaaaatacaggaatgaaagtaccttttcatatctctggaagcaacagcataacatagaataaggcctggcatctctctaaaaactgcatgaaactgatattgttgatctacattccaccagtgtggagattgggatagtacatgcattatctataaagtaagaaattactaactcagttattgcacagatgagatttcaagggcctgtttaacttaattcagagagcaaattgctttcaaaaaccttaaaacatatatttacttataaataattggcttacaagttacagatcatttactgcaaatgcaaacacaaacttgatttagtttagtgacttgatgttaggttttgtttgaactctttttgcctgggatggaactgactgggcacgaatgaggaggagtgtggaaattttagggttggacgtgtaggatgaggagcaagataacaatgttctcagaactgccttggagacagaatgtaagtccatcatgtgatagataatttgtatagctataaaatatctggatatcttggtagcatagacatacattaagactagtaattagtctgaattagtgatattttatggattaataatttattactggacaaatagtgtaaggacttatgtgtgtgtgtgtatgtgtgtgtgtgtgtgtgtgtgtaggtatgacatttccctcttctaccaggtatgttggccagaaaagttaccgtagtgtttcaaatggtatcccaaggacagaaaactctaaagcagacattccattcttttgacttgttgaatatcttgtacattcagtggaggaaggaactagactttcagaagtgtgtgaaggaattgttttaagtcactatgtaattgcaatttagttttcttattttctcaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaagtaagacagtagtaatatatatatatgtgtttagattcgtttgtatcttgataattggccttaaattatagtaagtattctgtctgtgtataaggttgctatatactggcatagaatcttctgcttccacctccccaaatgctggcatggcagctgactttgaacggttctagtgcctttgagcacagacaaatcctctcacctgagtcactaaggaactgtgtcaccaaggaaatgtctaaaacacctgaaaccccagccccattggtttcccaggctaaccagtattggtgagggtccaggcataaagaccatgagcactgctttggtccatgcaaatggctatattataataacgaagagaacttgtctgtggccacctccaaatttgctctctatgaagctcaggtacaagtgaatatgcatgataggtacaaacgaatatgtcacgatgggtacaaatgaatatgccacgataggtacaaatgaatatgtcacgataggtacaaatgaatatgtcatgataggtacaaatgaatgcaaattaatacataattttttggccccaatttaagtgaagatgtttttattagaaaggcagaataaacatgctggtgaggttttggagtttagacggttcagctccatcagttgtgcatttttggacacattgttttatgtgtctgcatcatgttggtttcatttataacgtagaaacagtagcacctggctcataagcttattgtgagatgcaatggatatgaggagtgttggtgccttagcataagggtataaatgtatcctagtgtattcgttttctatgctgcatgacaatcattgcacacttaatggcataagaaaacacacatttgtcatctcataatttctgtaggtcacatgtcgggatttctgagttaacatttttagttttgtacatatcgtgactatacttttttctgcaataaaattgctcctgttcatattaagcttgcaatgtaaagagtaggtcattaaatttcagtaagaacaacttctataattaatggcttaaaaatgtattatgtagtcatattcttttttttttttttgagacggagtcttgccctatcgcccaggctggagtgcagtggcttgatctcggctcaccacaagctccgcctcccaggttcacgccattctcctgcctcagcctcccgagtagctgggactacaggtgcctgccaccacgccggctatttttttgtatttttagtagagacggggtttcaccgtgttatccaggatggtctcgatctcctgacctcgtgatctgcctgcctcggcctcccaaagtgctgggattacaggcgtgagccactgtgcctggcctatgtagtcatattcttcatttatactttggggaaagtatttctatcaactttattgtcaaataatttttttcctttcaaatgggaagtttgggaagatgaaagtaacatttaaaacaaccacaacaatcataccttgagtatttataaatcatagtatcaaatctaagataatattttcattttattcttataaagctaaaataatattttcattttaaatgttctcttgatgagtaaagaaatagttatactgaagtattcctcactagcttaaaaccttataagatttagttcctactcattatggtgatgaaatctctaccctcatcaggtgaccattgatttagacaatttagttaagtaaatctttaattgaaatcaactagcatcacaagactcatgagagccaccaagagggattaagtacttgcgtgaaaataaggcaatttaatatgtcaaaattcgtaagtttgatggttctgcacgggctcattaaagacagttcagtagtaacttgtaaagctaacttcataaaaaaagctcagttccggtctcaatattgtgactgttgaaatgagaattttcttgatgaaaaaccagatttattttttgaattgtcattttcattttcaagtgtccatgtcattatttaatactctttttgattacttagtttgaaaatgtaagtcattctttcctgcctttgaagtcacttaagtgaacatagcatgaagtttcttatgagttgagagctgctgaaaactataacagggaaaaaaaatcttattttacttcctgtcttggtttatttggtgttgctataaaggaatatcagacactgggtaatttgtaaagaaagaggtttgtttggctcacagttctgcagactatacaagaagcatggcaccagcatctgcttctggtgaggcctcaggctgtttccactcatggcagaaattgaaggggagatgccatgtgcagagatcacaggacaagagaggaagcaagaggggggaggagggagatgccaggctgttttatttacttatttttaaacaagcagctctcttgggaactaatagagtgagaactacactcattactgtgacaatggcaccgaaacattcatgagggatctgcccccaagatctaaagacttcttgttaggctccacctccaacactggggatcaaatttcaacttgaggtttgggaggacagatattcaaactatagcactcccaaagttcagagtggtgtcagaaaaaaatatggctgtcattgaaaatgaggcatcctggatatgtgaatgaatttccctattaacctaggcatcgtgtatcattagcaactttttttttctttctaattgcaacagcaccgttttgcttgaagctttatcaggaaattctacaattgccaaatggtgctttggtgtggaccttcctaaaacccatattgcatggaaaaatactatacacaccaaacactccagaaattaacaaggtcattcaaaaggtaagttaaaataaatgagaatcatatagaccatacatacactaaatcaggaaggaatctttaaaaatgtctgacataattattatgcgccttggattatgtagaaggctcttgttttgaatctacttcattttagcctgagtgtttttcctgtcattgttattgttaaatctggatttgctgactccttcccttagaggacactttgggggttggggttgttatttagaataattaatgcagtgaacttacagaactctaatatgaaaagtcaaggacagtgagacagagaggaggactgtttggagtaattccaggaaaacttcgagaacaaatgctaatctgttttgcttggtgcatccaacaattacgaaagaatcagacatgatacatacaaactgatgtattagcagttagttagtattttggttagtgatgtttctgaattcactgtaaggctttgcttcaccctgtggagaataaggtgagatgaagacaccaaagcagggtgtatccaggaggaattgagacactatgtggctctgcttattttcctttccttacattgtttaacctctctaatctatttactgcaggatttgttattattaatatttgcactttctttttaaataattgtgttgtattttcctggagtcttttcttgcctactagggggcctgtaagcctacaggcacctggaaaggggacattttaccaaggacacaggaataatttggtcttattgtcaaacacagaagagaagatacctgcactattcatgataagcttccaagcctcaaatagcattaaaaatttggaaactgtgatcatatggcatgggatcatatgagcagttaagtcatttttgatcaaacttgccttcatgagtttcatgcttctgacccatggttgctgtgtgaggtcacagcactgtttcctgtaagttccctttcccactttgccacctacctcaggggctgcatttacctctgcctactctgaatggtatttaaactttaaaacatttatataatttatttaatttttgttttgttttgttttttggagagacagactctggctctgtcacccaggctggagtgcagtggtgcaatcatagctcactgcttggctgaagcagttctcctgcctcagtctcccgaagtgctgagattacaggtgtgtgcccccacgccctgctaactttttagtttttttttttttttgtagaggcatagtcttgtctacttcctaaaaaaaaatcttgaaagtgtcctttcagaggggtatttgccaaaagtctgcactctcacatggaacgacattgatctccgtatatcctcagtgtgagctgttctgttgggcaggaactctggcctcacagctgccatcccaggactggagcctctgcgccattactcgaatttccttagtgtagtaagctttttagggttttggatatttaaggaatttcacagaaaatggctccatatcacagctctattttaaattcaaaatttaaaaataggccatgactttaaaaaaagatgatatgctatattattatgttaatattattaatatatgactatagcattgcatattatgatgtattctgcagtataacaattagtgtgatgatctctgcttttaaagagctcaccctattgtggggaagagaaggcaaatagctgaagaaataagttagatatactatgctataaagaccattcagtgcagcagaggcacaggctgtggggggcagctggtctccctggaaagaaagattgggcaaagcacttggaaggatgggttttctaagcccctgtgaggtggagacgggaggattgtgggcctggacagaggtgtggggaggtgccaagccccacatgtgtgttctgagaatgatgagaatttttgaaaaatcaccaaagatttcactggtttttgcttagcccctttttagatattgcaggcagtattgagagctgatgtcttttttacttatttaaaatggctagcaactttgcatgcaggtatcctggttttgcacttgtaaagctgattttatggcattgtacctgggatgaattatcctagcagtcagccatggctatttggttttatgaaaattgtttctagtcattagactcatggtctaaagtcccacagagctgggagacgcttgtaggtttgcctcttgggctatgcgaagcaatattatctacagtgttggagtggcccatgctataaattatttaagacgtggtctttttctctccattacttcttgttaggtggaaccatctgaagttgccatttttgcaggaaaaaaaatctataaaagttggtaatttcatttggtttaacttgtaatagcacaggtgacacccagaagcatgatgctgtggtaagaaacgtgtgtatgtgtgttggaaggctggattttggtcccccttttcctaactctctgtgaccttgggcttattgcattctctttgaaggactcttctcctctatctgtgaaatgaaagacttgagtagatccgtgattttcagtcatctgggagacggctcttcatgggggatgcatcagaattacccacggacccttagtaaggccttccgcctctgggctctgatatccccatccctgaacacttgtacccctcacacccatccatatccttccacagagctgtgtgcacctccatctatcagccttaaagacagtggaggtcaagcattttcatgaactggaaaaaaaatgatggccaaaacttctagagagtgttaaaaggtaaacttagggacattaaaatttcaacaagtttatttgagcattcggttattcatgaattaggcaatgccagacaattcaaccctccactgactatgttgggatgtgggatgtggggtaatagaagaagcttgtatgaagtgtttgctgcagcaacagggagaaaatatattcgttaaagtcaaaagtccctagttggaggttagttggaggtttctgattggttaattttaacttttgttttactgtttgcattgatttgggttttggtttgcctacataggaactcaaggtgctatagctgtcttagcctaacagcctcctgatcaactattttaacaggagttaatttaactcatactctaagggtgtcagactcagtatttgcaaagaaattgatgctatttccatgtcattagtcaagagattccaatgtattagtatgctctttttattttataggtcagagtcgtgttcagttttggccctaggctgatgaaaaattgaagaacaatgtgtagacacaatgtgagcttgaagggaggctatgaaagaaaaacagaaaaaagaattatattgttttcccaagaataagtagcatgcctgaaatgatacttcagtgagaatcaccaggcacattctaggccactggtgcacaaagtaggtttagtctgggcttctaagggacgtataagcccatgaaaacagaccgtcttattttcatctagctctctccctttggctaaaggacagagctttgaactgtcacactcagtgtcctcctttgtgaaactgggctaaatcataactctcagtgccatttggaagtggaaaaaataccagaaataatattcagaaaatagtaaaccaatgggatctcctcccctacaagtgttattcccagaaatgcattctgccattgttgcctctggggagtggggaagacagatgtcacctcagaaagaggaaagagatggtggaggccagtggttcaaaccggggtggggttggagaaattttacccaactgggcacatgtgacagtatctgaagatatttttagtgtcacaagtaggaggcgctgctggcatctggaggctggaggccagggatgctgctatacatcctacaatgcacaggaaagcccccacccccaaacaaataatgatctggcttacaatgttagtggtgctgaggttgagaaaccccagcataaaggggtatataatgccagacgggagcgggtgggagcccctgggaagagaaggatgaaagtagaggaagctggtggtcaggtgggcatcctggcttctcctctactggtgatggtcccaaacaggggctgtgggatgatggaggagctgcaagctgagggccttggccctacccatgtgtcttgggggatagtccctgtgtaggccggccctgagctagcatgtggtcctagcagtgtggctgagcagaggaaggatacctgaattagtgtctctgagcatggagtagaagggagccagatttccctgacatccatgtcctgagccagtgtgtcaagtggaggccttggggacctgctatgagccggctgccgtgagagcgaggtggcctcagcaccaagctggcctaggccaggctggcagaggagatggctgaggctcagaaagcaggagccgaggtgagaaggaagcagcaagggagaaggcagtgccagaccccaaggttccaggtaagatgtgggctgggcaggccaggccctggcagcaccacagacaggcagacgaggcacatggctgtgggagtcctgggccctccacccctgactgtcaccaggctgcccctggagaacatcagggggtttgagcattcaccccaaagagcctgaatcactcagaggaagctgtttgaacagggagccactgtcagcaggcaattttgagactttgttctctcttcaccatccccagtgggtaaaaactggatcagctacaggaaatagagaactaccttttctttgcatccccaagcagtgaggtgtcagatatttggctttgtagcatcatctgtctgtatgcataacatcaatcaggaaacagagcaggtcccataaaatggcagccctacgttgggaacctggtgatcctctgtctggaagccgcctgcagaggagggactctgatagttatgtttgtttccaagtcttcccatgctgctcaagatggcaaagtttttcagtaaccttgtgtatcactccagacatggcagcagcccacacatacctggaatttaaatgccatacttccttgggatccagtgtgccagagacgcatgtcctcacctgaccactgtgttggagaggtccttcctcctttcaggctggcctcagcaggtggcagagatcagagagaggccaccagcggtgatccagacagccacgccatgtctctccctgttcccactctccctgtcctctcaatgcccagggcagccggtgctcctacctccagttccagctgtggggggctccagctgtctttctcttgcctttgttcctggagcttatcctccaaccttcttaagaagtatcttctctcctcaggcacccccaacaggcactgtgtgtttttgctttgtttttaaattaacatagagtaagttcggcaggctttttttcggtcgacagctctcacatttgtctggatcagtacacagaacagttccattgcccgagcccacaccaaatccctcattttgtcccttggtaatcacactgtcttcccaccctaaacccatctgttctctatcactataggtaggttttctttgtgagaatgccctataatggaatcatcatctgtaacctttgaaagtggtctcttttgctcagtacgagggctgtgattcacccaggtcattgtgtgtatcagcagttgcctcctctttattgccaagtggtattctgtggtgtggattcactgcagtttgttcgtccattcacccactaaagggcgtgtgggttttttctagtctttggcgattatcagtggagctcttaccttgcttttatcactacttgaaattatctcattgacttacaggcgtacttgtttattatttgtcgcctgctgtaatataagcttcatgaggggcaggagcttgtctgtcttcttggccaccgtccccagtgcctagaagaatgctaggaataccttcagcagtggctgttgaataagttaaagaataataattatttggctcttgtacccatttgagccaaagacattctggtgttaaatatacaagggagatagagtagactgtatgccaagccctctgcccgctgccagagccaggccttagctttgcagatatgcagtagctttgtctgagtttagcagtggtgggtgccatcaagaagattatctcccaaggtcattaatttcatttactgagcttgggccaggcaccttatgtggattatctcatgtatgcctcacaaccaccactgcaggtaggtactaatatccccattctatagctaggaaaaccaaggttgaaagaggataagttagcttgaccagggtcacacacctatcaagtggtggagctggaattcaggcccagtgtattattttgaagcctgtgatatggtttggctgtgcccccacccacatctcatcttgaattgccataatccccacgtgtcaagggcagggccaggtggagataactgaatcaccggggcagttttccccatactgttctcgtgagagtgaataagtctcatgagatctgaagattttataaatgggagttcccctgcacaagctctcttctctgctgccatgtaagacatgactttgatcctcatttatcttctgccaagattatgaggcctccctagccatatggaactgtgagtcaattaaacctctttcctttataaattacttcgtctcaggtatatctttattagcagcatgaaaacagactaatacagcctgtattagttttctcaggctgccataacacagtaccacagattgagtggcttaaacaacagaaatttattttctcaacattgtggaggctgaatgaccatgatcaaggtaatggcaggactggtttttcctggggcctctggcttgcagacagccatcttctctttgtgtcctcacatagttgtccctctgtgtgtgtgtcctaatatcctctttttataaggacatcagttatatggattagagtccaccccaatgacctcattttaacttaattgatgatttaaataggatctttaaagacctatttccaaacaaggccacattctgaaatatcgagggttaagacttcagcatatgaatttgggaagcacataattcagccagcccacaacagtgcctctttggaatgatcttttaccacttgtaaatggaaataattagagctctctatgaaacttgtgaaccctgtccttatggttttgcagctggttatggaatcacattgaaaaatagtagcccagggaggctagtttgctaattactacaggaacgtaggactgcatactaaaaacaaaaaataagtaggaagcacttggaaaccagttgcaggtcatctctcagcagccacctgtcctcgggacctatatgaattccccactgaaccttggatgctcacatgcatggcgtttgttccttgggaacgttccagagcagggtccaatctcactcatctgtgttaactacctagcacggtacaatgatgcacagtgtttgcttgtaaaaagcttgttaagctgcatttatgtatgaagatttttgttgcaaagccatttggaggaggagaagatgtgcttcgaattgctttcttaattaaaaattttccctaaaaattgagctaaacgttacttcccccttccctttggtcactagagacctcctctgtcagagaaccaacaatgtcttttttactctgacaatagtttgctctcaagttactgaagcagtaacttagacatgcctatccatgggaagcctgctaatttgtgcctgagcaaatttttgcagactaaggatggcttgcagctggtggtaggaaagctgatccataatggccaacttttagttttccctgtggtccaggtatgttctgtaaataggacttggtgctaggtatatgagccaaggactgagaaccaggaacctattggtggctatgaccaccctgtggctattgtgcagaaccctaccttacatgaggcatcaaagcattggcatccctgcctcaacctccctcatgcccttagattagcttgtgtggcttcgtacctttgccagcatcacatcccaagaggcttttttttctttttcaaaaaatatcagacggtgcttaaaactgtagcttttggtactttcagtgatcttgacatattgaagaaatctgattactttttctttttgttcttttcatggcatctgcatttttttgctgtttcctgagtgcagtgtccattttgttattagccaatgtatcagtcaaggttcaagcagaaaagagaaaactggttaagtttaatatgaataattattactataaaaaggcattagagtaatggtggattggttatcaacagtgaagagatctctaaagaatgcagcaatggcggatacagggaataactcttgcccctagagctggggcagagaacccaaggaagaaacagaactacaagtgacttccccatccaggcttgaaatccagaccctactgaagttagcacaaccatggcccttagtatggcagagaaaatcactgaggtgagtggtaattgccatgaatctgcactctagggtatctggagaagttctacacttttcaaatctgcaaggctataaaagggcatacctgaggaagtcatctaggtggacatgccacacctgcagaaatccctgggacaccactctttgggatgccatggatgttgcctatgagaaggtgccatgtgctgctggttatgcgcattgcaggagctgaggtttagagaagctagatgtgggggaatccaggagcttgctccatgggagccttttggaagcagcacactggaatctggaagagaaaatccctcttccttcactgtccctccagagccctcttctggcaaagcttaacagtgtatcaactggcaagggagaatgtctaaaaggcccaactttattattgcagaacaggcaatgaagggtgaatttcaagttgtgagaaggtaaattaataactagccggctgtaaattggtttctttgttttagactattgaagtacaaagagtttccataaagcacatgagttcttaaatgtaagttttaatttatcaaacatatattgagtagagggaagaattacttgctctaatcctgacaccgctaagagctaatgttggttgcaaacctcatttatgccttatacctacaataggggttggcaattgtcatacacgttttgcaggtaaagaaagtgagtcttaggggtaagtaaccttatcaaaagctgtcaacaggaggcagagatgggatttgaaacaaagtctgtttaactctaaggccaatgttttattttttctgttatattttactgtattctccaagtagaaattcacatgtgagtatatctatttctgcctcagaggaactgcttgtggtatgaaggagatgtggagtcccagtgacaagggcatggggaagactgcttcctatggaaggagctggccttaagctgccaaattggaatatcgggttatgatgggcagagatcagctctcagtctcatctatctggtatagtggattctgattggatctggagcaacagagcaggacagatagagagttttacatttgctcatagttccagaactctaacaccaataatttcactgttttaaatgcagattgaatcactctttattgagcacttacttctgtaaggttagaggaaccatcatgttcactgtattagtccgtcctcacactgctatgaagaaatatgggaaactgggtaatttataaaggaaagaggtttaattgactcacagtttcacatggctggggaggcctcaggaaacttacaatcatattggaaggtaccttttcacagggcagcaggagagaatgagaaatgaacaaagggagaagtcccttataaaaccatcagatttcgtaagaacttactcactatcacaagaatagcatggggaaactgcccccgttatttaattacctcccaccatgttcctctcatgacacgtggggattaggggaagtacaattcaagatgagatttgggtggggattatgggaagtacaattcaagatgagatttggttggggacacagcaaaaccatatcagacgctttcccaagtcctccctcatttacttctcacaagaaccccagggagtagacattgttaaatccattttatagattaaaaaagtagtaagaattgtgaatgtttatattcccaagtttattagatgataaacagaagctcatggcttgaatccaaatttggcagactctgcagccaatttattttcattggccatatttacagtattagttataaaataataaggatcctgtatactaaagcttctttcactatcatcagtttgggatactgggtacctaatttacctcattttaaaaaataactttgtgtagcaatgcatggcatttcacccatccccagaatcctgactgccttcacctttgggaggatgagaatgaagtaatacagtttaaagatatttatttgtttgtaagcagtagagatgggaaacagcttggccatcaacacagaatttggtgaatcagatatagactgatcttcaggagaatatcaggcaaagtgaagaataagcacaggctattgctagtgttgtcattaaacggacacaaagcctgataactaacttccatagaaataaaaattcttggttccatgataattattaaaggtgaaaaatgccagtgaagtggaagctgcccaagcctggagtctacataaacttgtacgggctggaagtgcacaggctctgcacatatgtggggctatttacatgtgcagagcaatggggaagggcactggtgggacctttaggcaggtcaaggtctttcccagggagccctacagagagaacaaaatccattgcaatccactttctgactgtaggcatcaaatcagttattggaaagcaagttgtccgtggtttggtgaggctctcagatgggtgaaagtggccaatatggaacattttatcaaaactcagcaaagttgcccagagtagaagtaattacattttacaagtggccttgtttgatataacctcctataaaatagcagttctctaagacagcagtatcagtagaactgtgaatgtactttttctgtgagactagataatatccaaaccctcagatgagcatagatgttgctcttttactgaccttggatacctgcaattttccatcattcgttttcctgtctgcttggaaatggtggtctatttgatataatcttaattaatttattagtgaaatagcacattagaacatgaggaaaaattataaacatatagttcaaaaaataataaaaaaacccaagatgtattttaaacaaatgaaaagatgctcaaacttaatagtaagagaaatgcaaatccccaaaatgagatatccacaaatgagatatcatatcaaaatgctaaaggctcacaatttgatatattttgttgtttggaggtattaggagagagtcactctcatgcattgctgttgggagtgtattcgtgtgaagtctttgaggccatgttgggaatatctatcaatactacaaagacagctattcgcacatgcaaacaaggatatttattgtgccattgtttgtaagcagtagagatgggaaacagagactggacatcaatacagaattaattgaatcagatacagactgatcttcaagagaatttcaggcaaagaaagaacgtggatagtatgagtgaagaaaaacagaataccaacataatgcatctgtttttgtaaacatatagataaactcagggggtccacattgaagaaccaataacgatgcttcttctgcatttgaaactgggcttctaggggacagagtagaacccttttgaaggcttggaatttggtacagtgcgaaaagtgtatacaagataaaatcccaggaagtcttttaagctagttatttcatgttctattgaatttgtgtgctatattgaggacatagggcattataattgagtgttagcatcctagggggctggctgtgtgccctctaaatgccctgtctagccatgtcctctgtatgggaaggtcagggcacaagtcccttttgtttcaggggcaacagaccagcctttctcttttcctcccatccgtccatccatccatccatccatttatctattcatccatccacacatccatccatctgtccatccatccatccatccatgcatccatccatctactcttgcatccatctatccatttatctatccataaaatcattcatttatctgtccatccaaccatccatccatccattcatccatccatccacacatctatctgtccattcatctatgcaatcatccacccgtctatccacccatccacccattcattcatccacacatctattcattcatccatctatccatgcatccatccatccacacatttgtctcttcattcatctatccatccatccacccacctatccacccattcattcatccacacatctattcatccatccatctagccttctatccatccatctatccatctatgcatccattcatctatccatccatccatttatctattcatccattgatctatttatccatccatccatccatccatccatccatccatccatccatccattcatccatccatctatccatccattcatccattaatttatctatccatccacacatccatccatccattcatctatttgtttatctctctgtctgtccatccatccgtccattaatctatcaatccattcatccatttatctattcatccattcacatatccatccattcatccatgtattcattcatccatccatccacacatctatctgtccattcatctatccattcatccatccatctacccatacacccattcagtcatccacacatccatccatccatccacccatccatccatccattcatccatccatccaaatctatctatccatccattcatttatctattcaaccatccacacacccatctattcatctattcattcatctgtttgtccatccatccgtccatccatccatccatccatccatccatccatccatatatccatctatccatttatccatttaaatccatccacacatccatccatccatccatccattcattcatgcatctattcatccatccatccatccatccattcatctatctgtccatccatccatccatctattcattcattcaaccatcgattcatctatctatccattcatccatcaatccattcatccatttatctattcatccattgacacatccatccatccatccatccatccatccatccatccatccatctatacattaatccatttattcatctatcctcccaaccattcattcatccatttatccaagatggggagaaagcaggctcttattagtatgaagtgcattgaggggaatcgggggatgctgtatccgtgggtttttcccttcctgattttggccaagtgaaaaagaaatatttttcttttatctactctgaatatgtctacttgtttccttttcaaatcttcaaattcctctgccccattcccctttgatgcaataagaaaaaggtctgaataaggagggaagagggtgatataactaagaaaataattgatataacaaaaaataatgaatacaacagaacaaataaacccagagctaatatcttgtgctatgacctagtcacattcttttaatattttcctctatcttaaaagaaagaatagctgcaagtaagagaggaataaatcattttctaaaattaaaagttagtaggtggtgtataaatgaaaccaaagcccaagacatttctcctaattaaataaaatggaaataagactttaatcacaggatatctgaaaatcctgacacacttttagttgggattatcagctctgagcctcattagttccctataatcttctgaaggtgattaattaaacaatatgattatgaattcatagatttaaacgtgttaaatgtatttcagtccattgctgtttttatttatttttcttgatgctcaaatgatcccaactgtggtcagtgggcacctcttcatttagaattccatgttcttttaaaaattaactttttaatttggaggcagttgtagatttacatgcatttgtaagaaaaaacatggaaagatcggtgtacccttcactgggtttcctaatggtaacatctcatgacactacctataatgcagtatcacaaacagtattctgccattgatacagttcacttgtcttccaatttcccattttactgtgtgtgtgcgtgtgtgtatttagttttatgcaggcttagcacctgtgtaggtttgtgtattcatcgccagcactgaagcagaacaaccatatcacagcagggtctcttgctttacctttcataaccacagccattaattcctacaccactcccccgcaagtccctgacccctgccagccaccaatcaggtcttcatttctataattttgtcatttctagattgttgtatacatggaattatacagcatgtaaccatttgggattgactttttaaacttagcataattccctagagtagtatccatattgtgcagatatcaggagttcattcatttttattgctgaataacattccctggtatgcatggtccacagtttctttaaccatttacacattgtgggacatctgggttgtttccagcttttggctattgtgtcttctgtttctcttttcttgccttcctgtggattacttaaacattgttgagcatcctcaccctaagacatgattttaggatacccattctaaaaaataatttattgatactgtctttgagtgtatctttttgcatgatgttcttacaaagaacgtctggctctagatattacaatacagacatacacacgtggcttaccacagttcattggcattgagattttaccacttcaaaccaggtatggaaatccacttcgacttaggtccctttaccttctctgcttttaaatatcatcatcttgactatcagaaggtgttatgatttatgttttaatcatcaaatacatttcataaaactcatggaaaacagtatggtctgttgtattcacccacatttctgctctgttgtttttttcttccttccaaatgctccaagattccgtttcatattttcattttttaaagtttttcttcatctgagaatgtctttattttatcttcattcctaaaagatatttacattagattcagaattcacaatgacaattcttttcttacgtcgtgataaatgttaggctactttcttctggctcccagggtttcagatgagagatttgctaacctttgagtgggtgttccctagaggtaacatgttatggttctctggctgctttaaagcttttactgtgttcagattttagaagtttaattatggtgtggtttaatgtagatttctctcagtttatcatattgagtgtttgctaagcttcctgagtctgtaggtttttgtatttctacaattttaggaagtttttcagccattgtttcctctcatactctttcagttccactcagtttctcctctctttcagagactctaatgacaccagtatcaaaatttttattattgtcctataggtacttgaggctctgttcactttcctatcaatctcctttctccctgttgcacagattgggtaccacacattgatcagctgtcaggttcagtggttctctcctctgccatctccattcttctactgagaccatctagtgagttcttgtatttgcgttattgcattgtccatttctggagaatccatgtggttcttttttataatttctttttattcattgagattttctgctattttgtttgcttcaagacaatttgtaattgcttgttgaagcattttttaaatgatgggtgctttaaaacactagccaggttattccaatatctgatgtgtctcaatattggcatcaattgattgcttttcttaattctagttgtcttttctttggttatttttataatgggtggttttcaattgtatcatgggtattctaagcaatataataggagactttgagccctatgtaaaaatcttttatttttgtgggtagtcattctacttaggcttaacacacagatcttggcccactttgtgtgctgtggttccaataagagtttaattttggtttatctgatgcatctgggactccctgatgctgcagtatgaaaggacagatgagatttctccagtccagctgcctccatgttggggagatggagcctccagcagttggagaagaaggggacttcttaggagcccaggtctttgttgcatcaggagccatcctgctgtggggcagccagtgtttccaggccaggtcacttgatattgtggaatactccttgccctgtctcctgggtgcttgttgtggttcctctaccctcaggggaagaacaaccatttgcctggctattcattaccagtgtcatccgagctgatccccctgttggtgttgcaggggcagcttggtttgttggaaggactcctggtccctccagagaggcagcccagctaggctgccttctgttactagaatgttagaaatgtgaggtattttggctggggattttaatgtgtgtgtacgtgtgtgtgtgtattctctatttgcagtttttaaagattttacagatcttctacatgtgttgcattaataatgttattcaacctttgcatatctgtatgcatttttggttagtatagctggcgtttactgagtatttgctatgtgccaggcctggtgccaaggtattggaatactaatttgtcttaatacttacaagagtctctatccctatttttttttttttttgagatggagtcttgctctgttgcccaggttggagcacagtggtgcaatcttggctcactgcaagctccacctcccgggttcatgccattctcctgcctcagcctcccaagtagctgggattacaggtgcctgccaccgtgcccggctaattttttgtattttttagtagagatggggtttcattgtgttagccaggatggtctcaatctcctgacctcatgagccacccgccttggcctcccagagtgctgggattacaggcgtgagccagcacgcccggcctctatccctatttttattgaatactgaagctgagagttcaaggtttttctctgtttgctgtgctggctgcttttcagctcctgtgccattgtgagggtctcctagtgaccctagggagatgtggttagactctcaaaccctccttaagcattgtccctttggcatttagactattttcagtattaaatgtaataatattgcaatagacatcttcatggaaataactttatattttatttaaactatttccttaggatagagtccttttatcttgagagagtaaagcatgtgcatttgttatggatcagtgactgcatttttctgataccaaattattttataaaagtcttatgccagtgtactctgccagtagcaataaatgaaaaaatataccaattttattctatcctcaatagtgttgggtaccattaaacaagtaagtattagttgagaatgtatctttgaggaagaaatgtgggcaagcattgattaatttggtcagtatatactggggacatatgctgtacccagcagtgactctaacactggcgagacagcagtgaacaggcaggtagcccctggatggacagagtcaaggagagaggtttcagaggactcacctgtgatgtgagagcattggaacttttcatgttattgaggaaggcattagctggcctgcaggcagatctttgctctggtggccacatcatatacagtccttgttggaagatttatcttaatataacagctgaataagagacatatccaaatatgcttcattttgcaggctaattacaccttttatattgtggacaaactaaaaactttatcagaaacactgctggaaatgtccagccttttccagagaagtggaagtggccagatgttcaaccagctgcaggtgagtggttggtctttgccaccgagggatggggagctactgctagggcatgtccgagacatcagggctgccctgtagaagattctacagagtcacatcaggcatagtggttctagttgactcatataattgacataaaactagagatgtgtgaaaactttttgtgaattttcagtattttacccatgcaaaatggtatcgttgtgagaatgattaataatttaatagtaactttttctttaaattctttattaagcttaatgctttttagattgtttgcatatttttgaattgcaggtctattcaacaatcaatgatcatttctgcatattctgtattgataacttaatatttttaaaaggaacgacttacagtttagaatggcctgactccattagagtctgacaatcattaatataaaactttaattcaggtagatcacctaataattttttgggcatttgtgtagcttcaacttaccttaactctgataggatgagaaaatatgcctgcattttaattcatgtttagtttttttattaacttaccaggtaagtagttcagagtatggactcaggagctagaatcctttgagtttgattcccggctcaacccctgccaccagttgtgtgatcttgggctagtcactgaagttctctgtaccttgagtttcttccctgagaaatgaggaagcgatagtagttatgaggtataaatgggtcaggatacatggagcccttggaataggttttgacacagagaaaatgctactgtgtgagtctgagttttccaagaagcagatgccaagacaggattacatgtgcaataattttattttgggagatagctgctgaggaaaggaagaggaagctagacaggttggaagcaaggttgtcagtggtgatgcaagtctgaccctgaggaaaggagagagggagagggtcgggtggaagcatcctggtgggccctgcaatttaatggaaatcagataaggccgagagggagtcacagagctaaagtcagttatcaaggtaggggtcccatgtcagtggagtcctgtggctcctgggagtgggcctgatgtggtggtcattggtgagagacagcccatgggaggcgtggcctcagggcaaagtgccatggattcagagtgcagcagtgggccctgccatttccgtttcctgcagttggaggtctgcgatgttcattctcacagcgaccatggccatatgtattagctagtattgtaatcttctttaatttgtttgtgtatggattaatttgttaatacagacatcagcaaacctttgcagttaatgggacagatagtattttagactagataaggtctctgctgcaactatatataatctcatgcaatattataagcaccaagtcgagaatgtacaaatatctaggagaacataaaacagtgcctaactcggcctcaaaaatagggcagctccttgtgaagtctatggtgtacctgagtactacttactaagtagccatgtcagaaatcagtcacatgttcaaccagttgaagaacttatcttccaaaggataagacggcgtaagttgttcctctatttcttagctttgggatcatgctcaagggaactcgcagtaccttgggtttgtagtagtcgatgtgtatgttgcaggcctggttctgccactagatggagtggttagagtctctgaggaaagccctaactttgctctgcttccctgttccatcagtaaaagacaacagtaccctcctggggatgttgttgagattaaatgacatgatgcataataactaccctgcacattgactggcaaatagcgaatgcccagtgaaggaagataaataagattccaaaaaagaaaagcaaacaccaaactttcataataaaaccttgtcatccttagacaagattagttaaaactatcacatgtaataaggtgaatgtgagaaataaaagagctaattacaaagggcacatattacttgagaattcctatatggacctcttgtgctattaggttatgtgctggaccaaaatctggatagtgtacaaatattctccaagaaattggcaaattccaaaattaattcccagtcattgatcctgaggcagagcctggatacatcagtatctttccctctcagcttcttgttggttgttgtatgttgtaagtgtcaggcagtgcaatgcaagtacatggatatcaatggcaaaataaaggggcaagatgtcatgaagttgatgaaaaaatcttggagaactctccacagtaaacaatttgtctccaatcattgaaaaatgaggcaaagtcacaaccatcaataataacgagagaagaatggtacagatgaagcaatgaaagatgcttccgaagatgaatagccaaacattgagagagggtttgggaaattctgaaatcctccttcagagttttcataacaatgaccctctgtttacaactggcctctgggaaaggccatgcaaaggaaaggaatcttatagaaaggttcattatataggttcgtttgaaaattttgccaaaaacaaaccacttaattcattctttgtttttagtattaacacataattacaactacaacataaattttcataattgttgattttgtttttcaaggtaagcttctaataagatattatcctgttatttattgtggtgttttaaaacttcttttaagtggattcagtttatgtgccttgttcctttgtaatgaaactttgaataagtctaataagtattattcaataatacgaaataatgcaattatttttattaagctatattatttttctttaggaggccctgagaaacaaatttgtaagaaactttgtagaaaaccagttgcacattgatgtagacaaacttactgaaaaactccagacatacggtaagtgtgctgatgggcatggtagtgttcttctgcccatatggctctgccacttgggtgggtcctcccccttgggccatggcattgctaggtgacttccagcaagtcacttttcctctctcagtttctattttcttatctggatcctgaagggcttgaactaaatactccccaaagtttgtttcatacctgaagttttttcgattcactgattcaggacttaactagtaaagaacctagttaaaaaggaagttttctgattcaaacacaagaattgtgaattacaaaacaagtttataaaagaaattattattattattgagttaaaagtaacttgaaagccattgcatagatttgaaaatgggaagctcagataaaaacattacctatcagtaaacatttattgtacctctgcaattgatgtatctgtgaattcatttaggtgttttaacaaacatttgctggacacacgaggagagccagttccatgaaataatccatagaggggcataaaatattcctgttccaccatgcagtgcagagaagaagatgaccatgcttagaaactgcaacactgtggcaaaatcagcgatcagggccctgccagagaagctctcaggagcctaacccagttggtggggacctggagtcagagggaggatgggtgtcaggctgttccaggtccctggctccctcacactctgcttgtacatgggaaagggtttcggatctgccttacatatgaaagttagaggaaggcaagacattttattcggcataatatagtacttccctttaaaaaaatttctggtgaatgcaatacttaatattttacttcagaaaggttaatcatattttaaaatgtttcatattttaaatgcattacataattttttcaattaattaaaacacctttaaaagaagaagtagcactggaaagtttataataatagtgtccccatcttctgttgctggaaccaaggactgacatgggtctgagagatttcctgtgtggaacgcagatgtctcctgagtttgcgtctaccatggtgctagtgttaatgcagatgtcttagagtgtgaatcgtacctgagccacatttgttcaacatgttgctgcttagccaacagtacatttgaataggttttcccacatgtaaacttctattgtaaaattaagagaaagttccccagaaatttagaacttttcctacaagtgtgttgggacacagaatatgagattcacatggaattttgagatccatgaggtgtgatcctctcttctttctgcttccgcctgacgctagagattgaagaccatatcatccaggtgaatgttggttattttccatccgaccctgtacagccctctgggagcaggcacagagtggggtcaggcattcacgggtggggtggcggtgggggattgatcactgaccagatgcaaatctccttttgtaactatgctaacaaatgaactcaccttactgcatgcacccttttaaaatttatacctaggtcatactcacttttcttcatcctataaacagtacctggaaactgaggtgactatttgaagatatactgatgcaacttttgggaatatttgcccaatcatgctgtcatttttattcattatataactttcattttatttttattttttttagacaagagttttgctcttgtcatccaggctgtagtgcaatggtgcaatctcagctcactgcaacctgcgacttctgggttcaagcaattctcctgtcccaccctcctgagtggctggaactacaggtgcgcaccgccatgcccggctaatttttgtatttttagtagagatggggtttcaccaagttggccaggttggctcgaactcctgacctcaggtgatcctcctgcctcggcctcccaaagtgctgggattacaggcgtgagccactgcgcctggcctcattatataactttaaaaaataactttttgctttattacaaaaagtatatatgtctgttgtagaaacattagaaaatacaaataagccagaaaacaaatccacctataatcttatcaccacagatagctattttaaaagcctcggagttcttttttaggtgaatttatatgtactcatatgaagataagaatatgtattttcacaaaaatgattatactgttcacataattttgttacctgagtctcctgagtttgcatctaccatggtgctagtgttaatgcagatgtcttagagtgtgaatcgtacctgagccacgtttgttcaacacattgctgcttagccaacactacttttgaataagttttcctattcaaaaattaagattattataaaagtttttcatatctataaatattgactgttactaagaaaaagtcccttcatctagctctgccttccatttcactccatagtatgaatttaaaattacttaggaatttctttgggatcggtccttatatttctaactgatacacctacggcagtatttcttgatttatttgttacaggaattatcaattgatttcttgttctgaaagatgcagatttagttttgtactacatcatttccctgatcagttgctcccactatggtaatatgaccattttagtagttataaaacagtatgaggagataaatgttgttcagtgcagagtcaggctatgcattataatgacattcccttatttaccatgtttcccttttcctagagtttcatgctctcttgctactacatgaaacacctgttctccattgctcccagctctgtgtgccaacacatcacctttatgttgagtcattttgtctgtgcagacgccacccagaccccctaccatgctccacctgggcaggctagccgctcctgccagcacccagctgctttcctaggaattctctgctctgctctcctggggtggataccatgattcctgggctctaggtcctcatttttgttttgttgtcatgttttgtgggttcatattaatcagtgtagtcttgaaaaagagaatgagagaaaaaattcctgagtgattttactcagtaaagtaaaattacatctgaatgatatgtggaaatatcctctatttcattaccaataattttgcatctcttctttctctctcctttttgcttttaatcagtcttgtcagagggttatcaatttttattagtcttaaaaaaacccaccgtttatggccttatatttcatttgatttcattgatttctgctctctattggttttttccttttgccctgtgtgtgtgtatgtgtgtgtgtttggtaacttcttgagatgaatacttaaattattcatgtccaccttgtcttcttttcttttctgatatatatatatatctttctgatatatatatatatatctttctgatatatatatatatatctttctgatatatatatatatatctttctgatatatatatactcatatatatatactcatatatatatattcatatatatatactcatcactagacacttccctctggcattaccttaactgcatctcactaattttgatatcttgtattttcactctcattcagttaagcatattttaaacatgtggtgtaatttcctttttttttcacctttaggttatttgaaagactatagcttaatttctaaatatttggtattatttatttatctttgggttaatgacttccagctttacttcacagtggtaagataatgtacttcgctaatacgatttcatttgcttaacatttatggagactcactcaatccttgcacacagggtcagttttggttcctgcattgttgggtgccgtcttgagcatcctcactgtctccttgttccatcagctcttaagaggtgtgtgtttacatttctcgttatgactgtgggattgcctatttctccttgaggttctgtccacttaggctttatatactttaaggctgtattgtattttctgttgaggacttgtttgagacatttatattttcctttgtttgtatttaaattatcttccagcctctcccccttcttttacttctttatttctttccggaagtttttctgtgactgacttagttatggtttcttatgagaatcctcttttggctctgtagcatttcttgaatcagtggccaaatatcttatatttggggaaagtcttggctactatcttttgaagcattgcttctgatcacttctctctctgctttcctctgcaactcttctaaacaagatgaaaacttttcacagtgttcaatgcttcttatttccttttctatataatccaacctattttctctttatacttcagtttgtgatttcttttcttactagttttttaatcgacaaattctctcttcagctgggtctaatctgctattaaacataccaatgaagttcttcatttcagttgttgcattttccgcttaaaatttaaattttcttattttaaaatagtttttagctctctggtgaaagtctattttcatctaattttggacacaatactcacataagtctattttcatctaattttggacacaatactcacattttggaagtgcatgtttgtgagctttaatacttgtcttttgtgggtatttttttagtctatttttctcttgcttttttttttggttatttttcttgtcttgtctccaggaatattaaggattaaaaaaattgaaaccagacattataaatggaaaattgtagaaataaatttgagtctcctgatagtgctatattcctctagataatgttattttcctgcttgtggcagagagctagggcagggccacgttttcctaatccatttggggatggagtggattgatggaggtagacttcagccttagtagggaaatttccagtttcctgtactcctggatagattccctatttgggtggggtggggatctcacctataaagctgataccgattagggcccatgtagatccagagctcaaagtcccgtggaccactggagactcagcctctcagtttttggcaggatcaaataccaggcttcccaaggttctcttttctcttgcatctctgacctttgagcttttgctgccttggtagctctttaaagtctttatatagattttcttttttttttaatttcaatagggttttggggagcaggtggtggttggttatatggataagttctttagtggtgctttctgagattttagcgcagccatcacctgagcagtatacactgtacccaatgtgtagacttttttaaacttttaaactaaagtctttatatagattttttaaaggccattcatattttctggttgttcttggaaggaaacttcatctgccccacattgtcctccattactctaagtggggtttcctcaatatgacctttcaatctgaagacgacagctcttcaattaaggggagttttcttgtcatcatttctttgatatttttacctctctataaaaataatgctattttaactttagtttattttaaaattactattactgttttctatttgtttattttgagttctctctttcatgttgaagggttcacttaaatgtttggtgatattatgtgtgaagcattaaaaccagactgaaagtgatttggtgagtagaagttattgtgactcagttcatatcagtagttctcaactgaggatgattttgtcctctaagggatgtgtggttatgtctggagatatttttggttgtcacagctggtcacagctactgccacctaacaggtagaggctaggggtactgctaaacatcctacactgcatggaacagccctccacagcaaggaattatgtgcccaaagtgtctgtagggcctaggttgagaaactctcatttagagcaataagatggagtcacttcttgaaaacaaatttcaggaggagacacgttggaatgtcaaatcctctggtctgttttggctgatgcctgccatgtctggggtcctcaggtatatacactgaatggtgaacaatcgttaacttgtattattctctggggcttggccccacattagtgtagaattttatactatgttgttttatgtccacctatatgtgaacctcagtattgtttttgccctttcagacttaaagtagcctgtgtttctttaccacatagggtttcacatgggccctatgtgtttttcttggctcatttttcctatatattgtgagatgaagcaacccaataagagctgtgattctaggactcttaccagaggctttgcccattcgtgtcctgtcctctgtaatccatctttctctcatagcagtgccctcatcatttaggttggggagtgtactcaaggtctccaaagtgatggaacatgcagttaatactagaccacattttatttttattatatctagtccattgtgcaggaactattacccaacaaagatattgcttctttcctcccagaggagggagatctgcccagtgtcctaagacctaagagtttttgtgtggagctgcttttctaagttgtagttaatgccacataataacattttagtcaacattgatctgcatacatgatgatgttcctataaggtcataatgagctgaaaattcctactgcctagtgactttgtagctgtcagcacattgtagaacaacacattactcacttgtttgtggggatgttggtgtaaacaaacctactgcactgccagtcatataaaagtctagcacacacaattatgtacagcacgtaatacttgatcatcgtaataaactactgttattattggtgtatgtgtttaattcaattcagagtgtacttcatatatatatttatgagttaagtgtaaagcagcctcaagtaggtccctcaggaggtatccagaaaaatccattgctagcacaggagatgacagctctgcgtgtgttagtgccctgaagacctccttccagtgggacaagaggtggaggtggaaaaaagtgatattgatgataatgaccctgtgtaggcctaggctaatgtgtggttttgtgagttagtttttaacaaaaaatttaaaaagaaagaaaaaacctaaaaataaaaacaagctagctcatagaataaggatgtaaagaaaatatttttgtacagctgtacaatgtgttttgtattttaagctaagtatgattacaaaagggtcaaaaagtcaaaaaattaaaaagtttataaagtataaagttatagtaatctaaggttaatttatttttgaagaaaaatttaaaaaataaatttagtgtagcttaagtatacagtgtttataaagtgtataaagtttataaagtgtacggtaatgtcctaggccttcacattcactcactgctcactgcctcatcagagcaacttccagcctgcaagctttattggtgagtactcaatctaagtgtatcatttaataccatataaaatctttcatatcatatttttattataccttttctatgtttagatatgtttagataaacaaatccttaccatcgtgttacaattgcctacagcattcagtacaataacattctatgcaggtttgtagcctaggagcaataggctatgctatacagctaggtgtgcagtaggctgtaccatctaggattgtgtaagtccactctgtgatgttcacacacgatgaaattgcctaatgctgcctttttatgccgcatttctcagaatgcatcctcatgattaagtgatgcatggctgtaagatgtacctatgtctcccaattatatgcatgataagaaagcttaaagccttctccaaagcagttccagttctgctactggaagataatgaaagtcacactatagtgagaccaagtcactcttcactgtgtttaacatctgctgttttatgcagttaaattgtttaaccacgcttgctaggcaagcttatagtgcagcctattccaaataacaaatggtcagcaacacacagatacagtagaaaaatgtctccagtttgccctacaccgagaaatttaacaatctccacttctccattaaaaaaaaaagccccccacaatgcacaatatactttttggttttctattttctagttgttatgcttactttcatgcagaaaagttaattaaagatattcagttggagcctcgctctctccttatagctgttacatgataatagttagcacttactgtaaatcagtttatagtgtatatataaacttcaactacatttacttttcacagcaatttcatgggtaattttgcttttcttatgctacagatgaagaaagtgaaacttttatagattaaataactatctaatgtgaaacaagataaatagtgcaattgccatgggagcaaagccatgtcttgtcagctttgaagcaccagtgacctgcactcctggagcagtgacagcaggggtcaatgccacttctatgttcccaaaccaggttaccccagcccatgtatttagtgggtcttgctttttgatgcctcccatggctataattgcccataagaatatccaagtttagcctcatacccacactatttagaaatcagaagaaccctcaagggagttttcatcacagccattgcataccccataagtaccagtcattacagtagcatttcacagcactgctgtctccagaacctgatacctcaatacttctagcaggtactaggtggtgttccagggcccatggaaaatcatggaataaacatgatgaaatgtccaaaggaatcacttttgcagcaacattttggggaaaatgagacataattttatatactgaaacaaatgagtagactagtacaatataacattttcacacacaaaaatcagttatttcacggaattttcaccttctcaaggctcatccaggatcctgtcttcttctcgcacacccttgtatccaccctcctccctgggtggagtaatttgagaagtgcaatgcaacaaggcaccgtcagcacagtatgctggagtcaccagccaagggctggttcagagatttggtgccatcttaaagaaggaaatagatagagaaaacagacaagaaatgttaagaactgctggtgtcagcactggctccgcatcagccagtccaggccagctgtccagccccagccctctgtgttcccacagcagataaattgggatgctgagtgtttcattttggttaggtggaggtggggctggaaatctggaaagtcccctgccacacaggacattgctttgtgctgtgctacctgaactgttattggagtcttaaagcaagataaaggcagtggagtttgtctcctcctctactggaaacaattttatatagtgtattaataaccgttatactaggaaatagttattgagtgctctctatgtgccagacacagtgtcaagcatgttacacattattctacttcatctttggaaaaagaccattgagcagatgattatcatttcccttccataaagagggcgaggattattcagcctcagatgcccactgaggggtggtgagcaggcacccaactccatctgacccatagtccacaaggcccagtagacggtggagatcctgtgtccctatctccaggccaaatgggcaccatgccaagataaattctttaaaccaagccacatgacctcttgttgagtgaggtgggctggaccagactgctagccaccctctaatccttccacgtcagtgctgagggaaaggcctcactggtgggccttacagtggctcggaggctcagaacttttccaaggaactctgagatgctgtgtcccagttgggggactccggggactcatgacactctgaggcagaagactcgacgctgtggatccttctagctcctctttgattgtgtcatccaaacagccaaaggtccttttctgccttaaaccttagaaagtgttgactataaaactaaatgagaaatgaaaactgctgtgcaattacatgtttctgctattgacgccatttgagaactctggcttgagctattttcttctcactgatttttccaatgagcgtgttttattcttctatgaattcagtttgacggtcttaacttaaccaggcccttcaggctctaccaaattgggaattacaggaggatttctatgagatgtgtgtgtgagctctgatggcaatagttaattgatcttatttactaaatggctttatgccttttttatatcttttatttctctctggaaaacagtaccaagattttcattctttctgaaatatagatgataaatctcaggcttagagactggctctttcagagccctacaatatttggtggaatcaagaacccaattctttgaattctggatcatgtaattcttctactatgtgttaggcagggctgtctggaattcctgatgtttgaatatttttaacacacagtaagcagaagtttcatatggttccactcaatataaatgcagcctggtgtatttgtaagaaggtggacccaaaagctagatggcatgtgtttgaatcatggttttgaaacttactggttgcttatactctttgtgccttaattcctatactttaaaatgaacatgccactagcaattccctatagatataagggttcagtgagacaatacacaagtgcccagaattgtacctggcacaagactgacactcatacagtgacacttcactattattgtagatatttagcaaaagcttaattatcagaaatccagccttcccaaatccttacactcatgtcttggcctgagatcggcaaattactggaacataataacagcagttacaacataatgaataacagtcttttctttgagaaactgtgcaatgtaggttgaggggatgaagggcagaaggagcccgacacttcttgatgttgtttggcagcttacatgttctcatccatctgaagttggcagatggaaactaatctttccttaccagggaagaagttgaggccaggacatgtcaactgatttttctacagacctcaggatgatggagatgcatcttcatgtagtttcttattcagggctggcccccctttacagagccccaacacccctttcaaacatgggctgggtgccaagcaagcaaaacccagacttaatccagaaaccttggaagccaggaggatctgggagcagggaaaccagtagaggagggaagcaagcatgagaggcagaggcagctgtcagtgggtactgatgctgccatgtccggggacaaatgcccacaggatggcaggtaggctccaagcttcgatggagggtggaaatgagcacagggagcagctcacatcatttggaaagttgagtgttcaggaggtcagtgagatacaggagggccagcaggaagcagtgactgcacacagggccagggatagactgttgtctgtcaccatacatctttcctgctgctttccctctggaggtcatgttctgggcattcccacgctgccttgctctagatcatttggtttttccagctccttcctgaaaccagagtgaaaatactgagatatcctcagccttttgccctgaaaatgtttgatgtcagcattcatagccaaggtgttgcgactttactctgctgctctatttatgtttcgaatgcacagatccaggacaaagactacacaaggatttggtttcctcagtgtccatgctccttgataattgcttttgcaaaattaatttaataaaatgactttcccaaaatgactgcttcagggaaggcgtgttttttttagaattgcttgactccaggttggaactttttttttcccctgaactctctgtgagagggtctttcctatcacatgtagactttccttctgttgtttatcctgttgtctccaactgtgtttccttaggctgctgtattaccctttgtgctttaactgtttttttttcatgtacatgtatcagtgttacagagcatgtgtataaaagtgtagagtttacactcagcaagtaaatgccaaatttcacatatgaccaaaatttgactcttttgagcaattttttagtggaagaattcatattcattttcaaatccatttgcacaatctccactatatgagtggtaagcactggggggatacagaagttgatgtgtcctaatctgttcactttcctcaggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtaagtactcaatgaaaaaatatgttcgccaagatgccaactcctgtaagttgtcattttgggagtttctccctaaaggtgtcttatgatagctcagaaagaaaagaagtcctttccagataaaacataaaataaagcagaactgtttaccttggataaaacataaaatgaagcagaaatatttgccttggttaatgaaaagttgtaccttatgccatagtgactaataacgttttcaccatcctaggaccaatgctatttactgcatctgcttttacccttttataacatcatgttctagttaaatctcacaccataagttatattattcccgattaaagttatactctaatttcctgcatcacctttccttttatcagagtatcttgatatcctggttggggcggagagcaggcaatggccaactctgctccattatttaattgttcacccattcaagataaatatggtggtgctctcatattcttttggaatacacattgaattatttttaattgaggttttgtattagtttcttaaggttgctgtaacaaagtatcgcagactaaaacaagagaagtttattgtcttagagtgctggaagctagatattccggatggagacatccactggtttttcctgcgggctatgaggagagaatcttctctaggcccctctcattggcttgtaggtggccatcttctccctgggtttctgcacctcatcttccctctatgtatttctctgtgtttaagtttccctctttttataaagacaccttcatattgagttagggcgcaccctaatggccctcattttaacttgattactctttaaatgttatctccaaatatagtcacattctgaggtactgggggttaggacttctacatatgaatttagtaagggacacgatttagctgtgataggctttatgcatacaattcaaagaatccgtgtggcataaaatagaatccatgtatttaagttatgaatgataagtaaccccaaagagatggattctgcacattgagttaacatctgcaatcaagagaaaaaaaccctgcaaaaaacatctgacaaataatttctttgtgttgattataccacagtttgcttttatgaaaaatacaaagcagcactggacagggaattaagagatcttggtttaggcttaccaccaattgcctgtgtgactgaaagtcagctttgccactgcgggctggggctctgagtctgcaggagtggagggctgtgagtctcaggctcctgcaacttttcctgtctcacccagtgtaggcgtggtttgagccactccctacagtgtggtaatgcttcgtttttccttttctgccactaggtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctgtgagtagcctggggcaggagccaccgacagtgagaagggccttgcatttgtctagctgaggagagaaaactcagtttttctatggttatttcaaaaagcactgttaaaaaagttcaccccccactttttaatttcgtaaggttcattttttttatatgcttgtactcttcaggtagaagaaatataatggttgagataatacaatcaagtgaagttttaaatttgacatcaggcatcatctatagttttaaatacacttaaaataaatttgatgaataacattcacaagggctgtgcatgtccaacaaaagattccacttacctaaccttgggaaaactgagggaggttattttctctgcagtgcaaatccttagatataggctgtatactggacagggtggtgaaggattccatacaggccttgaccatggcttgggtacccatgaagtaatatgagaacatttaggagtttgattgtgtaatttggctgctgacatctataggaagaggggaagctcagtgaagggctggagcagctggacaagaggacttggaggggacatcatggaggcattaaaacagccatcagggaggccaggcaggggatgtttgcagagaggacgggagactatggtcggactggggctcagtgaacctgagggtgagcttggacaccttggcaggttcagacaatgaacagacttcaaagctcaccaaagcggggtgagccgtattgctgtgggctgtggggctcagcctggatttcttactttcctcatggtgcatactgttctcataagcattctgctcccacagctggcctggctctggataatgtaggtcattcatttgcaatccctgcatgctggctctgatgcagggcctcaggaaggtaccaccttcctaccctctctcaaaagcacactaggaagtaagtggctgaacatgaggctactgaagggaccggtttgcgtgttctcttagttatgagaacagggacaagtactcatccttcatcgaaacactgccagtaacaactcatggcacctcccacccctgactggggcagagccatggaccaccaagcagaagtcaggactgcctctccaggtgactgggcgacacacacgtgaggataggtgacttgatgtcttgacccctccttcctgtctagtgataggctgcatacataatagcacatccacacattttttatgaaaatgctggttgtacaggaaggactttcccacagtgggaggataaaaggctgaagaccacctgattgaactcatcttgggatagcctagtgtggtgcggtgaacaaaaggtcaggaagaaagagactaaggcgacattttcactcaggggctgccttgttaggcagactgttagtaagcctcttaacttctttctttgtaaaatgatagcttttctttcttttcaaagtgatgatatttttggctatgaacattttcaacctgtgattttctgctcctaaagcatgtttcttggaggtgatagcagcaggagcagaaccgaagaaaagtgctgttgttggctagttgtcatgcacagacacttcatacccagtgcaaacacctgagagctctgagaattagtgatctgtgttagatactgggagaagccgaagttttattatgctcattttctaaaggcaaacctgaaatctattgcattctgacaatctccttctagctccaaagtatgctatgatctccacccatgaaagagcggggttgtgcttacgtggatgggaacatgacaattccctctgctccggttcacaggaggagactgggggtttactttgtccactctgacataggatatttcccaagaaggcacgatgggaagaacagcatacactcctacaaatgtattgatggaaatccagaaatggcctgagtaatcagttttcaattcctactgatcatagtgtatggctaacagacattgcaagagagctagaaaggaggaattgagggacatggatggagacatattttttcaccccttgaagataaattctgatgtatgagaaacattccagcctaaaacgttggaatgagtggaatacccaggtatgattctgatctcatggaattacctctcttattctactactgggatacagcaatataactcctcagaagtattgctttatttctttgagaaagatgaagaagtattttaattctctgaaatatttaaatctttgagatttctcactgtgctatatccatcttttatctcttgtttcgaagtctccctttcttgagggcttagagtacctgcagtgattgaaacacagtctgagatctcgaaagaactcagtcacttgagtaaaaatcctaaagcacagtttgtactgtagacaatgtttgttaaaatttttttagcagtttcctcctgcttactgaatgagctacatattcattaatttatgaatttattcaatgacttttatgtactatttgtcagtctctagactgaataagtaaagaaaataagtaaatcagtaaagaaaataggtgaatcagtaaagaaaataggtaaaaatccctgctcttgtgagacttccagtccagggaagcagaggtgccacaaatacaattaagaagacaattgcattgaatgataggaagcaggaagtgccgtggagctgggaaataggatgagcagggtcagggacactaggaggggaagatggaattgttaatgtggatggggtagaccctatcaggaaggtagcattttaacaaagacttgacgggatgcagaagcacaaggggaagtgtgttctagggcagaggaaccccccatgcaaaggccctgtggtaggagtggcctagggtatgtgtgaagagtcaccagagcagagtgcacaagggcaagagggtgggagatgaagtcaaagagctgattgtagattgcatggttgcaggtgactggagtggtattaaaagactgctggagagtttcgagcaggagtgatgtcatcatctgacttatactgtaaaagtcttgctcacgctgttgggtggaaaagagcttgtaggggtatgtgtgggacagagaaatcatttagaaggctgttgtaataacccaggtgagagatgatggtggcttggtccagtgtggtagcagagaagctggtaaaaagtggtctgattcttggttgcattcaggaagtagaggcaacagaattgccaaaagatttgatgagggcgtgatagagagacatcgaggaagattcccctattttggtccaagtaactggattgctggaattatctctaactataatagaaaaactgtgggtagaggtttggaggataaggatagaaactcagctttggacatgtctagtaggcagatttgttcaggaggctgggacaatgtatggatctattaatttaggagtctccccgattttgatggcatttagaactctaagatattaccatgggaaggagtatagatagaaaaatagagagggccgagaccaaatgtggggcccctcccatgaagaggtaaatgagaagaggagattgagaaagtatcattgaggcaggaggaaaacctacagagtgtggaatcctggaggtcaagctgagcaaaagactccaggaagaggagtgatcaagtgtgtcatatgtggctcatgggtgaaataaggtaaagacagataatcgaccattggatttacaccatccaggacttcatagagagtagcttccatgatgtggtgagaatgacggccaaattagagtggacagaatggagacttggaggggtagaattggagagtgaactcagacagctctcaatgggaagaaatgggaggtgacttcttcttcttcttttggaagaagtcttttttttttttttaaatataagatgctacctggggaatagtccagtaagatgggaaaattggtagtgtataaacgggggggacagctgtgtcctgaattagtcaaggggaagagacctcaacaagtggagagacctactataggtgggaacatggcaattcacctgtggtaacaaaacctgtttaactctatttaactaaaaattttccacttttcttgcacacagatctctctctctcctccttttatttttcatgtagtatctaccagcagctcatggaactaatgtcctgaaaggcatgcattggaaaatgttgctggagactgtagagatggataggcagcagcagtttttgaaattgcatgttcctatcaaccccctgattcataggcagttatcatagaataattttatgattggaactgtagtgtgtacttcatgaatataaaggaattcaaatgttaatgtgttgcttcaaagaataagccaacttaataaacaggttttcagaaaacaaaaaccacaacaatatcctgggattgttttatatgcacaaagaatatttatttgaaaggtcacctgttatttcctctattgctttttggctgcttcaattcccaccaccctggggtgggttcaagagaaggagaaatggagcgtgctgggtcaggctgagtgatggctcccgtgaggcgttgcatctggactttgatgtgtcttgggcaaagtggagagtgaagggttgacagccactcatgcttgaaatgttgaattcctgcttaaaaaaaaatcagcttgatccacaacagaccagtgagaggacctctcattttatttattttgattgtttctcttccttgggctctacttcaggtaactttattaaacacctctctcttccatttagtcaatagtcattgttctcagcagaaattcccattcttgatgaccctcagcgctcagagctgctggaagccccctctgttgcccgcaggctctgtcctgtcccaccaacgcaggtaatttgttggtgataccaactgtagtgggaaggagaagaaaaaccctcattaaattttacaattcttcactttctcaagccccacacagctcttacaaacttatctccttgctgggcagaggaggatggtttctcattaaaacctcagcaaatcgtttctccaatttgtctatgttctttccctcaacagcagcaaagtaatctcttaaaattgtatcacatttaaaaaaatcatctcacttattctctaaaaaccttaaaagtacagtggaagaaattgagacgctgatagggtaagttatttcccccaagatctcacagcatcttaatacccctcactccccaaataaactattaattgccacttgctacttttaagcactttgtgcaggatgcttggtcacttggctgccatttcactccattgtatttgaaagtctggtatgttttcggccgggtgtggtggctcacacctgtaattccagcactttgggaggccgaggcgggcagatcacaaggtcaggaattcgagaccagcctggccaacatggtgaaacccggtttctactcaaaatacaaaaattagctgggcatggtggcacgcgtctgtaatcccagctactcgggaggctgaggcaggagaattgcttgaacccaggaggcaaaggttgtagtgagctgagattgcaccattgcactccagcctgggtgacaagagcaaactccgtctcaaagaaaagaaaagaaaaaaaagaaaggacaggacaggacaggacaggacaggacaggaaaggaaaggaaaaaggaaaggaaggggaggggaggggaggggaggggaggggaggggaggggaggggacaatgcctgcctggcatgttttcttatatcctagccagagctcagatttgagcagtagttcttaaccttggttggtgggagtttggaagtgtatggggtgttttgatggtaacagtggggaccagtgtatgtttagtgcctaagggccagtggtgacaattgttgtgtgataaatgacactgtagtgtgcaatgaagaatagtcctagccaaattccaaaacaccctcatttagatccactgtttgctctgcctctggtaaattatttcaagggccttcatcattcactcatatagttattcctctattcatctatgtagaaacattttgttttcatattcactgtatgacacacattctatgctgggatggatgcagagatcagcactatgcagttcttgaggtctagaaactcactgcttaatgcagtagttagtgtacattcataactaataaggggcgaaaagggagatacagatactgtaaaagtggcagcactgggttgctcacaattgatttcatgccttcctctacctagtaaaatataggagaatttcttggtagaatctgtatgacctgagagtctgaattaaggtctcaaagtctccttctttagacatattggatcttgacagtgcatctcaccttctaagtttatccgatctctttcgagcttcctggatccctttagagtctcagacttgacatgatgacagaactgggatgaaaaaactgcatttgggtgccagctttgacacttgctggttcgcaggaccttgggccagttttgcgccagctttgggtgtcggtctcctcagctcatacggggtattaactgctgtctgcccagtgcattggcttgtagtgcgcagtgaattatcctgcttgaggagaccttgagacttgtgaggggcaacgccaggcactgtgaatgggtgggatgctctgagtggcagcccactccattcttgggcagcttcaaatctgagaaagttcctccacctactgatgcagaaggtcaatctgcatgactctggcaatggctgagtcaggaacactagagtcttaaatgccccttacttcaccttccctgacctccactcacctccaattcacaaatcacgtcagacttcagctggctgtgttgtgcggaaggcagcggagacagagctagcaagtgacaggggcaacatgagtgtgcctctggttccatgaaaaggaaagggaggataaagggagagagagaaagtggaggccaaatgcactggtccttctcttcagcagttgcccccagctatgtcctgtctccccatggttgatgtggactggtcctgggcagtagtggtgatggaggccggtggagaggggcagaagcagggaagggcagaggccgggctgatgtgagaggtggtggctggaaatttgcctcctccctgcacttgcctcaaagtcctacatcctgagaaaacaaaacaaaaaacagacaacaacagcaacaaaaaccagctgatttctcagggtggttctttctatagtaagactttggtccaacacgcccatgacttttctgtcattgcactcactgatagtgctgacagaggcaagtaacagatcaaataccaggagcaaggcttactaaaatggaaaccaaaaagtccacctgcagaaaaagcaatggtgacaattagtgtttgtgaagatcagagtatccctttagaaaggcttaaagaagtaagagagtttaatttccttttttgtttttacttttattttattttattttttattatactttaggttccagggtacatgtgcacaacgtgcaggtttgttacatatgtatacatgtgccatgttggtgtgctgcacccattaactcgtcatttacattaggtatatctcctaatgctatccctcccccctcccccaccccatgacaggccccggtgtgtgatgtccccactctgtgtccaagtgttctcattgttcagttcccacctatgagtgaggacatggagtgtttggttttctgtccgtgtgatagtttgctcagaatgatggtttccagcttcatccatgtccctacaaaggacatgagagagtttaatttcctaatggtataatttatagatagttctttgatttgggttccagagaaggggaaacatacagagaatattctcgattcttagtttgattcatgctctcctgataagaggaaaatcctatttctgaggttactgagacatccctgacctttgtgtgtatgttttttatttttagttctataaacaagtgatattcaagagtgaagaaaatagagaaaataattcacacttaatatcctgttccaaatagacacttatttgtttatttatgttttcttttgggatgagtccctcattctttgtcgttgtgattcatgttttacaaactagaaatcgcaaagtcttgccaagagttagcctgaaagtttttgtgctacatactcatttgggaactatttacgcagtacttattatgtgtcatgcactgtaatcgcatgacatatgtagtagggaaagatgtagtcctgccttgaggaagcttggagagcagggattgttatgaccgtattaagatgagacaaccagcctggacagcatagcaagaccccatctctacagaaaataaacaaaattagctgggcgttgtggtgtgttctgtagtcccagctaattgggagggtgagaggggagaattgcttgagcccaggaggctgaggctacagtgagcccagatcatgccactgtactccagcctgggcaacagagtgagaccctgtttggaaaaaaaaaaaaaagacaagaaaactacgaatgacttaaatctgctctgctgtgaccccgctctagtggagactgcaagggacgagaatcacagcacctctttaaaacttggtactcagtgcagttgttgttggtgatacataatacataatgcttcaactttaaatatgaaccacttccaattattaagatcctagaagagagaaattaaagtcaaaaaatgaaacaattttcttctctccctttctccctactcatcctccttcattcctctctcggtgtggttactcctcttttaacatgctttttccttattttaaaaattcatgatgtgcaagttatttcattcttttcttatttgacttctgttttctcaaagaaccctatttggacttcatcaattctctcttttgtctcatctaactttttctgcttttatttttattacttccttacttttctgtatcttcaatatattcttttataatttgagactaaagtttaattcattatttttagtttttttcttaaatatttgtagttaaatatattatgtaggtaatatatttaacataaggtaatgactgttctttcaactcctaccttatatcccatagatctcatatgtagctaacaatttattgttttctagatgcatgcagtacaggtttctattttctctttgacccaagagctgtttaaataaagcttcttttaatttccaggtgaaaattctcaagaattttaaatatatgaaaaactatgtttacacagcttacttgtaataagaaacatacaaattaaatctgctttgtaatagtatgtttttacatatcagagggacaaaatacaaaaattgcattatatactaaattgccaagttctgttgctaaatcttaatttctgaattgcagtcaaaatatgattcttattatttctgttttggtatcaagtaatatataacccacttttgtgaatgatttgtagacacttgaaaagaatttctaattccctattttagggcagagaatttggtctgtgttatttttgttatgtaggatttttctatccttaatttatgtcgtcttgatctgtcttagactgggataggtaaattatactcccttattacttggttgtccttctctctttttcctgtggagtttggcttttggatatttgtgctttgttactgtgtgcattactatgaataattgtgtcttttaatgctttgtggacataactctaccttgtttgatattgaaatggtgaactctgctttttttcccttctcttcactcttcctcttcttcttttttttttttttttttttgccttttggtgtttctatttgcttgatatgactttgcccatcctttcatttaaattttttctgaagcattttgtttcaagtgtgtctcttgtatgcattatatagcttcttatatatgtggccttaattctttgatagtataaaatgcaattataaattatatatagtcttgcctctatcttgtgtttcttatgcttataatttttcttttaagctaatatttaataatgttttattattattgtagtggttaccttataattataacattatataagtaatataaacccttgtttttttatcacaagcaataaaaacttaaaatatgttctcttatttcatcatatattttctcttgtccatcatgcaattttagctggtattgttaatcttacttaatgttgccttttgtactgttaaagacacttatactaatattctacatttgccaatattttaaaaaatagtatttgagtttggcatgcaccaactttttcttcgtctctaactcattccccattatccttccatttgtttttcatatcatttctgcatttcagggaatagtagcatttccaatctgtcttgtaaccttaattcctgtttttgttttagtcttgcttttacaggaaaatgtactcattgcttaccatcagccctttcactgtaatttaccagtcatcatttggcgggatgaagtttgccatctagtaatttccttaagaagctctcataagataatataacctgaattcctacatacgtaaaactctttgtagcatttatatttgaaggacatcttggctgaatagaaaacccttggttcattccttccttaagtatcctgtaaaaattgtctttggtcttaaatgttattatggagaaatctggggccacattgttattttctcccttttatataacttggtaattttggcaagctgccagtagcttgaaaacgcaataaattttataagagtatgtttcattgttgaacattctaggacaattttctatgatgacaagacaagtcctttggatgtgtagattttaattttttttaatggagactcttgatgtattctagctttgcaaatttagaaatacttagtttttctttttcagggagtttaattgcctgcgtttcttttccctgtgtttctaatcaatagatttttacattttaaaaaactctattcctgtttcctttagttgcatttcttgcacctattttctacatcccttactgtattttgtgcagtatcaatttggcctgtgtttcttccaattttattctcctttgtctgatggctagtttttttcacatattttttctaagttcttccaattcccattttatatctttctgctactttaccatctcattaactcaattctaatgattgtgctgtgtggtgtttcttatagaggggcttgccttgtttaaattgtttaaatatatttaaattgttgacaaaaagtatgttcactattatcatctgttcaatgagaccaactttttcgcatgggtttttcacttgttaataattatgcaactctcaatctctttttatttcttgcccaaatgttgtgctaaatttttgttaccgtgattgttactcatctggaatgaattggatattcctgtccaggtatctgcaagagggtcctggtggtggtgaggaccaggtgccattaatgaccttacagctcaaaagcttacttttccattgccacaaagatagagtgcttcctgaaaacatatggatttctcacatagcctccgtcttctgtttccctggaaatagggtctaggagaaggcttctcacgctagtcaatgtaacttttttttgcttttttattgatacacagtagttgttcatattcatgagttacttgtgataattggatacatgtgtacaatgtgtgataatcaaatcagggtaattgagatagccatcacttcaacaatcatctctttgtgttaggaatattacaaagcctgtcttctagctattttgaaatatacaagttattgttaagtacagttcccttagtgtgctattgcacactagaacttatcccttccctccatttgtacacactaaacaacctctaattatcttcccctcccctttacccttcccagcatctgggtaactcactactctactttctacctcaatgagttcattttatttttagctcccacgtatgagttagaacatatatttgtctttctgtgtctggcttatttcacttaatataatgtcctccagttccatccgtgttgcttcaaataacaggattttttctttgtaattgctaaataatattccattttgtatatatgccacatttctttatcttttcatccattgatgaacacttaggttgattccatatcttagctattgtgaataagtctgcaataaacatgggagtgcacatatctcttcgatatactgattttctttattttagatatacactctgcattggaattgctgggtcatattgtagttatattttttagttatttgaggaaactccatactgttctccacagtgtctctactaatttacattcccacctaacagagtgtgggttttcccttttctccaaatccctgccagcgtctgttattttctctctttttgatagtagctatttcaattggggtaagatgatatctcactgtgggtttgatttgcatttttttgatgattcatgatgttcagcatatatttgtataactgttggccatttgtggtcgtttatttttgagaaatattgagtcagatcttttgcctatgttttaattggattatgtgggtttcttgctattgtatttgtttgagtttcttgtatattcaggctattagtcccttgtcagatggatactttgcaaatattttctcccattctgtaggttgtctttacactttgctgattgtttcctttgtttgcagaagctttttagcttgatgtaacatcatttgtctatttttgcttttgttgtctgtgcttttgaggtcttacacaaaaagtctttgtccagaatcagtgtcctgaagcagttctctgatattttcttcttgtagttttattgttttgagctttacatttaagtctttaatctatttagagttgatgtttgtatatggcaagagataaggctctagtttcattcttctgcatatggttattcagtttttccagcatcatttattgaagagatagtccttttcccaatgtatgaacttggagcctttgttgaaaatgtgttggctacaaatgtgtgggtttatatttgtgttctttattctgtttcattggtttatgtgtctgtttttaaccaaagaagtgaaagatatctacaaagaaaactatgaaatgttgatgtgatgtgagaagttaaagaggacataaaaaatgaaaagatatcctatgcttattgattaaaaaaattgttaaaatgtctacattacccaaaacaatctgcagatccaatacaatccttattaaaataccaatgacattcctcacagaaatagaaaaaaatcctaaaacttatatggaaccacaaaagacccagaataaccaaagctatcttgaggaaaaaaaatgaagctggaggcatcacactacttgtcttcaaaatataatacaaaaccatagtaatcaaagctttagtctccattttatttatttctgctctaatataaagtctttcatcaaagaaaagcccaggacctgatggcttcactgtgacccgtgttctgcttgctccaacctctggtccttgcccttttttttcctttgcctggagcagtcttcctttagatacctgtgtgactcatttccttacttcatccgctttctgcttgagtatttttttcccgctgtcagctcagctaatcaccctgtctgaaatagcattccttctcacttttggttaagctagttcttttttactcatagcatttatcactacctgatattatgcatctctgttttagtcctttctgtgctgctatcacagaatacccgagactgggtagtctgtgaagaagagaaatttatttggctcataattctggcaggaagtccaagatcaggcagcctttctggtcagcttctgctgagggtgtcatgccacttcaactcatggcggaaagtgtaaggggaagagggtgtgcgctccatacatgagaggcaaccctgcttcataacagccagctatctcaagtacctggaatctatcaatccagtatcctggaaactcaacttgtctcatgagaactgcattaatccattcatgagtgtggagaccccataacccaaacacctcttaaaggctgcatcacctctcaataccatcacatgggcaattaaatgtcaacatgagttttggcagagacagaacatagcaatctctgtgtttattggattattttatgtcccctcccaccttgccgacacactggaatgaaagatccttaatggcaggacctttttctgtttggctcattcatgtatcaccagcccagtaacacggcttgtaccttcagttggtctcaatgttgaataaataattattatgtggatttagagctcagagagtatgtggtgagaagacagagggtccagcttgaggtaggaatgcctacatttaaaggcaggtaaaggagaagttgccaagatgtgggtgcaaagctgggagttgttctggaagctaagagaaaagagaggaggagggaatgaccaatgccatccaacatgtctgagaactcaagaaggaaaatgactggataattctcattggattttgaggcatgactgtcattgatgccctagataagagtcatttcaagtgtatattagaaatggagcccagttagagtgggttgaaatatgagtgttaggaaaatagaaaggaagactttcatttgccaattttcacgtattttgtagatgataatctgtgatcaattaatatcaataattgaagatagataatggtcccaattaaatgggggaaatggcaggcatggattaatgacctgctttgctccaacctgctctgcctatggcaggtgtcagagagtattgtggttgggctatggctctctgagagatctcgaaccagttgtgtctccttcatgggttccttcatgaatttgcatacctacaaaatcagcacaccaatcatggccctcctacctaagtcacaggcatgtagaaatgaccaaaggagatatcactcctgaaagagctttctaacttggaagaaaaatgtaaaaaattagtagagtcattttgcttgtctccggatgctgactgaattatccccttacagattcctgaacaacgttggtttcttttttccactgataatgatgctgacgtggatggtgtctgtggccagcatggtcagaaagttggtgtatgagcaggagatacagatagaagaggtaaatatccttaaaccttgcctgggagacaaagatagggaggctggggactttggaaatggatcttgtcccataaccaacctgagcctctctgttttgcttccctctcctctgctggggttctggtgtacaaaatagctgagtccctgttccagaaagaagattttatgttgaagtctgaagcaatgccagatattttccactgacatgaaagaaagccaaagaatagccacatgagattgcaagaacaaagccagtgttcctcattcagcaacttttttaaaacccagaaaaacatagcagcagacttcccatcttaatttatgcttagaattttttatgtagagaccctgctattttttttgtaatactgttataaaacttgaaactatcataacttaaatttttttatttccataggttttttggggaacaggtggtgtttggttacatgaataagttcttcggtagcgatttctgagattttggtgcacccatcacccgagcagtgtaccctgtacccagtgtatagtcttttatcaatcaccatccccaaccctttactctgagtccccaaagtccaaagaatcattcttatacctttgtgtctcatagcttagctcccacacgtgagtgagaacatatgatgtttggttttgcattcctgagttacttcgcttagaataatagtctctaattccatccaggttgctctgaatgctattatttcattcctttttatggatgagtatatcccatggtgtgtgtgtgtgtatgtgtatatatatatatatatatatatatatacacatacacacacacatttatatatatacatttatatatatatatacacacatatacatatacacacacacacacacacacagacattttctttattcactcattgattgatgggcatctgggttggttccatatttttgtaattgcgaattgtgctgctataaacatatgtgtgcaactatctttttcatgtaatgacttcaggagtgggattgctggttcaaatggtagatctacttttagttctttaaggaatctccacactgttttccatagtggttgtactaatttacattcccaccaacagtgtaacagtgttcctttttcaccgcatccatgccaacatcgattattttttgatttttttgattatggccattcttgcaggagtagagtggtattacattgtggttttgatttgcacttccctgataattagtgacgatgagtatttttccatatgtttgttgaccatttgtctatcttcttttgagaattgtctgttcacgtccttcacccgctttttgatgaaattgtttttttcttgcagttctttgtagattctggatattagtcatttgctggatatatagattgtgaagattttctcctgctctgtgggttgtccatttactctgctgattatttcttttgctgtgcagaagccatttagtttaattaagtcccaatatatttatctttgttttcgttgcatttgcttttgggttcttggtcatgaagtatttgcctaagccaatgtatagaagggtttttctgatgttatttttctagactcgttatggtctcagggcttagatttaagtcttttatccaccttgagttgatttttgtataaggtgagagatgaggatccagtttcattcttcaacatgtgggttgccaattatcccaacatcatttgttgaatagggtgtcctttccccactttatgtttttgtttgctttgttgaagatcagttggctgtaaatatttggttttatttctgggttctttattctgttcgattggtctatgtgcctatttttataccagtaccatgctattttggtgactatgtccttatagtatagtttgaagtcggataatgtgatgcctccagatttgttctttttgcttagtcttgctttgactgtgtgggttattttttggttccatatgaattttaggattttttttttagttctgtgaagagtaatggtggtgttttgatgggaattgcattgaattgcagattgcttttggcagtatggtcattttcacaatattgattctacccatccgtgagcatggcatgtgtttcctttgtttgcgtcatctgtgatttcttttaacagtgttttgtagttttccttgtagaggtggttcacctccttgtttaggtatattcctaagtattttattttattttttgtagctattgtgaaaggggttgtgttcttgatttgactctcagcttggtcactgttggtgtatagcagagctactgatttgtgtacatgaattttgtatcctgaaactttgctgaatttatttatcagttctaggagctttttggatgagtctttagggttttctaggtatatgatattatcatcaacaaacagcaacagtttgatttcctctttactgatttggatgcccttcatttctttatcttgtttgattgctctgactaggacttccagtactacattgaatagtagtggtgaaagtgggcatccttatcttgttccagttctcagaggaaatgctttcaacttttccctgttcagtataatgttggctgtgggtttgccatatacggctcagaccatagtgaaataaaattggaaatcaactacaaaaagaacactcaaaaccatgcaaatacatggaaattaaataacatgctcctgaatggttgttgggtcaagaatgaaatcaaggtggaaactaactgaactgaatgataatagtgatacaacctatcaaaacctttgggatattgcaaaagcgatgctaagaagaaagttcacaacgttaaatatctacatcaaaaagtttgaaagagcacaaatagacaaccaagggtcacacgtcatggaactggagaaacaagaacaatagaaacccaaacctagcagaagaaaagaaataacaaagatgagagaataactaaatgaaattgaaacaaaaaagtacatttaagtctttactccatcttgagttaagttttatataaggtttaaggaaggagtccagtttcaattttctgcatatggctagccagttttcctggtaccatttattaaatagggaaccctttccccattgcttatttttgtcaggtttgtcgaagatcagatggttatagatgtgtggtcttatttctgagatctctattctgttccattggtttatgtgtctgtttttgctccagtaccatgctgttttggttactgtagctttgtagtatagtttgaagtcaggtagcatgatgcctccagttttgtttctttctcttaggattgtcttgactatacaggctcttttttttggttccatatgaattttaaagtagatttatctaattctgtgaagagtgccaatggtagtttaatgggaatagcattgaatctataaattacttagagcagtgtggccattttcatgatattgattcttcctatccatgaccatggaatgtttttctatttgtttgtgtcctctcttatttccttgagcagtggtttgtagttctccttgtagaggtccttcatccttcacttcccttgttagctgtattcttagacattttattctctttgtggcaattgtgaatgggagttcattcacgatttggctctctgcttgtttcctgttggtgtataggaatgcttgtgatttttgcacattgattttgtaacctgagacttggctgaagttgcttattagctttaggaacttttgggctgagacgatggggttttctagatataggatcatgtcatctgcaaaaagagacagtttgacttcctctttttctatttgaatacgctttatttctttctcttgtctatttggcctggccagaacttccaatacagtgttgaataggagtggtgagagagggcatccttgtcctgtgccagtttttaaggggaatgcttccagcttttgtccattcagtatgatattggcgacgggtttgtcatgaatggctcttttataaaaatttaatttaattttaagttccaggatacaagtgctcatgaaaatcaaataccaagcttgaggaggcaatgtccttcccagggcccttcacagggctgaatttgcaagcaagcagatttacctttccactggtccaccttctttctcctaccatctgatttgttcttcctcaagtacgcatgctgtggtaaccttgggttttttctctttttggtagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctggtaagtaagttgttttgtaaaaaaaaaaaaaaaaaacaacaaaattgcaatctatctaacaagacaaaatcccaccactctcactttttcaatttgtcatgttcatatctacatgggctttctgatatctgctttttaaaatcttacccacaaatgcaaaccgttgaaactgcagggtttttgctggacagcagcccattaagaatgtccagtttttacataacagagactttctgcagattctggaaaataagcaacattcttaaggaagcatataactttattttctctttcatgcacagaaaaaagctagatttctaaagcaattttagaagtaaaaaataagcattttttcttgaaacattatgaattacatcacattaagtggaaaaatctctctgttagcaatgtcagagtcactcatccatttaaaatgtacctcctaaaaacgtatgataacactttcaggtctgtaacatcaaatacgtagaacataaaaaagtattcattcttttatggcaattgctggcaagcgcagtgcctgacacatagtaggaactcaatcaaagcgagggtgaaccatcactattaaaatgatctgtttcagagagccagtggcatcactataaacacttgcactgtgctcaagactttattctctccagcaggtcaagtgacttcctaaaattgcagtctgttgagagataagacagagtcattaacagagactttggggaggtgtcaaggagacctagattacggggctgctcaggggtatttaaaggcccttaaaagtcctttagtccagcacaggattcatgacggccccagtgcttcactcacttattgggagcaaaacaccttctctgctcatttagggcctagagtaaaatatttctatgaaagccaagtgatttgtcttcaacttcagtaaacgattcaaagctgtctggtttctactagccatatgctcacaacaaagatatacatacagaatgaaaaagtggttatattccatcagtgttttatctattggtatgtgttcattggtcttgattagcttatgttacatttgtaaaaacccataaccaataacttcctgttagtgttaattagctgttttcagaataattaacacaagtgggaccattggtggtccttccccatatactccttgtacatagaaaaagagtcatccatgatctgacctgattttcagatggtgttatttttaattttacttcagtcattatattcgtgggttctgtgcacataaaatttgattttctgtttacatattcaaatgctttctagcaagtaaaaaatatctaactctggtacactgtattttttaatgtaagatatttttttcaatggggtttcgttctaacataagacttctccactgagatacaataacatttttcttcaatacaccttctttctagtgtagaatagtgtatgcattccatcagtcagcctgcagtgtgctccagggcattcacttaataataaaaaatagtaaattactctattccagttttcactgttttgtgttacacatttctgtgtatgatacattggatttatgacacttcaagcatctcggtaaagagaaataattccttttaacgttaaaaactagcttgttatcatgcttttcagagtgggctgacattccgctaagattttcagatcaaaatatttaaatgactgcctgaagcgatggttgggcgtcatcagaatgaaaagttgtcatggcttcgctccttgaattaagtgttgtggattttctgtggtcccaatcaaaacactaacgtgcagtttttctccatcaatctgtgggcagtgccttctttcgacaaccgcctttggacaaggggtattttttattacattcctggaaggacaagagacaggtaagagcatgcatgtgtaaaaagtgactctcagtgaatcacgtttttggaaattaatagttatattgcaagtgatccagtaggaagtcttcattatcaagtagagcattcagaatgaggtttggatatttgctttcactgttgtatacacctcccactatctggtagcaccagttttgagaacaatcaagaataatcatggcatcccttgcttcagacactatccaggtcaaccacccagccaatgcttgggtcttccttataccacccttgacgtctggtctggtgagtgaccttctgaaccttccaagatagggtgtgcaaatgtgtccatctgttagatcaggggtccccaacccctgggccatggagcagtccgtggcctgttgggaactgagccttacagcaggaggtgagcagcaggcaagggagagaagctttgtctgtatttacagccactctccattgctcacgttatcgcctgagctccacctcctgtcaggtcagtggggccattagattctcataggagcctgaacgttatgtgaactgtgcatgcaaaagatctaggctgcatgttccttatgagaatttaatgcctgatgatctgtcactgtctcgcatcacccccaggtgggactgtctagttgtaggaaaacaagctcagggctccccgtgattctacattatggtgagttgtataattattttattatatattacaatgtaataataataggaaaaaatgcacaataaatgtaatgcacttgaatcatcctggaaccatcctctatcccccggtctgtggaaaaattgtcttccacgaaactggtccctggtaccaaaaaggttagtgaccactgtgttagatgattgttgacctgggatctgtcttcctggatcctctacccatgttttctagttcttcctttctaattatccctttcacatgaccaccatctacatatttgttggctctcatctttactcctagatttactagattgttcctgaagatcaagatccagaaataggtctaataagcataaaatagagtgcaattatctcataccaatgcaggctaaaatgattttctaaaaatctattggcagcattttttgcttatattgagaatttgacaactaaaattctaaaccagaacagacatatatttcatagatatttgtatggttttttttgggggggggtgtttttgtaaacagaggtaaaaccatgctataagtaaaatttgactctagctattgttgtattagccagttaatttgtactggtctttgagttcttagagtttttcaataagatgtattaaaatgttcttttacagatgagtaatcttgaatgatttcttctaactgatctttagaataaattgaatcaaaatgatagaaacaaaaaatggaaactgttagaccatttgaatattttggtctaaattccaagtacacaatgattaaaatgtatattttattgaactgtagcctggtaccatagggaaatttagaaaggggaatatttttcttaagttgtatgttaatccagaaataaatcacaaacctattgtaaaaaaataataataatttcccaccctagttcttatatatcctattatatattttccaagagcacagagagttacacagtttagaatttgggttctcaaggagactttaaaaaatttttttgaatgcttattttccttaaatataaagtcctttctactcaggtaaataaaaccagatatgagtaaggtgacctttaaaactttttaaagtattagatattaaaaagtagttaacaatccccccacctgatatcattgaaataggtgtaagattgcacaagttaacatttcatgaaaagttatggccagtgatattgaccttctttttgttttagttctgttcaacttcacttgagcttccagaagtaatgaactcatcatgacaaaatctaccataaaagagcttgtgcagttctaactctgacctttttcttcctgctagggattcaatggaataatatgtaccaggctctggaacaagggggcatgacatttggctgggtttgctggatgattctttttgattcaagcctttattttttgtgtggatggtacttgagcaacttgattcctggtaagaattttgccttttgtaagataacacaataaattttaaaaacagtttgaattaatatgcataaatattagaataatcacttattctttaaggaagatccagaaagggaagtcttaggatatatatttaaaaggagctgtacatttttgagaaaaaatgtgatgcctttgtttcccaagtgaaaggtaaaaggccatgtgagggaatagccaggatgaaattagcatgaaaactcaccaggcccaccaagcagctccccaaaagtgggcttcagtctacacagaaaatatcctggtttctcagagagtgtttggggagggcaggcatgagggggtgagggtgggggtgctcagagtgccttggccagaaagtcactcctagtggggatctagggaccaagcgctcagccagtggcaggtcggtgcatggcaggacctggggagaagcaggcagagcctaaaggcagctggacagggtgggctgggagtgaggggccatgtccaaccacagggctttcactgttgtcacggatatggggtttcccaaatgtggtggtgcccttcttccctggtgtggcaggcatgccccagagtctggaggacaagtatatcaatggccaaaaaaaaaaaaaaaggccagtaatggtaatgggttttcctagctgttttgggaggaaaagaggcacgcatacctttacctttttggttcaggcccgaaagagcagaaatagcactttaaaattacttattttattttttagagataacactttgatggtggtgtattttcttgctgaaattacttggcaactctggttctatgcttttcaaagcaaatagtgtctaactaaattaaaactaaaaattaaaaaaaatgattctaatcttatacaaatgaaaatggagggatagaaagaaaacaaatgcagttcattctgtttgtgaaaacacattccagacttggagagctcatgaatcatttagggatgggtaaacataaaaataatatgggccactgaaaagatcattttacacaaaagtaggaatatatggccctcaagaggtagagagagaacataaattggaaatgtgatttatttaggaaaaacttagactgcattgtcttggtactttgaataaaatttaagaaaataaaacttaagaaataagattctaggaaataaaggataaaacaaatgagttgagaaggccaagggttcaaggaaattggatgagaagcaattgactattgagaagaagcaaaaataacataagaaagtaatgttacaaaatacatttgtgatgtccatctaaaatacaaagaccagcaacaaagtctactctctgcaatgttgagatgaagataaaatgtgtcccgggacccagaatgatctgatttctccctcaaccatcagcatctaaggctagaggctcttggggcaatatttttctacattatggtaaagcaaaggaacattgtattcagctgagactttccctctgaatcccactgtggaattctaaattgaaaagttttaaaagagactgagccttgaggtggatgtctggtgtgcagagggctcactgtctaggtcatatttgaagggaagaaaagggaattgggagtagactcatggaggaaggtaattgaactcagaaaagctgagtgatggtgagaatgtcctcaccagtgggacagtattgagtcgttccttatcctgtgggtcaggggatgtttggctaagctggtggcttttaagaagaaattctttctaaagttcaatgaggtcaacttgaggctcagaggaaattaaaaaaaattgttttcctcaggggaccaggagattcaaatgctagagttggtaatcttttggaagtaccttggccatctgaaccatgccacatttggaactcacgtatattcgactgaggaaaccgtgatctcctgttccttctttcatctcctcctgtccttccattccttcagactcctaattccctgccctcccattaggtgaaggttaaacaaacaatccaccatcttcatacactcacactgcaatcctgcagtctcacaatatggctcatgattaacatctacccaatatgttaaacttgagctatttcagaatcagctcttaccctgccacatccaactggagaaaaagatctgctgattttacttcacaagtctcccttaagttcacacggatgtaccttttctagggaatgtctccatgttttcatcaagccatacaaagtattctgtgacctctaatgagttatgattcccagatacactggatcctacaccctgcaaagggaagcaaatgcagtaggacctcaatccacctttgaatggcagacactcatttcaacattttgtttagtgaatttagagtgggaggttttatattttctctttgtgattgtgacactaattttagctaccagctagttaggaaaaaagatcagagtctattacagaatttaaaaaaaatcaaagctcgcacatatttataacacatatttaaaaatacaaaggcatagagctgaataaatatgtcaataaatatttttgactttatcacaaaattcagattcttttatttcaaaagctaaaaataagagttggcaatttgcatattcttaaattgcacaaagtatttcttttccactttgacaaagtctgccaataataacaaagaatataattgccagacactactgatgggctttcagatccataaagagggttataatttctaggaggtctcagacccaataccttctttttaagagaaatattttatattacctcctttactctcttgaaatgaaacttatggataatgaaaactacctgcatatgagtcttaaaattaatgtaatttaaaaattttaatataaaagagaaatagaaactaatttatagtaagttctcggtgctcaggcatgaatgcatcggaacacagaatgagatattcagttgcttatgcttatgtggaataagttcggatttaaaagaaggagaaaggtcagaagccatttggcactaaaaggaaagaaaatgcataagtaaagagaaatgtagatactagaagtaaagctaatattaagtagtactagatcagacttattggtatgtgattataaagatgaaaataacttcagttgaagtaggaaaaacgtgggaagaaatattatacatgaatgaagtgaataaaagaatgatatttttgtaaatgacctgggtctttatttaaaagtaatcaggaaattccctttgttaacacatggggcaggtaatgacaaaacataacagaagatccattttctgtcttacaattctatctcatttcagtttctccattcagcctccagtctttaaagacgttggagatctattctttagtagtgacaggaaatagaggactgattggacaaaggaataatattaataatataagagggttttatagagaagccaaggggtgaatatctgggaacagcatcaaaataagattgaaaactaatagggagcctcatgttaatcatctcaatgtgtaattttcaccaaatggtcttattgtgctatacagttttaaaatatatatatcaaatgacaatgtaacatagttactaacccttattaatacaatttagtgcattttctaaatttctactattcaagaatatctggttttaagtttgttaaaagcaatcttcacatcttttgtcatgtgtttgtatataatggggcagaatgaagattgatacagacatactgcattgcaaactcaaacgcagtgagtgacatcactattgatggcgttgttttccaaaacaatggacaatttctgctttaaaaaataatcttccactagtttacacagtggttgaatttctgaaaaatttagtgtatactgaaactgcacggaaactttgagtttatatgtcctaggctcaataaccatgaaacactttgcatttgcacggctgtgtgtgatcaggctcacagaaggcaagtcaaggacatttctttgttgcactttgtagggtatcaactaacccaggcatctgcacactaaaggcaattgtaccatccccattgtattaatcatacttttttattttctgtatttttgaggctttgactggggttgaaggagtgcagttactgaccctagagggactgttccttccagggatagccagttcctagccatagtaaaggactcacctgtggatgtgcctttcacaagcaaaaaaccaatccagagcccacgcccctaccacctgctgtacggggcgatcacactcggggtcactgtccacctggcctgatcagcccagggcaaggtaccagccaactagggacagactctctcccgaagagcctgatgaaattattcacagtagttaattagaaatgtacttgcccttcctcacatgttccttcccttgaaaaccacagtaaaggctcttgttcacattcccacagcacccctccctacttcccctgtctcctgactgacactggtgcttccctgtgtgaccctgtgtggtgtgtcatgcctccttctcttggggtctgtgagtaacaaagtgtagtttcaatgacagttatctcctgatttgttggcatcatcatacttgagtaataataaaatctatattttaaaacactgttccagagtctcctgtgggtaggagggtgtctccagatgggaggtaggaggcaggaggcaggtgagaaatttctctcttttgctctctgtcacacacatacacatacacacacacacacacacacgcacgcacacaccccatacctcagacaaatacttttctctcgattttctttctttgttataaagtgaccctgtgagtatgaccccagcatttctcagccccggtgtctgactgggagactctgtagatccagcatcagatcatttcctggcctgcggggctcagcgtcaactgcaggtctccacgctcgagtcaagagctcacaagcaaacatctggtcctctcgaagagttttcattgcataaactctttttatatgcttccaattaaatttgattctgctcgatctgtctaatttcattgacctcttcttttatcactgtcagttttggggggcaatgctgattagtttcctggcctgcataagccagcaggcagttccccttgaggagaaaagctctgtgtaaatggagggcctttgcacatattaatgtgcccaattacatctggtaatgtgagcaggttgtatgtgcttctagagtgtgcacgtaaaacaaatttgaatttataagcaaaagccgattgcagaggcaagccaaagagctgagcggcttccacgccagcttgcatttggcagctctctgctttagttagattagtagattaattagggggttttaaaagtccagacagattatggctgagatggtttaattagcaaagcaacccttaatattcaatttattttttcataactctggaatgtctttcacgtttgtttctacttcccatccctgaagccattaccttagttcaggcctcactgtgcctgatctggacttacagcgagttacagtgcctttgtaactccttcctactcctctaggtatccccgaccccagcacctcacctctgcatcctacctgcatgttgacacaaagttatctttcttaaaaatagaccaaatagaccatgtccctcccctgcatgacagtcttccccaactccaaaatgtctagagaataaataatatcctcagtggctctcaggccacccgaacctgctctgctgcagattcacgcccctctctctattcccgttgtgctgatggggagttggggggcagtcttcaatgtgcccagcacacccacacagggtaggcagataaaatacagggcacccaggtgaattcaaatttcagataaactacaaataatttgggggacatattcatactaaaacattaattgttgtttgtctgaatttcaaaattaattgaacatcctgtgtttgtattttctgaatctagcatccctcccagcatctctgtcttttcattctcattcctttttcttgggttgaagggcctgcttttgttttgcataggtggaaacctatgatgacaatatcatcttgtattcttctctcaatgattttttttttttttggtcatctgtactagaatgaaggtcataagaaggcgcagtctctgcctgattcattggcgtgtccctcgtaccactagagggtgtgactagttgatttctgtttgatgactgacatcttcctggaacaggaaggtataatccggagaacagaagggcaagggatatgatgttccagatctaggtgacttctgccctgctcctttgtcactgtgctgaggcctcacctgtcctactcattcttgggctgacagctggaactgtgagccctgggagatgagccagcatctctcctcatacctctgtacaaaatgcttagttattcatttctcaacaaagcatctcccacagtaaatcagggctgcaggaaggtgtcatttcccaaagactcaagtgagaaaacaaggatacaactaataaagagtaatgtcttagctccattgcaagaaactggtgactcctgacattgttgcagttgtctatgtgtgcacacttgtgtctgtgtacatgtacatgtgtgcatgtgctgcatgaatatgtgcatgtgtacatgtgtactcgtgtgtgaatgcctgtgtgtgtgcatatgtatgtgggtatacgtatgtgtgtgcacacacacacgtatggtgatcttcactttgagtcatggccctaagtttgaaatcatatttatctttgtacgacttccacttatatcgaagtgaagcagagctgaggcttgcttcaggatttccttgcgtacactcaaaatgtgaaggtgttcaatgacttcatttggaacaggcaaattgtgccttatttcacctttagaatgtgcatgtatgaaatattcttttctcccctatggttctgaaaaattgagctataatacatcagatggatatgtgtttattgtaaaatgtttgaaaagtttatagagaagcaggaaaaatttttgaggaagcaggaaaaaattcagttatctccaatatcaccaaccagaactaacatttcccaggctttttccagacagttttctgcacctagttgggttcacactgtatatgtaaatttccctctgttttaaaaaaatatttttatcataagcatttatccacatctttgaaagtactgttaatggctgctcaacatttcattaaatgaaagtaataacttcctggacctttctcctactttgcaagtttaaataatttctgctttttccccactataagtaatgctacagtgaatatatttatgttcagatgtgtgtccccactttgtcattgtgtcatctagaatcctagaattttaattgctaattcaaatctataaacacttgaaggcatctggatcccattgcctactatccttgctaagggtggtgcccacttaagctgcgactgagtgtggttgcctgagaggcctctgagccgaagacctgcagctttgtgagaataatcttcctgatgtgtttgcttgctttctgtctcctttgatttccacacactcattgttcacgtatgtgtcaacaggggcttttcgtgtaattggtactggaagaaactgtgcttctttcttgttgtaaaaggcaacccaaagcatcctcatgactgcacttgcgtgttcagacaggcaggagctgctagaggagaggctaaccagtgtgtagcttctggagccatcagctgcgcgtcactgggcaacccttgctgttcctccttttcttattgggaaggtagaggtgataattttacctgacatgttggtggtcacaggactgtgtgaattaatacaaccagataccctggacagtgcctggaacacagtgagtggaatgctggctgtgatatgacctgattatccagctgctactcatcctcttcctacagagggatggtttttgctttgcaaggttcttggaggacacctgcctgcattaattttctcagcctgccataacaaagtaccacaaactgggtggctcaaacaacaggaatgtgttgtctcacaatcctggaggctaaaagtctgagatcaaggtgtaggcctgtgtatgtgggtatatatatggactggtttctcccaaggccactctccttggcttgcagatggcattgtctccttgtgtcattcctgtgtatctgtgtccaaattttcttttatgaggacaccactcacattggattagtcctcgctcttgtgacttcattttgccttcattacctctttgaagaccgtgtctccaaatacagtcacattttgaagtacagggggttagaacttcaacatatgaaacctgcggagatacaactcagcccacaaagaaaagtcagtgctattcctcacagcagctgaacagcttcccttcactttatgtatttatttttttgtaacttttaagtgcaggggtacatgtgcaggtttgttacataggtaaatgtgtgtcatggaggtttattgtacagattattttgtcacccacgtattgagcctagtacccatcagttattttttctgatcctctcccttctctcacccttcaccctccaaaaggccccagtgcatgttgttccccgcagtgcatgttgttcatgtgttctcatcattcagctcccacttataagtgagaacatgcagtatttggttttctgttcctttgctaacgatgttagtttgctaaggataatggcctccagcttcatccatgtccctgcaaaggacatgatctcattcctttttatggctgcatagtagtagtccatggtgtatatgtaccacattttctttatccagtctattgttgatggccatttaggttgattccatgtctttgctattatgaatagtgccacaaagaacatacatgggcatgtgtctttataataagatgatatatattcctttgggtatatactcagtaatgggattactgggtcaaatggtatttctatctttaggtctttgaggaaccaccacctgtcttccacaatagttgaactaatttacactcccaccaacagtgtataagcattcctttttattcacaacctcaccagcatctgttattttttgaccttttaataatagacattctgactggtgtgagatggtatctcattgtggtttcgatttgcatttctctaattatcattgatgttgaggtttttccatatgattatcagccccatgtatgtcttcttttgagaagtgtctctttatatcccttgcccactttctaatggagtgtttgttttttgcttaatttatttaagttccttatagatgctggatactagacctttgtcagatgcatagttaagcattcctatacagcaacaacagtcaagcccagagttaaatcagtaacaaacttccattcacaactgccatacacacacaaaatatctaggaatacacctaacaaggtgaaagatctctacaaggagaactacaaaccactgctcacagaaatcagagatgacaagaacaaatggaaaacgtttcatgctcatggacaggaagaatcaatatcattaaaatagccatactgcccaaagcagtttgtagattcattgctattctcattaaactaccattgatattcttcacagaactagaaaaaaatgtttcaaaattcacatggaactaaaaaggagcccgaatagccaagacaatcctgagcgaaaagaacaaagctggagacatcacattacctgacttcaaactatgctacagggctacagtaaccataacagcatggttctggtacaagaacagacacatagactaacagaacagaatagagaacccagaaataagaatgcacacctacaactatgtgatcttcaacaaacctaaaaaacaagcaatggggaaaggattttatatttaataaatggtatggggataactggctagatatatgcagaaaattgaaactgaaccccttccttattgccatatacaaaaattaattcaagatggattaaagacttaaatgtaaaacccaaaactataaaaaccctggaagacaacctagttaatacaatttaggacatagtcacggacaaagatttcatgacaaagatgccaaaagcaattgcaacaaaagcaaaaattgactaatgggatctaactaaagagcttctgcacagcaaaagaaactattgacagagtaaacagacatgtctcccattctgtagaattggaggaaaattttgcagaccttccctttactttcaaaaggtaatggatacatgtgctctcctttgagtgcatgaacatctctttctattttttgattagaatgtgcgagggcttgcatatctctcttctgcttgatgatcaaagtgctataatagtctttatatcagcctttttaattctaatcagttgtagaatttaggcctttaggtaagttacgttcatcaaacttaaactagaatggatgtgttaaaagaaaattgggaaatgttaataatgaaatcccttttcatttcaacatgtaatgagggcaaagtgactgttaaatgggctgaaatgaatttggagaatacttttgaagaatggtaacgtgtttcatatggaaatgttagcattatgaattattcttctttatggaaatttcaattgattaatcccctcctacacttacctcatgctcttcctcttgtctaggaatccatgcaaacatcaaagataggcaaaagaagaacaatcacaaaatagaagggcagtgtggggcagggtgggactttactctgggaatattcagcaattatccaaaaagcatgtattgaacccctactctaaagataaagtcttgggggaagtggctgagagggggttttagcacatggctgtggatcaggccgagaagggagagttagggctccactgcaaaactaatagctgtgccctgggatatcacattttgtatatgggacatatattaaaaatattaacatgggatgacattttatattaattacttaagatattctaatacagtaccttcatctaaataaaaaattaaactaattttaattgtttcattttttaggaacatttggtttacggaaaccatggtatttcccctttactgcctcatattggaagagtgtgggtttcttggtggagaaaaggcaatactttctaagttctagtctgttcttcttcaatgagaactttgacaataaaggtttgtaaggagtagaattattagatgcatgtatttttcctttgatccattttgatttttttttgtttgtttttatggtccagccttttcaagtgtgtgctgattcctagagagacttacatttaggctgtcttgggctgggaaacagctgcaagcccaagatgtgggaaagtatgccatgacagtgtttgttctgtgaaacccaggaaacccagggagttcccattaattattatttagcgtcctcccctctgtgcattatgtgcatttgtgtgtatattacaatttagaaaaattgaagcgttagtcccaaaatgaatatgtgtaagaaataaaagcaaatatgggcagctaccctgtgtaaagcatttaaaaatttttaagtgttctcacccatgctggtttattcagtgttcctgtgtgagggagaatatcactgtcccttacaaatagggattgtggttctcaggagataggggcaggactgtccctgtgcctctgcactccagagtcatggcctgttcctgcaggtgcaggcacagggcacctctgccaaaggatgaatccataggccatctccatggaaatagagatgcatcactcagagataaacaagctcccatcgtggtgggtttagattacaagtcaacattctaatctaaacaatctaaatatttttctgaattatgaatcttttagaaaatgtggaacacatcaacaagcacctatccactctcacgtcctcaggagactatttctcatgaacattttatgtgtaactaatctgcctgttgtttttttctctacttaaacaaaaatacatgtgtgtgtttttattttttttattttttacaaaatggttatcataagggttcaaaactttgtaatcagtgatatcacttaatgtttgccattatatagtctgcttcttgttcttgctaaagaaagatttttgagttgatttgtgtgcttcacagagctggaattcaatttcaaagcagaatgctgaattaataaatatgagcattatttttagggcttttgaagtcttttcacaatgaattttcatctctctcacagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatgtgggtcccattttacccttatcaaacactgggcatttgattcttaaaacttcagtttacctgtgagacagaaggtttgatttcttttcctttttttaaaattttgagtctcaatacagagtttagagacacgggtgaaaggcagagcccctcatgagtgcccgtgtgagagaggccctatgtcttcaaccgcacaggtgcactgtaggcctggggctcagtcaaaggggtagtggtggatagctttttaaaaggcttaattcttgtattttctacaaataatttaccatgttgtactttagtctttgaaagtcctttggcactttcagcgtttgtcctactaagtatcatcttgcttgcatatctgtaggaagaggaatatcacagtggtacttgcaaattttttaaacacctgattatttttcttttccatgttctggtttttgtgtggttcttttctcattaagggtagatgtttggtttaggattcaatggctctagatttgattaaagaatcaaatcatgtgctcccagagaaacaatgaattcaaacattcacagccttgggctggctgtagaagtggaggtttaaggttaaactactaaaattatgaaatatctcttttgaacaaatcactttctcttttgttctttttctcactaaatatgtagtattaaagtgtgattagttaaaacaatgaagagggctttgcctcagacttaataagaaaggtagaaaaataacacatgaaacttcagaaatctcatactgaaaaaatagaaagaaagaatatggacagtttttatttgttccttggatacagaaatggacctggaaaagcgtgtgagtgttttttttagtgtttgaaaattgggaaaccacaagttgcacaaataatgactcagccagccagttcctctcaccctgcttttactaagacacatttcttacaaggaaaacctgggctgcttgtttagcagaatgatgagaattgcatttggagtttctagatgatttaaagttcaatgactgtgttgcttttagtgtacatttgtagtacattttgagtcatcctaagtggctgcctccacctggcaattcttagatgaaaggctgagaggtcagtcaaagacgggggggtcttcactatttaaaacaacagtctttgagacttctagggaatgtgtataaactattttatagtatcccccagataggtttgaaaataatatagcaaagagttttaagttcatcgaggtttaatttttgtgcagtaaacagtatctgttgatgtgtacagtttgatgagttttgacacatttggttagtgccggaacaagcaccacaaatacagaacctttctatgctgctccaaggtttcctgtgctctcctttgaccctggccttcatgtgaccactgatctgctctttgtcactaaaaactaggttacttattctagaatttcttgtaaatgggatcatgtctggcttcttgtactcagcagactgttttggggacccaggcatggtggtggtggcccagcagcctgctccttgggacagctgagtggtatccaccatatggaggcaacccagcttctttatgttttcatccatgggttgcaactgaggttgtttctctttgtcagtgattgtgaacacagctgctgtgaacatttgtgcatacagctttgtgtcggcacacatttaatttctcatgtgtaaatactaaggagtggatttgctaggtcctgtgtggtaggggcatgtttaacttttcagaaataagaaaccaatttaaaacttaaataataaacttcctgaaacaaggaagcagaactaggcaattctgaggcttctgttggtaaagtcggtcatgtgagcttgtggtggcaggctgcttgatttcttgtggttttaacacacacagactatcccgggagcagcggaaagaagactggctccagggttggggcctagctttgtatctctgttttgcttatatttaatgatgaggatttaggtatatatgtcatttctttagcatgtttcctcatctgtaaaaagttgaatgttatcatcttaaagtcccatacaactataatgctctatgattgcagttcagacttacaatggttcaacttaatgatattttgactttatgatggtgtgaaagtgatacatattaggtagaaaccatagtctgaggactcatacagccattctgctttttactttcagtacaatattcaataaattgcaagagatattcaacaccttattataaaatacgctttgtgatagatgattttgcccagctgtaggctaatgtaaatgttttgggtacacttaaggtaggctagactaagctgtgatgttaggtaggttagatgtaaatagatttttgacttacaatattttcaactttttatgggtttattgggacataacccaatcagaagtcaaggagcatttttatttcatgtggtagcataacatgttaaactcacattttcaacatcaaccagccaatgtaccctcaaactactcacaccttttaactgattgtgtaaaaaccaggtcagcagaaggtgagtgctcttggcaggatgcatgcgccatcctggagctgactggattgctgacgttcacagtatcagcaacgcgtattctccatgctgtcttattttctctggcagatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcagttagtaaacagttgtctctctgctcctcctgcctctgcccattgtgtaaggaagtgaagacaatagaaagagacacttaaaaaatcatctgtgtctacatttataagatgaaataattagcaaatggttgttaactatggaattatgacacagccaccaacactgagaatgtcagaaaaggcttctgtgggaaggcattgaatttgatttgatttgtctttgaaatgtggaagagatgagcacatgtaagcacagaggctgttgatggaaactttgtgtatctggagtaaaaggtccctaggggtgtcctgaaatgaaaagaattcaaaggcagcgggaaaactggttgtcaagaagctgattagtctgccttttctctccttgatccctagctcttcctcaactccttccttccttcctgtcacacacacacacaaagattaagaaaaaaagagccttattagtcatgctaaggagtttgaacttcactgagcaagtaggtgttcatgagtgggggactgtgattagcctgagatctggaagatctctcctgctagatcatagcaggtgccatgggagagactagatacagagtggccagtgtaggcaagaggtggtgacagcctgatttatggtcatgccactggggtgcatgggccaggaaggcctgtatttgaagactattcaaatttagaagaatcaggtcatgttgactaactggttgcacaaggcagggagcagagaactcccggtagggtcacaaacaattggtaggacattggttggtccacatggggggctgaaccctatatgaaagtggaatagcacaaggaagatctagagttgagaatatgtggggagaagtggaaaggaagtagggtatccaggatgggaagcaaggcaaaatccaggcagtgtgccctggctcattggacattgatagaagtttagaccagaggtaaaagggagagacagtaggttcctgattagagaacaaagtggtgtttgagggtgatgaccatggaagcatggattggaggggaagtggagcaatgaaagtcatggagagtagctggagatagaaacattaatccagtgctggggtcatcgattcagcaaacagtggtagttaagtgtgcaggccgtctgtcctgtgctgggctctgccccctcaggaagatgcatggctctggcctcctggggctagtgctgcatgcttggcaattccaatggatggactttgcaaagcagaacgtcaaccatggcgtgagtgtgtggggaaggggcccttggaggcaagcatgtaagtataactggtaatggactgcacattcctaagaagaaaatgtgaatgtcatgaattcttacagaatattgttattttacaatatttttgcaagctttacatttataaataagtatttacaatctgcatttaattaaggtgaaagctcacagggtttgggtgttgttttgtatggtgtaaccttatttctttaccactttttccgctatgtgcttcatgatggtggagctctaccttggtgtttctagccctggaacactgagaaaaagaagaatgagtcttaaagttgtcacacattccatgtgccgttggcgatatgaccagagaccaagtaaaacgtttgcaatgagaatgctccattccacccttccttttacttggcctctccaggtgccattgcttgcttctccatccctgccattgcaggtcacccctgcatcatgcctctgtagagatgccagggctgcagctggccttcctgcctgctgtcggcttcttctaccctttcctccagcccctttggctcacttctgcaaagcttatcttgtccccaaacccaacccccagctgttctccccagatcatggtctagcttcctgatgtcacgtgctttcagtactccacatggagtgctccttagaaatgtacccaggtcctggcccttctctgccaactgcccttcaaggactcacatcacttgaggtataatctaaaggtatggaggcctacaattgtgtaatttacattcttgtgcctattgtctcagatttattatgagtgcccccttccacctcaaaaccctcctcctttggaatataaatttataaagccctgccagcctctcttgctttacctgatccttcattgtgtggtgcctgctgcgctggtcttatggtggatccctgagcacactgaacaggcccttcgctgcgttcgtgttgtgatgggctccgtgtgtagcctgcctcactgccgtcctggctcttctcagacaccatcttaccagagcagacttcctgagcattctgtccagaacaacttcccactcactctcctgagtcccctctatttctctggctcttatttacgacatttatcatttcatgacagcctctgtgtattagtcttctgtttctttccaccagatagcaaaccccttgactacagggacgtagtctgtttggttcactatagtataataagcattctttgagttgaataactggatttttttttcaatttttatttttatattttttccataagttattggggtacaggtggtatttggttacatgagtaagttctttagtggtgatttgtgagattttggtgcacccatcgcttgagcagtatatactgcaccatatttgttttattttatccctcaacccccttgagttcagaaagaaacctcaggtgcaaacaatgaagctgaataagctctactggggggtgtgtgaagtgggtgcagggggtcagctgcccttggttgtatggtgaagggtcatagcagaggtaatgattgagcagcaggctacaggatgagtaaggatgaactggggttgactgcagtgggtgggctgcaatatgttacagcatgtgcagcttagagcgtccacaggcctctctcttgcaggcctgtgcacaggcacattacagaagcttcctaagccttgcaagattttaggttttgttccttaggctgtccatgggcatgaggcctctggagagtgctgagcacctgatacgatggccgtctaatgatggttcacacactctctccagttgcaggtggaggatggggtgggctggggtgagcccaagtcgcagggagagctgggggctcctgcactaagaacagattaggccaggagaggtccagtagggtgaggaggaaagggagatgcagacccaatggggaataagagaggagggggcgtccatggtattccccagatgtctggctcaggcaagcacagtgtttttcaacatacagttgactcttgaacaacacaggtttgaaccctgcaggtcttacttatattcaaatgttttcaatacaagtaacacccagtgtgcctacctcttctgctacctttccttctcctctgcctgacctgcctcaaccacctttgagatagcaagaccagctctccccttcctcctcctcctcctcagcctactcaacgtgaagatgacaaggataaagacctttatgatgatccacttctagttagacaatagtaaatatagtttctcttctttaagcttttttaaataacatttttttcctctagcttgcctcattgtaagcatacagcatgtaatgcatataacatacaaaagaggtgtcaactgactgtttacattattggcaaggcctccagtcaacagtagaatattagtaggtaagcttttggggagttgaaagttatacacagatttttgactgtgtacagtgtggtgctttaagtccctgcattgttcaagggtcagctgtgtgtatagagagagcctatttgagaagttggggagaggaaagtgatgagtttgtcttagagatgtgagttgaaggagtctggaggtttctgatgctgaggccagctgtggtgctaggctcccaccagggcactgccggcctgtgctcctgcccatgctggttttccttatttattaccctcccctccactgctacctcagtttccttggtgtgcccaaatcctgagatccttcaaggaccagatcccctcccaccatggccttgggatgttgtgcaggccatgtgggccagggcaggaaagaagccccttgtgggctctctcagatggccagaggggccttctgcttccagcctcacctctgcaatggctacctacattgtataaaggaggactttcatttgtttaacatcttttttttgtgccagccgctatggtggatatgtgccaggaacttacatgagtgatctcattcaagtgtcttttccctgggatatgggcagaggctccaggagatggtgccatgcagctcggagagggaagccaggatctgacctaggactctcagatgcaaagtgccttctgctgcctttctttcaagctggccactacgttgtagcatgtgggcatggtctctgcaaagacaaaacccactaggcggagagagggcagattctctagcacatttctagtgttgatgccctaatgggagtacggaccctcattggggattccatgagtctgagaagtgaaggtgatttgttaacagttgctctccctggggttagtgaatgcagtagctttaaaatgcactctcggaacttggcaggcagggcaggtgtgtcactagcaacccacagtggggaacgtgtggatgaaggatcgctggtgcattgtggaacctgcctctggggcatttctcttgaaggaatctcaccccagtaaggtcagattgcaaacacgggatcctagaggggctaaatgaggcagtattatgaacattcttttggagatacgaaacaaaacaagatcacaaacacagaatacggtagaggcttttctcttttcatagtgtctgtttttgtgtccttttatatttgaattattttaaatttgcttacctctatcagattgatggattagcttcagttcttgtgggttgagccctgctgggagtttgctgattcttgagtgtgatgagtgcactgtggccttgtattgatcaattctttgtagttttgaatcgcaaaattaggagacctggaggacatgagaatacagcatattgctagttccagagaaaatggggaaggggaacagatactccaagagatattgcctgagaattttgtagagttgaaatgcatcaatcctcagttttagggagcacagcaagttctgaacaagataagccaaatgaatggtttttttcttactgaattcttatactgcaaattgtaatttgcaatatatactcatttctttcaaagtgtcaaaaaactccttataataaaaaaaattaaaattgtaaaaaaaaaaaagaatatggtagaggcacatattacccaggggtcagggtctgaaaggagggcactggggaaaaccatgctcacattacccctgaaaatcttttagtggagagcagcattggaaaatgacaaagtggctctctagaaatgcaccactgcattgcacagttttatttttccatacttggatgggatcagtatttgtttagatgatctcaaattgaaattcgtgcctgtgtttagagaccagctatactataaatgcatgtgtggaaaaagccaaatctccttctggatggatgctgacactgtgagggccatgtgcaaattaagcctgaattgatggaaaaagtccttgagggaccgaagtccattgttaaagtgatggatgatactatacattttatttaaatcatcctttcttcttttgtcccccgctcagcattcacattattgtcataatctctactggagggcattctctactggaaggtggctggttcacatcttgtgctgtcttcagagaatggctggaaatagtaataatgttaatgacagtggacacttggatatacatggaaaatatttagtttgtactattgaaagctgtcttaaatttgagtgggtacttaacgagaaatagctaggtatcttatggactatatattatgagatagcaaattggctatgtccaacctgatttctttaaaacaagtcataggttacctattgtaattttttaaaatgcatctaccctagaccacagtaaactctattgtgattgagattgggagcttaaatcaaacacctaacaatgctacatttgcttcatctttttttgggtgccaggcaaccttaatgattatcagcgcacagagtgttacctagcaacaaagccaatttgcacaaaagcaaccagaataagatcatgttttaggatggtagtcttcaattagagaaagggaaaactgcaaacatctgatttagatccaacatgctccctattactctcctgtatcaccgcttggtttccttaatgtgtagcttcattaaaatgtgacttcaagggaggttgcatccctgctagaatctttagagtaaacatgtgtcaagattcagatcattactgttttgcccttaatttggcctaaagaagataagcatagtcaagagaggaactttgttagacctttaagtcagtgtgatgttgttatgtagttaacgttactacttagagttctggagttcaccatgcaactcaggttggaggtacatttgtttgatagtaatgagatcattgagggcataagtgaaggaagattagaagaggggacaaagcattgatccctggacactccaacatggagtgtatggagagatggggagaaaacagccaagcaggcaagaaagagaaatcagtagcaaaggtggaagacaaggaagtgaaccaagtccactaatggtgagggtgtgatcagaccgtaaatgctgttgagggtcaagtaaaatgaagacttaaaaaatggcctttggatttagtatgtggagggctctagtgacctctggaagagcaattttagtagtgtgaagggaatgaaggtcttattagagtcagttaaagaaagagcggaagaagagaaattggcagcagcacatcttaggagttttgctgcaaaaaaagcaaagaaatatgatagtgtcaaaaaggaaaagtgaggtcaagagaaaaaatgctcctcttccattcaaataattcaaagacaggaatcacagcagcatatctgtacacagatgagaatgccccagtagagaatgaataattggattgagctacagagcaggtggcttgctgggacactattctgtatgggacaggggaagggatttagacaagagacaaggggttgtctctcctgagagcacagcaggctcacttacaatagaaggaccaagagctgagtctgtgagtacttccattagcttcattgtttttcaaggtagagtgcatgcacagaagggattataaagttaactagtcagaagaggatgcatggaattgagagcctggagaagatgtgtttgttagaaattacaaggtctaggatgtaacttggttgtgagtaaatgggattggtggagtgaagggaggatatgctacaacaaatactaataaaatctctaagaataatgataagagtagagctgaagaaagagacagtgcacaagagcagattcagggatgggtagatgacaacagcaatgacaacaacacccaacagtggatgatatgctcagatgacctgagattcaaggctgggggcttcagcagaggtggggaaggtcacagtgagacaaaaggagacacctgccccacatggagacccagtgaaggaaagaaacagcagttatagaacaggatttatgatgggtatgtgttctggctcaagcctttctctcctgtcttatctgaggtcattgtatggttttccatgtatttcaaggacagaatctctttgttccttgcatatgctattctttctcccccaggtcctggcaagtgctttcctcttttttttttttttctggaacacactgttcaagcatccccacttcacttactctcactacccatctgactgatttcatatgccactgtctctggagtcagagggaatccctatagctcctgggactttatcattaccctacttacctatactcttattataatttcttgcctgtcttttccactagaccttgaatttcttgaatcaaggataagatttgatttatttctctagccctagcaggtggcaggtgccaggcattgtaggggttcagtaaacattccttgaataaatgaatggatgattaaagagcagcatctgaaacacattctctggtgcataattgggtcataataggagaaaatatcttttcctcctttccctgctgcctagcaatgttctcaattagaggattatcctgtccttttgagaaggaatttggaaatgtaactttgaaaaaattatttgcttctttttgatatgtataagatcaataactagaaaaacactagcctctaaataactttaaaattaaaaaaaattcaacagattaaaaacttctggccagtgtttacaaattgctgtcttctttaatttttaagtccactctaagcatatgaacaatgcccagaaaccagcagagtggaaatgactgggctttgcaatggggttctcttcctgctgcaatgataggtgttcagacattgttttgctgaccctggccaatgcctcagtggcttagagtcctaggaatgtgtcattctgtacaaaataagtcaaggacttttacttccattgaccttagtggatattatattcactgattaaaatgccatgagtgctaattatcttcagcctccatgcctggttctgggaaaacagacataataagtaaaggggcttgttcttggggaagccccagtccatgtggggggtgagacacttaacaggtacatatgatacgtgtcacagggacccagtggatgccagtgtgtattctggcttcagagtgctagtggttaaatgcagttcttccacttagaaagcttttaacaatatatgctatctctctcttgggttttccaaatacaatgtggttctaataatgagaagaccctcatttggaggttatgtggattataataatttatacacacaaagcacttagactagtagtacccagtgtatgatacatgtctaataaatgttaaatatgattatctaggcttggagctaacatttaaaaaataaaataaagtgactgggatttcctctgtaggaaagcgtttatgaaatgaatgaatgatattcttcagaattatagattctacagtattgtgatgtgatagaaagttctactttaagttggacctctccaagaccaataactcaccatctcctgtgagcttcccatagcatgttgattatacttcatctgtaacatttatctcattgtgtcctaattggatatatacacatgatttatctagataactctgatttcctgcagaaggacctgtgcttcgttgctctttgatgcccctacctttatacccaatatgcaaccagcacctatgatgctatagaccatttgtgcaatcttgcaagaatttataaaatacacatgaatgaaataccctcatcctcacttcctccaccctatcattattacctactgctcttggcttcaagaattttaaaacacacacacacacacacacacacacacacactatggggagcaaaattgtccataaaatgtgtttgtatattgaaattcaaagtgcatcaggaaaacaggcctccactaaaaacagaagtaaaaatacagagtgaaccagatcggtcagtttaatgctaaccagttgcataagatataatagagagcaggccccagcttctttgcataaatttgattgtagaagcatggttggtcccttttgcttacatcttgtttgacacctgtgtagtgaaggttctgtgaaggactgcacaggtggggacaaagtgcagggggccagaagcgttcctgaagttcaatgccaggtgtatgaagaggaggtaggcttccagcttgcttagggtgcacaatgaggcagcagcgtggggccaccccagagggtaccatagacatcccaagtagtaccaatggaagaaatgaagaaggaggggtttggggttgaacacagaaaggtaaccagaacatgcacgtttgagaacatctgacatcttactgacttgttttcttgtctatttgtcttctctgctgactgatctctggttaatgtgctaagtttaatagatcgacctcctctgctagattggaatctcgcagctgggaatgtgttgggagattgcagggctaggcagttacctggtgaaatggaaacatttgtcttcctccttccaatagggtgttgtccacactgggaacacatgaaaaacaggagcataaattattactataaatttaggttgagatttaaccagcagaaaatgcactataagacttggatgaaacattaagtgcacagagtgaacactaaaccctaagaagtgggcttgaactctttctagttcaggatgggaagtatttacattaaatatttacttagtcatcaggcagaaaatgggattcacccaattctttgcttggaattctggaatgttccaggccccaactattcttgaagctcaactgtctggaacatgtcaaatcctcttctgcctgtctagccttctctctggctgcaaaatggcaccatgacttcagctgctggctatcaggaaggtagaaacatgcctgcagctccgaggagacactccactttggtttgagtggtcaagggaaggtttcaggaaggcattgtttaaactgggtttgtaacaatgagtaagatggtaaataggtgatgagggcagtaagtattcctgtagagttaacagggccacagtggtgagggaagttatttgtgagaaaagagagtggatccctggaagaggggtaaagtttcacatggggaaggctttgcactgggtatctgagatctggaactcctaagactgaaagatccctgcaacggaacaggacacttgttcttacattaatagcaaatgataatttatactttgcacgtggcatttcactggaacatctgcattaatcaggaaggtcgggtgatccagatttagtggacagtggccagggagtgaagggcttctctgctgagcagtagagctgggcctgccttgcttcttctgaccacactggtacatcagccattccaccatactccataccctgtagagggatgcagggccctccctggcagaaggtatgagtgaaatgagagacatgcttctccagagaggagacaatgcaagcatttccaagcacaattctgggcagatattgctggtctgcatcacggttggtgtcccttggcgtggttccatctgaacctgaagaaagtcaatgctgctctggtgagactcacgtgtgtgtagcatccacacctctgtgatatatttgtggtttataacgatttcagccactgttagtcattatttctggagtgaaattagaagcaaagttttaaggtgttcagggagaagagtgatgttttcttctaatttcagaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtaggcactgggcctcattctgccttctcttcccacaatattgtgttgcaggaaatgcattgctactgtacagtagaatcaagttgtatcccagtgaggctacattatccttttcagaaaaatataaatttttaaaagcacttatagggatatattcgttagataacatctctatagtgcttagaattgcttactttgtgtttgaccttttaactcaataacagcaatgacatctatgtacattatacattatcatacatgatttcaaggaaaattgtcttcttctggaagcatagtttcttagaagaggcatcccagatcataggacaagcctcccttgtctcagatgaagaaatgaaggctcagagagacgggcatgtgatttacttgtagctacagagaaagtttcctgaactgagggtggatgttgaacctcttgtccatgtttctcacatctattattgtttctttccaatttaggacatttgatgggcagttactaatttccaacttctgattctttctgcaatcctgacagctaggaagcattgttctatgtattttctgtgagaatactcccttttggaaagaaacattgcaacagtaaaacacatcttggtgctggtaaataagtgtagaggcatcagtggcaggattaatacagattctcataaaatgttattttgctttttcttttgccttttgagtataaattttcttctgacttaacctaaagtctccatttccctggaggtgaactaggatttgcaaaggaagaaataaaggaaaaataacaagaaagagtccttctttttcttagcatatagagggctgaggccagaagtcttggaccatcaaattctatctttggagtagaaaaggtactccagtctgtcacttaaagcttaaccataggctggagtcagaaaggagaaaaataacaaaagggagcatagaagatcaatctgtttctttctgtcccacaattttgttggaattatggaaggagaagatagatagaagtgggaaaattgagcaagcagatgtgactttttgttccactctgggctttggcctggcctgggcaattgcactagaaaagtgcaggccacatctgcggtgctggctcctcaatcatggtgcagccacatcggagttcacgaggctcagcagaaatccaggtcccagtgaggcactgagggctggtattccctaccttttcatgcccatgaactttgacattgaaagacagggcttgctaggcatgctgccatggaagtaggggaccccttggagctagctggctggaagccagggcagagattcagccgtctgcagtcagcaggacctactgtgaggcctagacagcctgggagcactctgctctggcctgacccctttggagtccaagctacaaatgccaaggtggggaggcaggcagtgccatgtggttttggttgacacccagacaccagatgaccctgaccacattgcacccaaagattcgaacccttccccgttgccacaagatcaagaagactcctgactccatttacctaagtgtctcttggggaaagacatagaaagggcagacatgggatactgaccaccacttcaaaagattgattaaattttgagatgcaacgatttaaactggacgaaacaatttgcgcactaccctggctggggactgatgcggaagatcaatgggagatagacaaatagataacattgtctctgcacctgtgaattgtggtgcaaattaaataccacaagcccactactcttgtttagtttaaaaattagagctggagtctcaaaggtttagctgacagaacatttttgtaatgagcacaaaggttattttagacagaaaaatagatacaatgaaagtctcagaaacagacagttttcttcagtttctgttgttacaaaccaaatattttctcactgtccttcgttgtttagcaattttttttgtctttggaggacttttttgaaatcatccctgcactgactgaagtgcaaaatcaatagtatgtaagcgattagataggcggtattggaagaaaaatgtgttttcaagaatcaaaatgtatagccatttctgaagcagcccaaacctctaggtaatcatagagctctgtgagacagatctaaggactgtgcagaaacaaacacttccttctgagaagaaagagctcttctgtcggaataccagtgcagtgggggctcagtctacctggaattttgtgtgtgtttcttgcttagttatgtacagtgagggctcttgatcagccctggtaccagtatttctgtgtctcccatggaaaaataaataaggaagcaaaaaataccggtgaaaactggcacatctcaactaaatttctgttctggggtatgcacttgctctacaaatcccatgtgaccctgcagaaatgatcaaatgcttctgagcttcagtgttctcatttgcaaatagagacaattgtaccatctcataggatgtgagagggcacagttgtatgtgaaagtgcacagttctgtatataccatgtgtgcgctcaatcaatgacaggttatcattattattattaaaatagacaaggggcgaatgtgggaagcgcagcttttggaggaacatatcatctgaatcagagagagaaacagtcaaacagtgtcttggggaaaacagtagcattgctctttgaggccgggcatggtggctcatgcctataattccagcactttgggaggccaagatgggtggatcacttgaactcaggagttcgagaccatcctggccaatatgatgaaaccctgtctctactaaaaatacaaaaattagctgggcatggtggcgcatgcctgtagtcctagctacttgggaggctgaggcaggagaatcacttgaacccgggaggcagaggttgcagtgagttgagatcgtgccactgcactccagcctgggtgacagagcaaggctccatctcaaaaaataaataaataaataaataaaaataaaatatatgtatatatatatattgctctctgaggctttggatgtgtcttgaatttccttaacagccactaaaaagtcatcaagggtcaaatgcctgcaaacttaattgaaattctttggaagtttattcatttatttattttcccagcttcattaaagtataattgacaaatgaaaattgtgtatttgtggtgtatagagtgatgttttgatacactgttgactccttatatccatgggttctgcatctatgggttcaaacaacctcggatcaaaaatattcagggaaaggcctggcacagtggcttatgcctgtaataccagcactttgggcggccgagagaagtggatcacctgaggtcaggagttcgagaccagcctgaccaacatggcaaaaccctgtctctactaaaaatacaaaaaaattaaccaggtgtggtggtgcatgcctgtagtcccagctgcttgggaggctgagacatgagaatcacttgaacccaggaggtggaggttgcagtgagctgagactgtgccactgcactccagcctgggtgacaaagtgagactgtgtcaaaaaaaaaaaattttcagggaaagaaagccaataagaaataataatacagcaataaaaataatacaaataaaaataatagagtataacaactttttttttgagatggagtcttgctctgtctcttaggctggagcccaatggtgcaatctcagctcactgcaacctctgcctcctgggctcaagcaattctcctgcctcagcctcccaagtagctgggattacaggtgtgcaccaccaagcccagctaatttttatattttttagtagagatggggtttctgcatgttggccaggctactctctaactcttgacctcgggtgatccaccacctcggcctcccaatataacaactatttaaatggtatgtacattatattattaataggtattatatgtaatccagagatgatttaaagtatatgggaggatgtacttaggttatgtgcaaatactaccccattttacatagggattttggtatcttcaggggtcttagaaccaatgctccacagataccaagggacaaatgtatgtatacattgtggaatgattaaatcaagctaatttacatgtgcatcacctcacatatttacccttttgttgttgagggcacttaagatctaatctcagcaattttctggtatataatgcattattactaactgtagtcaccatgctgtacaatagatctctagaatttgttcatcttgtgtcactgaaactttgtatcccttaactaacatctccctccttctcctccctccctgctccctgccccgccagctcctggcaacaaccattctactctttgcttctcttttgggaatttagattctagttgacttttatttttagacttcattgtatgggaatgtatcatctgaactacatgatagctctagtcagatgatctaaactgcctttaatcctagatcagggattaagcaaattttcttagcctcaaaggtctaacatgcaaggagcttggccttgggtgtggggacagggacatacatgtgcaagaactggtcattgtggaccttcaagctctattgcttttgtgtctacgttccatagtttatttgtaaatgcatcttttttttaatgtattgaaagtcttagtcttttaaggtgtctcctctattattgttattttttctacttgcattttgtttttaattgacacatgataattgcatatgtttattgttttgatttttttacttacattttaaattcaggggtacatgtgcaggtttgttatgtaggtaaacttgtttcttaggggtttgttgtacagattattgcattgctccggtattaagcctagtacccattcattatttttcctgatcctctccctcccggctccctccaccatctggtagacctcagtgtgtgttgttccctctatgtctccatgtgttctcatcacttaactcccacttgtaagtgagaacatgcggtgtttggttttctgttcctgcattagtttgctaagcatgatggccttgagctccatctacattccaattatgggttacagtgtgatgttttgacacatgaacacgttgtgtaatgatcaaatcagggtaattagcatattcacaacctcaaacatttacttgagtagagttaaagacatgtttagccttctctctttgaaaatttacctttggaacaagaatcagtcaatgagtttctttctatttaataaaacggaacaggttgaatggggctcagtgaaagccaatagggagtgtcgaagctaaaagcagcaacatctttttacataactgaatcaacttcaccaaaatatcttctagtttctttggcctctgctctgctaaagctaaatctgaggcttcttctttacaagcaaaagtcgtaaaacttgacaagatgctagaatgcttagagaaaacatttgaatttaatattggtttctgccaaaggaagccatgcccactgggctcactgatgactttcctgccaggaacacccaagtccccctccaccctggctccctgtgtccatcacccacaacatactctcctctctgtggttcatggctactgtgagcttttccaggaaggcattgcatgttctgatgctgctacttggaataatgaatacatgtggttacatcatccctgattccaaagggtatcaatgtataccatggccatttcagacctcttttttatcactgatttctgccttaactcagtgctatgattttcttattcaattgcgcttccataaaatatagccttctccctacatacatctcccttgtcatccaaagaagaatgaggagggccaggcatggagggttcacacttgtaatgccaacactttgggtggccgaggtgggtggaccatcggaggtcagaagttcaagaccagcctggccaacatgatgaaatcccatgtctactaaaaataccaaaaaaaaaaaaaaaaaattagccagacatggtggcatgcgcctgtagtcctagctactctggaggctgaggtgggagaatcgcttgaacccgggaggtggagtttgcagtgagccaagttggtgccactgcactccagcctgggagacagagcaagactccatctcaaaaaaaaaaaaaaaaaaggatgaggaagaggactttagtatctgaggagagagataaccacccagcttttttttttttaatttattctctccgttcattcagtgatctgcttcaaagacagagagaacagggggctgtgcacaagcactctgttttgccccccagtttcactctccgtgcctggcagagcacccacttttgttcatgggggtggggatgggagatccgtggaaactactgtagaggaaagagtttcagggcctcgaattggcaaagtggccaggacgcatttcaatttttttcagtttgaaaattggtgaggatctttaaattgtgccctggatctaccatcctgaggaaaggagggaaggtcctcctggggcctttgtcctcctggtgctgatgcaccctgtgcttggacccaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcaggtaaggagtgcaaccattctatctcactgaagtcccatttctgtctgtggcataagaaacaagtggtgacagttacatagtaataacgtctcagtggaggccttctgtgcacaatggcccacatgccaaaataagtggccccaggcctgtgcagggagcaagcctctgggaacccaagcatgcattttgaccgccaggagaaaatacatgaggagtcagaattacctgatagataacaggagctgctgtgagtgtcagggccaggaagtatatgacctatgtattctagaaattcttttctctttctttctttctttctttctttctttctttctttctttctttctttctttctttctttctttctttctttttctttctttctttctttctttttctttctttctctcctttcctttcctttccttttctttttctttctctcctttcctttcctttcctttccttttctttctccccttcccttctctttctttctttctttctctttctttccttttcttttctttctccccttcccttctctttctctttctttctttctctttctgtttctctttccttcctttcctccctccctcctccttccttccttcttttcttttcttttcttttcttttcttttctttcaatggagtcttgctctgttgcccaggctggagtgcagtggtacaacctctgttcactgcaacctcccgttccaggttcaagcaattctcctgcctcagcctcccgagtagctgggactacagacacatgccaccaggcccagctaatttttgtgtttttagtaaagatggggttttaccatgttggccaggctggtcttgaactcctgacctcaggtgatccaccaacctcggcctcccaaagtgttgggattacaggcgtaagccaccatgcccagcctagaaatatttttttgacaacgatattaccctcctagaggctaaaactttgccagaatacaagagagtagtgagggtatagagcaagtggagtctggcccgagaggctgaacttgggtcacatctgtagtcatcattgcctgtgtcaaccgggggcaggaagtggtgactctggggctgggattcagggtgtgtgggaaatcacctctccactcttgatgactgtatttgacccttggtggcccacgaaaagtcttccctcacctctgagccaaggttcctgtttgcttcctctctcattcagcgtgaatgtcattatccccaggtggctcctttcttctttggctgagaattcttgtctcccttttaagactccttcaacccagttttctgctgttcaatgctaggcccaggatctctctgtgactctcccagtggacggggggcacttcatgaatacaaacctctggaggctggccatggcaggcccagtagctaagacgggcatgttggggggcatgtgggtgtggcctcacaaggtttatcactgcagatttatattttttaaaaagaaagaaaaaaatacgagatgtcattgagatgcctattgcttaagtgtgatatttcatttaagctttgaaatggagttttgaaataatttgcttatggatatacatgaaatcaattgatgtatatatggattaacattccttactggcttcttttttccttttttttatggatagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtactgagaaaactgaagcgtgctttaattatttatgcctttttgaccagtccacattaaatgaagagatgtgggtaaagggggggagatgtgggtaagggggaggagtgtgcacttttatttacatttgatttctgattggtagcatactagatgccaataactgaacttaacaggcctgacaggtggcaattgccctttaagtgaaatggcattcttttagcattctttttttttgttttgttttgtttttgtttttgagacgtagtgcaggctggagtgcagtggcgctatctcggctcactgcaagctctgcctcccgggttcacgccagtctcctgcctcagcctcctgagtagctgggaatacaggcgcccgccaccacgcctggctaattttttgtatttttagtagagatggggtttcaccatgttagccaggatggtctcgatcccctgacctcatgatccgcccgcctcagcctcccaaagtgctgggattacaggtgtgagcccatgcacccggcctcttttagcattcttgtatttgagaagcttggtgtctttaattcagaatcatgaggtgtttaaacagttgtcagtagtggttgattgctggttgtaattcttcatgtagagatgccctcctctttctgcttctgtctgggagtctctggccccatgctgggtatccgtgatgtgagagggtttagcacgggaacactgcagacgcctggtgagctcccatcccccaggtcccacttttctctacctggatctgaggtggatgagaccactccatgtgggttcttcatagagtacacttaacaacaggcagaaataggcgtttcctccaggaggacattgctacgttgtgtgacccaacctgaggcatgccttgtttggggttcttgaggttggctctctgtgtgggcagtatttgagccctaattttacattgctattatttatataaaatgtcacgggttttcaaaaaatcaagtgctgcaagttaaaatttttaaaaatctgcaaaagtcaaagtctgaacattcagttgtgttttggaattgattccttgggttagtgatgcaggaggaaaggcaatcttttgtgtgataaatcagtgtggtcccaagtagatagcctccatcacaagttttgtctggaataaatagtcataaaagattgtgaaacataaaaaatattacaaaatgcttttatacatagaatgtatttggttcccctgaaactccgtaacttattattcctattttaaggttgagtaagctgaggctcacataggccaatttctttaccccaaatcacgaaggtcgtaaatggtgagctctacttagacctagggtttctgatagttagtcaagttctctaaattagcccatacctttgtggttgatgctctgtattccatgcatcatcaggactggagtccatccattcccactgcgttttaatagagcaagttacagtgcaagagacaaacaaaaagcagcctaataaacacacatgatgaataggagctgttttctaaagccaaaggatgcggtcactacatcttttcttgtctggctgtctcctattttcattcttcaagtcttgacatgaacggcgcctctgcagcggattcccagattcctcagcatcaattctgttccgtgttctccccacccgccctcactgcactctgaagcttttcttcgtgacacttctcccaacttgttatgcatgcttctctgtctctcccatggacgctgagatctgtgagtgcttgtatcttttctgcccacctctatagcagcagtgcccaggacagttactggcactcatggttgcttaataaatattttctaagtgaacaatgtgctgaacctttccaaagattcatccagctatatttttaatataaaatgaatattttattatttaataaaataatacatatatattacacataatatacatatgtatacatatgtaacatataatatacatacatatacatatattacatgtaataatacatagatatttaataaaacatatatatatgttcagggtttcgttgtgttgctcaggctggtctggaactcctgggctcaagtgatcctcccaccttagcctcccaagtagctgagactataggtgtgtgccactgcatctggcaccaagattttgatctttaaaatggaaaaatcagaacagtttgcctggtttcccaaggagtaacaatcatgattaaatgcctggaacaagtctgtcaaaaatggtaatggcttttctcacttacagtgggattgcatgagacgttgctgccgtagctttggagtgaccacggagctaaataacatctatacccccaaaagtcacctttcctccaggaatttttgggagacagcagtcttccctgggccaatgtagaacaagaaggaatttcctaagccccttttccccagattgcatgagtcagaatgcaggtttacagacgtgctgctaactaaagcaccatacttgaatgcagctatgtcagacaccacagttgtcactatcttcttaaatgtgaataacaagtccaaatattatattggaagctaatcatttggacagttgagagctgtcagctggcatgagtcagtttccctacagacagaaggaggcgctgcttccaggggtagttttgccatcctgggtcacttggaaaagaaaaataaaataatttttttggggggttatcgagagaaattgtcaaaaaagcccagacttcttatgttcatgtctgtctctctaatcattcaccgggttaatccggttgtttactagttgtatggtgtcttgtacagataaattgaacatattcataagctcactggactctcagggcagggaggaagatgctgtaggaatatggaccaagcacacttatcagtgaaataatgagtgttcacccccaatgtatttactgatttgcaattaaacacatgcgacaggaagagtgggtgttccctttacgtaagtggcattttgcttgttgttaacaaaagagaaatccttggtaatacttttaatttttattattaagaagagtgaaattttgtggaacattttgcttcaatattttatgaatttaaatatcacagaaaaaaaaactggtgaggaaagcctttatatcacgggtggatgcttagctcttaattgttttgttaattattgtggcatatatgaccaatcaataatatctccaggtaaaacatacatttagggagaggcttattcataaccatagcacatgtgaataagatacttcagtattctttttagtaattcccttccttcctgccttccttccctacctctctctttttgcctcccttcctccttcctgcctacatccttctttcctccctaattttcaggtctgtctgaatttttagtcacatctgagactaaaatgaagatcccacaggagtaagaaagtgtcagctgtgctgtttcatgtttgctgtgcttgtgttgctcgtattatcttcagaatcttttaaagccactatctcctttataagtgttattttagtaaaaactagataaatcaatgtaaaaatctacttagacaggcctctacaaagctgcaacctgttgaaacttgaagaactgtcactgtggccacagaggccaccagtgctcctatcagtcttaaataggaggaattctttatgtctgataggttccgcctaggaatagaaactgagatttccatgtttccttctgcaccccctggggtgctgagagagctgggcctcgacagagcctgcagggccacggggagtggtttgcattcttgaccatgcatggtgctccctcactgcactcactgcagaatgactcccctaccttggcacccttacctgtaggttgggaatcatggaaggaaccacaacatagggttgaagggaagaaacttctagtgcagcgcgtgacacacagacagacgacatttgttctgcttgatagggacttgcatgagatgccctgggaggatccccagtcggagagtgccccgggaccaagggaagcctcctgcaggcgctcccagaggacaaggctggagctgcaacctgggtgtgtcttggggtttagaggctgcaccttttgcttcctcaccctccaggtccagcctcccacctgccccagacccatgtccatgcttctccttctgatgtctgccccttccccactctcttccctacagagctcgggcctgttaagagcttgctgtacttcagtccttccatgctcagaattctaaaccagtcttggaatctcactgcatcactgcatatacctttttttttttttaaacaggagttacccatttcacaatatttatcttgaacagtttttatttttcccatagtcatgatgttcatggtgacataatttcttttacaaaaatgtgtccttatgtagttcctcccctccctgctttaaggcactttggttgtttctaaagttttgattttaccattgagactgtacaagtccgaagaacaggatcccccagcttttccatagactgattcctagaaatgcaattactgggtccaggggataaccctcaagatctgtgacggggtcaaatgacagaatccccaaatgatgacatgcatttgtgtcctagatgcttttttttcatatgcctcaatcttttcaacatttcaaaagaaacccagtgccttctagtcacatttaggatttcctaactggcctgctgccccatatcttcttcaacccatggttgccatgggaagggcctgggaatcaggacaagaacattgacacttgcatttatgtttcatcacttcctgtcggggacaatctggacaaatcacttagactggaaccacatttattcatttattttaattttaaaaaccttttaaagagcagttttagattctcagcaaaattgagcagaatgcacaaattgtgcattctgtgtccctctgcctcccttgcccccagcctcctccactatcaacatccctgcagaatggctcatttgttacaattgatgaaccgacatggacacatcaccatccagcccattaggcttcactcttgctgttgtacattccatgggtttggatgagtatataattccatgtatctgccattatagtatgatatggaacagtttcactgccctgaaaatctcttgtgctctgcctagccattcctccctgcccgaagccccagccctcagcaaccactgatctttttactgtcatcgtagttttaccttttcctgaatgttgcagagttgggaatcatacaacccttgtagcctttccattttggcttctttatcttagtaacatggatttaaattttctctgtgtcttttcatggcttgatagcttatttcattgtaccgctgaataatatttcagtggctgaatgtaccatagtctatttatctattcatctactgaaagacatcttggttgcttccaagttttagcaattatgaacaaagctgctataaatatctgtgtgcagatttttgtgtggacataagttttcaacttacttgggtaaatacctaagactgcaactgctgtatcttacagtaagagtgtctttagttttgtaagaaactgccaaactgtcatccaaagtacctgcaccattttgtgtttccaccagcaatgaatgggagtttctgttgttccatattcttgccaacatttggtgctgttagagctctggattttagccattctaataggtgtgtagaggtatctcactgctgccttaatttgcattttcctgatgacatatgatgtggagcaacttttcatattcttatttgccatttgaatatattctttaatgaggtgtctgtttaggtctctggcccactttttaaaaattgggctgtttgctttcttattgttgagttttaagagctctttgttaacttcatttttctcatccctacggtaggtttatcttccctatcttccacacacagtttttgtttaggtcaaatcatataattaaactgagtgcaggttacatattgctggattgtggcataaatatgaggaattatcaatattttttctactatttatatccaaaacacatatgcagtggtgtattttcagattagacactgttatattttaatctgtctatattttaatgttacagaataccttgcattatagaataacttctaaaaattctttttatgttatgtattagtccattctcacattgctgtaaagaaatacctgagactgggtaatttataaagaaaagaggtttaattggctcaaggttctgcaggctgtacaggaaacatagcagcatctgcttctggggatggaaggtggaaggcaaagagggagcaggcatcttatgtggcaggagcaggaccaagagagagtggggaggtgtcacacacttttaaacaaccagatctcacaagaactcactcactcgctatacactaccaaagggggatggggctaaaccattcatgaaaactccacccccatgatccagtcacctcccaccaggccctaccttggacattagggattgcaatttgacatgagatttgggtgacgacacagatccaaaccatattatgctatattccttaaatatctctgtttctgtttagtagtcacctttcttttacaaaatatttgtatttgtactttacccattcatattccttttggaaatttctcagtcttcctcctctttgccctcttttcttaaaaaatttatatttatgtacttcatatgtaaaattcctacagtaaaattcactatgagtttgacaaatgtatagagttgtagaaccaccactccaatcaaagtacagaggagtttcatccccaccaccttctgaaaagagtaattcttccacgtaacatgcctctgcaattttttaaatccaggattcatgttcttgctgttagtcaccccagaacagcaagaactcctcattagtcagtgaggagcaacagaacaagttgttcaattactttggagatgtagtacatgtttcttcaatttcttacagtaatttctactttctacatttagtatgtgctttgcacataataggtcttaaataaatattgatttactagattttacgtatctctctttttccacatctctcacacacacggacgctaagaaagaaattatctctctaagggcaaccatgggcaaagaatctggaatatatatacaatgtatatgagatctaacaaaatataaatggtatatttagagccgtttgagaaaggtatcttaaattggaaaaagattggggcttttggagaaccttcttttgtttggtagaggctataaaatgtctgtctcaaccaattttgtctcttgacacttggcgagcattgactttcctttcttatgtctgatacacagttagcatggctgttgtagcgctgagggtgcttttctcttccttcatctgcattttgcctgatgactttacaggagtgaggaggacctgccaattaactctccagttgagctcttcagctaaaaagcatattttatttctaaactggaatacacttactataaattatgatctccaactttacctacaagctagtgaaattaagatttaaaatgaaatcatgatagtcaccagtttcattaaggcatctgtactttctactccaatgcttggacctaaggacaatcctggcaagttacaatgtttactttgtgtgggatgggaccatagagagttagaagacttggctttgcatatggaatatattttcggcaatctctgaagccaagacaaaactttctggcataatgcaaacagagtaaatttttgcagtgtattttttaatagttttgaagtttttagtaatgttttagaaatgctggtgagcctgcctgagatgtgaagtttctttccttccagcttgctaaatactgattagtgggttccctttgtacctttgccaaggaggttctggatgctagttccttgggtgcatgaactcagctgccccatcctacacagcattaagaggtaaagcctgggcctcagatgtagggcttgatctttttttttttttttgacttttttttagaacaatttttaagaaaaaagaattgctgtaaaatctttgcccatttaagtttcaattgtgcccctcatgtccctaagagcaaaaggatccagtccaggatcacgagctgcactcagttgcaggcctctttagtcactgtcaatctgcaagaattcctcagtttccttgactttcatgacctcaatatttttgaagagtccagaccacgtattttgcacaatgagcctcaatatgggtttgccctattttgctgtgattggtcaggttatgcatttttagttggcatattccaggggtgatgctgtgtcccactgctcctggctgcctgctacacaaggctgatctgtcccatggctagtgaggtgatcttttttcccaggtaaagtggaaagtggtgtctgccaggctttcccactcttaagttaatttccttttctctctctttttttttttgaggatatattttgagaatctgtaaattccacttttcttacccacctgtttttgcatcttctgatgttccttgccagaattaaaaattattactatggcacttgccaagtggcgatttttctaattccatcattccttccatgtgttttagttggcattgtccagtaagaaagaactctctctttaccccattgacctatttatataaggaaccactcatagcattctattctactcaatgagttacaattcagtagggtcattatttactttgaggctcatgtcataccaagttgagccagtgggaggtccttcaagctggtttttgtgccttttaactcatgcctcccattctttgagcattttcctgcttcctgacaaaacaagatgttctaggattgccattctttcccagccctggctctagaatcagccatttctccaagaaatcctggctgctcaatacgctcatggtgattggggtgttgctgctctgaggttccctcatggataaagtaaaagatccacctctatttttgcttctctttctgcctataaatacaaaactaggagttcaactccacatctctaattccaatccaattacacagcattcatttagtgtttcctcttgccttatttgtaccgcccttcactgataatgagaaactcgacttactcattcttatgctaccttttcccttagtcctcctgtgtgcagctcatcttccaaggcctccacactgctttgctgctctgctcacatgctgtcttgtgtgaacctgccccacttcagctgccactttctgttggccccaaaccctaatctggtgtctttcttacaaaaaaaaaaaaaaaaaaaaaaaaaaaaagaaaaaaggaaagaaggaagaaagagggaggaaggaagagaaggaagcaggtacttttttgagagaccctgttccctttttctttcatgtgacatcctgtttgttgttgtttttttcttttttttcttttttcctaaagaacaatacattcagtattttgaggattcttcatttgggggctaaggtcttcttaacttagaacagtctcatggtctaagcatttatgcagacagcctgctgtcttgttaacactgactgtgctatcagccctttgactggagtgctgtgacccattctttgcattctgtttataacaaggtgttataggatgtcacagagcctgagtgtgaactagaattgactttttataacttatgtcttttaatcttccccttgtacgaataagcaaactgagagaccaagagaccaaaaaggtaatgagctgaccaaaatcagacattgaattttttttcattttgtgttggactccaaaattttctactctacttaccaacgtctcctgttctgtagtctccagggacacctcaaatcaacagcccttgtttcaaaggtgtgttgatggtgtgatagttctaggacaggctggataatggtcccccagcgacgtccacgtccttatcactgaagcctgtaagtgttacccatatgggactgtggcaggagatatcccaaattatctgggtggacttgatgtaatcaaaaggatacatcaaagggggatcgaggaaggtcagagaggaagaaggtgatgttatgatgaggcagcagttggagagatgagctttaaagatggaggctggggccattggccaaacaatattggcagccactagaagttgggaaagtccagggagtatattatcccttgattttagcccaggaaggcccatattaggcttctgacccccagaactgtaagatactaaatacattgtcttaagccaccacatttgtggtaatttgttacagcagtgataggaaattcatacaagctcctgtaaaataacaaatcttgctgcatgcattgtgttagcatgtcaggggacagccctgcccaagatcccatatttagagagcagttgctagtacctctagtgtttcgtatcatctaagttgtccatgtgttttcatcttctgcttccttaaaaaacaatcactttggggaaacagaaagagtacatcttatgtgacatgtaggtcaagtttggaaattcttcctctgctcaagtcatcactcagctgggttccattgtccttgtcttacaaaaatttggtcagcttcaaaaatttctctagcatctaagcaaaaaagtaccttgcactgaccatctccaggacacaatccatcaaactgacactttaagtgtagatcatatctggggtctcatgctgcttgacaacaccctttaaacagagaacccaaaaggatggggcataggactcatggctgagggactgatagcacaatcagtgtagagatgacactgggctgtcataaatgcctagacctcaaagctcttttaaattaaggagatgtagatccccaaatgaagaatcccaaaacttttgaatttactgtcccttgaaaagaaagagtggatacaccataggcattgcttttaaagcatatttttgttacattttaaattactttcatgctagttagtgtcctttagacataatttcatcatgtcttattttattcttatttactttgtgtgatgaatttacctaaaaattaatgactagtttgaccaacttgattgtcctttgacttgagaagcttgtaatttcagtgaaattcaaaacattagataagattgaaaagaatattctacttcttttgtatgaaagtgggaaggtgtaggtcttatttggtccatttgaattggcttatggcctatattcagttacaatgatagaaaataccaccaaaagaggaggaagacatatgtataaataatgtcattccatactaaatgcacaaacgcagcattcttcttaaattggaaagtgtagccaggacattagatgtttagcctgcattcacttcctgtgcagttgcctaacctttatttctatctcttttggaagattgtttatatgttttgatcaggacttttatactcttaataagaatatttttgcagtattttgcatctcctcataattgttgaaatgaaagagagtttacgtttctttatttgaattactttaaaaaacttgaagaacacctttcggtataaatagtgatttaaatattgctggaaagtatgtatcagataagaaggaatacagtgagaactcagttaacattgttgatgggttcttggaaactaagactttaagcaaaacaactttttttccctcatcaacattataacaaaatggcgttgaatgagatgacattatttgaggacctgctgtatgtccttttgctgaaagttgcagttgtgaacaacaacttactgatgacgctaagtgaggacttactgtaaaatgatgtaatgtggaaattctatgtccagaattcagtgaaatgttaggagccttcttgtaagttttctttcattaaatccctgggtaatgttctattctggatgttagggttacctgaaatacttgccaaggggagttttacagttgctgtctgtgtgattcagtgtgagaattataatgcaaaataacaaaggcaaagtctgccatcaagactccaaatctttgattacagtgatcagtgtcatattgcttttgaaaagagtaacctttatttgccctctctgttaattgggctactttgacattttgtcaaaatctcagagcctcccggacagcctgcctgcagttaaggtgagttgccacttgatggcacgcataacattctgatggtcttaggcttgcctttcactgttcataggcaaagttccagaattttcagacacattgtacccagatacttagtgccgtaccataattgattgtatctcctgctgatctgtgagattattgagggcaaaaactctgtccttattctgtttcctcctctaacacacacatgcccacaaatgtgtgcattcaaacatgtgcatatacattcacacatgttcatacacactcacacacacacaccctcctccccgccacatacaactatggccttttatgagaggggctagaaaaggaaaatttaaaaaggacagatgaatattgttatcaataatgccttagttatcaaggtatgcttcatataatcatagttaaatatgaccattaaatgaaaattccatttagaataagatataaaggaaaatctttagtcaatgaataattcttgattttcactatttctattgtttcctatttaattccctataaatgcactaggtgaagacttactgcactaagcctcagtgccctcatcttaagcaaggataatagtactcatctcatcagattgatctgagaattacatgatgaaacatagcacatacaccctactacacttactcatccttatctagctactgttgagaccagacattgccagcatgctacatgccaggcatcgtttttataactttatatataaatgcatttattgcttgcaacaatcctataatatgtcttatttatttatttatttatttattttttcgagatggagtctcgctgtcgcccaggttggagtgcagtggcgcaatctcggctcactgcaggctccgccccctggggttcacgccattctcctgcctcagcctccggagtagctgggactacaggcgcccgccacctcgcccggctaattttttgtatttttagtagagacgaggtttcactgtgttagccaggatggtctcgatctcctgacctcgtgatccgcccgcctcggcctcccaaagtgctgggattacaggcgtgagccaccgcgcccggcctcttatttattaccatttatcatgtgaggaaactaagttaaagagtggtaaaataatgtgttcaaggtcacatggctggcgcacactcagaaatgttattaatcattcttcttcttattattatttgcaatagtagtgaggtttacagcttttccttggagtcttactgagaatcagcaaagtgttatctttcacatgaaggtagctgcatctgacctttcactagtgctactcatgcagattttgctcagtaggattccatgcaaactaattaaccacgtgcggagatattgcatgcctctcctgaaggcttgcttgctcatggcttcttctttctggtgccttcccccatctttccctgtggttaggggctcctcaggaacatctagagacagtcaatccctttttgcttgtttagaggaatcagaatggtgaggttgtgtagagaaatcagaagtgaggcagggtgctcagtgtgggctgagatctgtatatgcaggtataggacttcactacccagggcattgggtgggaggtaccagctggatggacagtgacgctggcccagcaggagtcacttggagaggggccagggccagggaccaatatctctatggatacgtgcagaggaaggggtgatggaagcacctgcacagatgatgctaagggagagagtggcaatgcacagtgcctagctttgtgcatggcccacagagaacgttcaggaaaccttggctaaccacatgaataatagaagacttactgcatgcttccagagtctgtgcctggcactttacagccatcatctactgaactttaaatactgtgatcatcatctctgttttattaatacaacgaggcagccaacactctgcgtggtgcagtcctatgcctgcagacagagccggcccacatcttgccaagagtggaactccagcagttaggactgtgctgctgcagggcgatgtctccttgacttgtatgcttctcgtgaattgcccaatgtttattttagagattctctttccatcactccataaatccctgccagcgatccaggtgcagctcaaggccctcgatgtctccaccccacctcatttccctttgtgtctgcttgcacttctgctttctcaccttatttttgctactttagtcatagtatttggctttgaataaactgaggttggacttctgcctccactactaaccaagaaatgacttcaagcaagttatttgattaactaccttagtgacatcatatatcatagcccatggaaagcatacatttaatggggatttttatgtatgagatcccatctactgtaagtaaactgagcattgcaattttattgtctgattcacctctgaattcctaagatgctggtacagtgagtcacaaacttaagttgaattggatacactgtgttgctatctgtcccctccctgcctaccactgcctatgcatttgaccagcctccactagcccgtgagggtctgggagttcacagtcaagtttcattcatctttgcatcctatgggtagcctgttttgctgagacctaggtagtcttagagttatgccaattaaatggatggctaaatgaaatatatggggtgtgtttggcatatgttgtcacaaccggattaggcaattgaggcagaagaaaagaaatgcgatgtgtatagaaacataaaataatacatggcgtttttttttctccgaaaggtgtttttgatgcttttgcaagattccaacaagaaatctcacattgccctggggactgagtcagagctgcagaaccacaggcctacaggacatctgtctggctactgtaagtacagaatggcttcctgcatttctgctggaggaacaatgacaccagccttattcaacatcccttgttttaaaagttgtatagcaaggttctgaagttagtgaggagatgtgagtgtatagtgagggggcaagtaaatacaggtcagaggcaaaaaaaacgttgagttttatcctggcttgaaaaaaaaaaactgtgtgtttatgggacacatttatcttttcttcaggacttgacttagtatataaaaaatttctcaatgtatacagttagaataatgaccatcattcatcttattttaccttcatcacaaacaaactgatctggcctacctgcgtggtgtgcctcttatgtgcaggcaccctcctggtaatggatttgcatggtttaacaaagccccggatgtgggctttgccttcatgcgacctctgtccctttgggaccaaatcatggcttcagcttttgtatgcagcctcctttataggctttaatgattgaacagaatccagatttggtatctaggtgtgtgactgaagctccagttcagtccaattcctggcatatttattagcagcaactcagcaaggatccctgagctgagctctagggatgtggagggtaataaatctaagagctttccttcagagatttcagtctactaggcacatgaacccatgaataagtaactagaattaaatatgttataaccttttatgatgtttcccaaattgcatccttaccagcaactgtaggaattgctattgctgtacttcctcttcagctcttagtagtatcagatttgaaaaacatataatttagctattaaaatagatgtgtagtagtttctcattgtggttttaatttgcattctcctaatgattatgttaggcatatatttttatttcccacagctttattgagatataattcacataacacacaattcactcatataaatgggaccattcagtggcttttagcttcttcagagttctgcattcatcaccacaatcaaccttataccattttcattactctgaaaactggtgtcacttagcaatcactcctcaaaatccccatctcttcagccataggcaacccctaatgtactttcaatctctaatagatgtgcctattttggacattttatatacatggaatcatagtatgtgtggccctctgtgactagcttctttcactcagcacaatgtttttgaggttcatccatgttacagcgtgccagtactcaacttattttgattaccaaatatttcattgtataaatataccacatttttgtttgtccattcaccagttgatgggcatttggggttgtttccagttttttactattgcaaatatactattatgaacatttatatacacaatttttgtggatatgttttctcttacatgtatacctaggagtgaaattgctgaatcatatgtttcaatcatttgagaaactgctagactgtcatctaaagtgatcacaccttacattcccaccagtagtatatgaagtttctaatttctccacattctcccaacccttgttattatctgctgttttgattacagacactttagtggatgtgacacacaccttagtgtgtatctcattgtgggttttatttacatttcactggtggctaatgatgttgaatatcttttcataggcttcatggccacttgtatattttctttggagaagtcatattcagattttttgtccattattaaaattgggcagattttatttctagagctggaagaatttctaattatggaattgtgtgagttaagtggaatggtaactaggttttcataaatgccgtttatgaagttgaagaagtttctatctgttcttaattgtggagtgtttttaatcatgaaaggtgttggatgttgccaaatgctttctctgcatctattgagatgatcatttgttttttgtttatttatttatttatatggtatatttttggtttttggtagttaaaacaacattgcattcctgggacaaattctacccggtcatgtcatatattgctggattttattgtgctagtattttgtggagcatttttgtatctttatagcaggtattggtctgcaattttcttttcttgcagtgtctttggcgctgttatcatggttatcttcacctcatagaatgagttgagaggtgatcccttctcttctattttgtggacatgtttgtgaataattggtattagctcttctttcaatgttttgtggaattcaccagtgaaggcttctgggtctgggcttttctttgtgggtaggttttttaattatgattaattcaaatatttaattgatgtagggctattagattatctatatttttctcaaatcagtttcagtgttttatgtctttctaggaatctgtccatttcatttcagtcgttatgctattttatgttattggcatacaattgttcatagtaatcagttataattccttttgttttttaaaagtctgtagtgatgtttgtcaggcgtggtggctcacgcctgtaatcccagcactttgggaagctgagctgggtggatcatgaggtcaggagatcaagaccagcctggccaacatggtgaaaccccgtctccactaaaaatacaaaaaattagctgagcatggtggcaggtgcctgtaatcccaattacttgggaggcggaggcagagaattgcttggacccgggaggcggaggttgcagtgagctgagattgtgccactgtactctaccctgggcgacagagcaagactccgtctaaaaaaaaaaaaaaaaaagcctgtagtgatgtttcacctttcatttccacttctaataatttgagtcttctccgttttcttggttaatctagctgaagtgttgtcaattttggtaatgttttcacagaatcagcttttggttttattgatttttctcttttcaatttcatgaaattcagctctaatttttattattttgtttcttttacttaccttagatttagtttgctctgtttttccagtgtcttcaggtggaagtttgcatgaatttgagatctgttttttataattataaacatttactgctataaatttttctctaagcattgcttcagctgtaccctgtaaattttgatatgttgtatcttcatttttcattcatctcaaagtattttttaacttctcttttgatttctttcatttcttatttaggttgtgttgatttccacatatttgtgagtttctaaattcccttttgttattaaagtcccatttcattttattgtaatctgaaagaaaccagaatgggttcatatttttaatagagatgggatttcaccatgttggccaggctggtctcaaacttctgaacgtgggaggtggaggttgccttgagcctagatcatgccactgcactccagcctgggcaacagagggagattctgtctcaaacaacaacaacaacaacaacaacaacaacaacaacaacaacaacaaatctcttttcaacttattaaggcttgttttatggtctatgctggagaaagttccatgcctcttgaaaagaatgttcatctgttgtgataggtggtgtgttctatagacatctgtaatatttagtttgtgtgtagtggttgttcaagtcttttgttttcttgttgatattcttgtaaattattttatctgttaataaaatttgggtattgatatttctgattattattgtagaattgcctatttctccctttaaatctgttgacttctgtttttatgtctttgcgggctctgttaggtacataaatcatcacaattttatatcttccagatgtaagccttatttcatatcttttatagtcttctttccttcttgtattcttcctggtctttttagacagtgctggcactatacctgatgaagcagttttcgcaaacactttgtgaaaccttcttaggtttcaataatattcatccattagacaaaagccaggtgtttttgaaataacctcttctgtattttttggcttctacatagatggcagaggggaccacaccacaaagcttcctagaggtcctctggtttggttgagtagacctgtgagacacacttgatcttttttaaaattttttaattttacatacgtaacaaacctgcacgttgtgcacatgtaccctagaacttaaagtataataataataaaatatgtgtatacattatatataacccagttaaagaaaacaagtaatgcagttaaaaaatgatcaaatgacctgaatagatagacatttctcaaaggaagacatgcaaatggccaacaggtatatgaaaaaatactaaattaatagtcagcagagaaatgcaaatgaaaaccacaatgagatataaccttatatctgttagaataattaatattaaaaagacaaaagataacacatgctggtgaggttgtcaagaaaaaggaactcttccatactgttggtgggaatgtgaataagtatagccattatagaaaatagtatgaaagttctttaaaaaattaaaaataaaaccaccatatgatcaaggaatcccattacttggtatatatccaaggaaatgaaatcagtatattaaagaaatatctacactctaatgtttattgcagcaccattcataatagccaagacatggaatcaacctaagtgttcatcaacagatgaatggataaagaaaatatggcatatgtacatagtagaatactattcagtcttaaaaaagaagcaaattctgtcatttgtgacaacatggatgaacctggagaacattattttaagtgaaataagctaggaacagaaaggcaaatgctacataatgtcacatatatgcagaatttttaaaagttgaaatcatagaaatggagagtagaattgtggttactaggggctgggaggggatgtggtgaggagatgttggtaaatggatacaatatttcagttatataggagaaataagttcaagagatctattgtacaacatggtgactgtagttaataacgttttgtattgttgaaaatctctaaaagaatagatgagttttctcatcacaaaaaactatgtgaggtattgcatatgttgattagctcggtttagccgcttcacaaggtatacatatttcaggacatcatgttgtatatgataaatataatttttatttgtcaactataataataaacaaataatagtttatgacaggttaaaaaaaaaagaaataaaatctaccaagtgtgcattcaaacacatacatgtaaaatatctttggaagggtaaaaagatgctggtaatggagtttgcctctaggggaggaaactgagtagctgaaggattctatagcccccttgagatctttggtagatttgcactatgtgaattttagcaactgaaaataattaaaaaacaaagaaaaataaaaataagtacagtactcaaaaaatatttttttcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaattctctcttacatataaaagttattaaaaaatgtatctcaaaggaaatgaatgctagaaattaaacttaggcaaaatgctaataaccgaaagagaaaataatgtgtatgtccagttaaaataaatcttgacataaacagtatcccaattatgatatatgcaggaggatattactacatagaaattagataagcaaaaaatacatttatagaattaacaaacttttgtaatactatataattccttttacataaagctcaaaaacaggcacaatcatactaaagtgatagaattaccctttggcataaaaaattttataagagctctgtcagaagtaaactggaagtttacttcttcaaagtgagcaggataatctgttttgattaatttaaaggcaactgattagcgttcttaatgagatctgtaaaatgtcttcacctttgtcatatgacgtagtttaattgtgggagtgacagtgtgtattcagggtctcactcacactcaaggggaggggattgtacatgggtttgagtcattgggggccactttagacttcttcctaccaaaacagtattataacaagctaaactgaatttccgcaacttgagcctctcttcatatttattagccatttgcattttctctttggtaacaatgtttttccttacctttacatataaattacatatttatttaagaatagtgttctaaatttattttcactaacataaactgcatacatcttatagtaaatggcacagatgttaattgtacaaccagatggatttttccatggtacatacctgcgtaaccaccacccagattgagctagaactttcccagtacttcagcaggcaccctcacatcctctccaggtcaaatccctcctcacaagggtaattgaattactttagaataattgtgcctgtttctgaactttatataaaaggaatcatacagtatatatagaagtctgtgtttttttctaagtattattttgtctctgaaattcatctatgtaattgcttgtgtaatttctatgtagtaatattccctgcatatatcataattggtctctacattctaccgtttatgtcaaaatttatttaaactggacatacacattatttcttttttgattattagcattttgcctaaaggtttaatttctgagcattcagttttaaaaaatattagttaacttttatatgtaagatcgaatttaatgaaactatgattattaggttctcataaacattttgttatcgtgagaagttagaataatttatgttgaagatgtattgcctatatatatcctctatataggatatatatatcctctttattatgcttatacatctgttttagaaacgataattttatgttctgaatttggagaacattattaaaaaacccatgtaaataatttggaaataaaacacgtgcaataaaagctaatgctatatgaaaaagagtgatgttttgaatttaagaaagaaccctgaagaaagaaaacttatgtttttattgccattataaaatatgacataaaaatgtaattttagttatcattcaaattataaatctgggaactgaaatgtatattatttaagaatcaatttaagtatttcattaccaaataagaagtaagtctaggatgcattaaaacaaatttgatatgagattgcctacatttgccaattttattatattcttcaaattcctcctataaaactccacatgaggcctcaacctaagtccagtttatgttacttagtagatgtaacttaatcacaacattagctcaggatattggacacagtgtgcattaatgtcttctaagtaaagtgatttagttgctttttgtgttgtgtgtgtatgtgatctacactagagaaattcaatttctagaatagccatttacaaaagcctttctcctcctattggtgccctcaaagattactcttttgttattgattcctactcctgggctgcacctgcctatgggcaccccttctctctacagatgccatatgtcttcagaaatagttttttaagggatagctctgaaataactcactccttgcttttctgagggattgatgaagacaaaataaaatataaaatatatactttttaatcatagggaccctagtagctccgtagaaatgagttatgaagaccgatgcctgcaactgcacttttgtccttgtctctgcaccgcagagtgtggaagtcacttcttcatggagaaagaaactatttattagctgcctgaagtggatcggacactatgataggcactttacatgatttggattttctcacttcatcattacaaccagtttgcaaacagactttcatatctctgttactggatgttatagagatgtgatttggatttctgggcagtgttgagagccctgttactaagaatctactatagagactgcgaactctaaatgataaaaatgctaaccttactgcgaaaaaaatgaaaactgtgcgatgagtaacaacaaattagcatggtgaaacctacaaaagaactgtgtgctaaatgttggaggaacatgtagcacagagtaaataactgctcagaagagctgagaggcttccagaggagagactgtgtaaacagaggctgtgtgagtgctgtaccatggccagtgcccatggggccagcttttactctagatcaagtcaagtggcatgaacacacagagtgtcccatcccactgccgagctgctgggttgaggaatcaaccagtcaaactctcacgttgcccatgtgtaagcgcttcaagaaaatgacttccccagttgtattatgacttccccaagttgtagttgtattggcagcttgggctgccaaactgccacagactgagcggcttaaacaacagacattcatttctcacagttattttctaaacctctaaactgaggtttagagatgttatctgatttgcccaaaccctcacgaggttcagcatgaaactctcatccaggcacaatgcctatatttatcctctttcttatggttatacatctgccattgcagtccctttgggtccttttttaaaataattttaataatttttattttttgaaaaggcttttccaaggctcaatatacataaatcattgaatttataatgtttagtatatattaactgcttagtgtaatgtttagaatatacataaatcactgaattaactagtcagcttcctgagaaatttagtgatctcacaactgaatgatgacctggagagtttgttacaacacagattattgggtttcacccccaaatcttctgactcaggaggtccaggatggggcctgagaacttgcatttctaacgagttctcaggagacgctgctagtccatgcatcacatctggagatacactgccttggtgtgatggaaaaagaattctacttacaatcataagttatggggctattctctcttttattggccttctagctgtgcgctggtggtacggactgaactgtgttccctgtttgttgaagtcttaaccctcagtacctcagcatgtgactatagctaggactttaaaaaaggcaatgaggactaaatgacatcaaatgggtggatccttataagaacaggaaatgtacgcataaaaagagacaccagggatgcacacacatagagataaaaccatgtgagggagaagaaagccgtcggcaaaccaaggagagaggcctcaggagaaaccaaccctgcccacaccttgctcttcttggtgctgacaactgtgagataatgattgtctgttgtttcagcagctcagtctgtggtagtttgtttggcagcctgagctgactaatacaactggggaagtcacttccttgctgagcttacacatgggcaatgtgagagttcggctggttgattcctcaggccagccacttgacaatgagatggggctttctgtgtgttcatgccacttgacttgatctagtgtaaaagctggcccccacgggcactggccatggcacagcactcacgcatcctctgtttacaccatccctcctctggaagcctctcagctcttctgagtagttatttactgtgtcctacatgttcctccaatatttagtacatgcttctctcacaggtttcactttgctgatttgttgttactcatcgcatggttttcagtttttcccagtaggtttagcatttttatcatttggagtctgcaggctctatagtagattcttagtaacaggactgtcaacactgcccagaaatttaaccatgtttccctggccaactctcacttcttgtgccaagtcaatttcaaatgtcccctctcctcgtgcctccggttcctcctcctcccactcccattggaggagggagttcctgcctcagaaagaaaataagagtgaataaatccatccacctcccaccctctcccacctgcatcctctttccttcctgttacaggaggaaacaccctctttccttcctgttacaggaggaaacaccctctttccttcctgttacaggaggaaacaccctctttccttcctgttacaggaggaaacaccctctttccttcctgttacaggaggaaacatcctctttccttcctgttacagagtagggccctcttcctaggtgaggctgatttctttgccaagatgaatcctttcccacctttgaaggaagaattcattgctctctgttttcaatgcctccccctgtcctgaatctttctcactatggattatacatgctcatggctcttcttttgctaaagacaaagcagcataagagaaacaaaacccttccttcaaatcatttccctccagttgcctccatagctctctcccctttacagccaaacttctttctcaagagttgtggagacaagctgtgacttgcatcgtcgtctctcacttgagcctcggtcaactcagatatgtgccattttcccaccatcccactcaaaaggcctgttttaatttcactggtgaccagcacatcactagtttcaaaaggcatcatcctttatctctaagctgtatccagcatcctctttttgggcaaaactttatttctttggaccctatgacacatcacttgttttcccctgagtacttgtcttcacctcacctcctgcttcatcctgaccttcatctgttagagttctaccatgctcaggcagtccctgagctctcttctctctttattcttctgaggggtcattttgtccctaactgaggtttccttgttcccatactgctgctcatacatctggggtcagctcagatcacctctcttggctcttggctataactgcctgctgagcaactccattctaacgcatcccaggtacctccatctcaacacgtttaagtccaactcatgattttaacccagaaaactttcctctggctcattcttggtcttagagaatattgctgctctctacctagtttacaaaccagaatgtcagagttattcatgagccttttcctcttgccctccatatgtagccatccctagattccatcagggcatgctctacactgcagccaagtctttctttctttctctctttctttctttcttttttttttttttgagacagagtttcactcttgtcacccaggctggagtgcaatggcgagatctcagctcactgcaacctccagctcctaggttcaagcgattctcctgcctcagcctcctgagtagctggaattacaggtgcccaccaccatgcccagctaatttttgtatttttagtagagatggggtttcaccatgttgatcaggctggtcttgaactcctgacctcaggtgatccacccacctcagtctcccaaagtgctgggattacaggcatgagccactgtgcccggcctagccaagtcttaagaataagtatttgatcacattattctcactcccaaatatttaatggtttttcatcttctgggactcaaattctgctcatggactcctaagatgatagaaggattggatcctgactgcaccttgtctatgccagttggactcctttcagtttcttaaacagatcaagctccttcttgcccccagaatctttacaacagctcttctccctgcctggaatgctgtctactctttcccccttctctgagctaatctttgttcattcttcagtacgtgatttatttgactcttctgcagagtcttcttcaacttgccagaccaagttacttccctcctgataaatgctcatgctcccctcttatgcttcacagaacctgtggcaggttgtatttaaatagctaattgcaagtgtttaacatctttgcccagtgaaagaatgcaaattcagtggagctatctcgtgtgtggctgtatttctggcagggaatgcagtgtctgtcataataaacctggaatataggtttcttgcctgactaacagaccagctgaatgagaagggacacctgcatatcaaggcaagtggtaaccacttggccttacctgggttctactctagggcttctggaatccatgtatcactgcacatatctggcctttgcgggctctgtcccacctacagagtgaacagtcccacagtgttggccacactgatgtggccaactgatgtggtcccactgatgtaccattgctttggttactttgttcggaatgtagttttaagagaaggggcctttttaaagaaagtttaaaaatcacctgggtacttagtaagatggcatattcttaggcctaactttcacaaatttggattctaaagacctagacatttacattaaggagcaccccaagttccttgatttagatggtctgtggccactactatgagaaacatcctgttagagtatctttaagctcaaagtttatgtgaaagatcacaaatctatctaatactgagtgatttggggagacatgattgttttctttatataatgctttgtcatgccctttaaaaaaaaaaaaaaaaaagaaaccttattccctgatgtgagacctgagattgcatttacattttcagctctatgatctgccactaccactttacatacagttctgttccttttttctcccacaatttaattctctgtatttcatttctaattactgcttcttctgatgatggaaagcaattttggcagtgattaatttgaagggtctgcaacctctcctttgctttttaagacaattctatttgcacagcccatcctatgaagggctagtagaactctgcctcttcagagggctgttccaaattttttgggtgtctccaggcttaaccatgatgctaatcctagagtgctgtcttttcttctttaaccaaatttcctcaaatttcaaaaaccaccttccctggaagcaaggtgggaagggacatggctgctgccaattatgcaggccaaagaaagtttgtgttccacattagctaaaagcagcagaaagctaatggcagggtgctttgcagaaaagagtctgccaaaataaaatggaattgaaatagatttgggcaggataaatgctggtggcaggtgccagaaagcagcaacttctgtcagaagcagtgaaaagagaagaaagtgtgtgtaattcttgcagccatgcagatcagagctactaaataaacctcctgaggttaatgataaatagttccaaacctcatctcctgtactggaatatcatattcctgtgagatatttaacaaaagatgagattaactcatcttaaatgcagtcattgcctcaaaagtgggtaatgcagacaggactagctctgagcaactttcactaacatatctacctccaggaagctaaggataaataggcccttgaaagcatcttcaatcctgtttcaacacccacctcctcacgggagcctaggagagttgggtagggcatcttgaactggctccttcaattccatcttcctccctactcccataatccatttctttctccctagtggatagagatacttgggaatactgtgagtagctgcatttatctctctttgaaccatggtacaaaatcatgactttactttgttaactactttaactttgttgtttttaactctgaaaatcatgttgcaatgaagccccattaatgacttgaaaactgctcctgaatgaggcccactaggcatggctgtcaaagttgagagtgaaatcaagaggttaaaggaactgcagaggtggtattaggttttctgaggaggggaagaatggacccaggagagagagaagcctcacctcaggaaggcaatacatagatagggatgctgaatacaatatttggtcaatatccatccattcaatcacccatcagaccttactgagcatctcatttgggctggggagtgagattaaagctgaagatattgagatgaatttaaattaagctccactctttctggtttcaaggacctcagcgcatatgaagaagacaggtaagtggaaggtgataggaacagtgagggagatgaacattgggctcaggttgaagagaagatttgatagtagggaaatttttcttctttttttcagctatatttattgaccctcacttgtgccagatgccaccgtaagggctcctacttgcattatcatcactaacttttccaagaggagctgtctgagccagacttccaatgggcagatgcctgacaacagagtccacatgcctgcctgcatagaaccttgcctcccaaatgtgaccaaaatagaaatcagagagcagggttaaggctgagatcataattatggtgcagcaaaattatctctcgccctaaccatcaatgacaaccgcaaaggaagctcaggtttggaaactcaagtgtgaagctgtttagagactgcaggaagacctgtctttggtgcatatttagagtttaggtgccttgaccaggtagtataagccctttagtgatactgatgggttcataccacccattcaatatccctgattccctgaatgtcaactcactgtcttttcagtataggtttaatcaaaagtgtttcagcaacctttattcaaaaatgtggctgggtttaaggtatgaccttattcacaagtgaaatactaatttgatcttttgacattttggctattacaatcatagggcattgcaaagaaccaaatcaatgatgaattagccacataggaattggaaattttaatggcatgacatgtagcatttttcttttacctatattgtgtttttttaagaaaaattacatttgaaaaagcagtatggttgttataagaaataaacagataaagtatcacataaattgataattatgagattatcaataaaacagtttagataaatattgcctccacttattagcttctttaaagaattaggcttaatattgattttactttttaagaatatatttaattaacctagctttatttatttatttgagacagagtcttgctctgtctcccagactggactgtagtggcgtgatcttggctcacggtaacctctacctcccaggttcaagcaattctcctgtctcagcctcctgagtagctgggattacaggcacccacaaccacgcccagctaatttttgtatttttagtagagatgggatttcaccatgttggccaggctggtctcgaactcttgacctccagtgattcgcccaccttggcctcccaaagtgctgggattacaggcatgagccactgtgtccggctcctagctgtctgtactgccatgtttaataaataattgtttttcaggttttatgttttgttagtaagcacccacatgccacaaaaacattcttttattttcttttccttttgatttctctctattccctttcctatttcctctctccttccttccttcctttttcttctctcctctcctcttcccttttctattcttctttaaaaataagatgtttgattttattggctctctacttggggaaacaaaaatgttttgaataagacaattcagtaatggtttggataaatatcatacagctttatatataccagaacaaagattgaagagtaccctatctaacagggaagaaaattacctgtccaaaatgttcagtgtattcagggttagccagggctggaattcaggcatcctgatgctagagtgtgtgacttcccctgtgagacatttacaaagttagtacccatcttaatggtgtctgcctattgaattagaagtatatttcccaaggaaacctgtagcactgttaaggtttccatgcagctcacctgattctatttccctgacttggtgagacagatgcaatgatttatgtcttttcatgtctgccaattattctgaaatccagcattatgactggggtcagcagaaaatagtcctcataccatttctgtaaccagcttagcatatttctgtcccataatccatgtctttgcatgagattccttctatttcttcacactctggttaccctccctacctgtcacaaacatgtttttatttttgaattgctggcattggctgactccttgaagaaacttcctctaatctgacattatgtatatttcactgtgctgttcaggtttcactgacacgttttgtttacttgtttgactctattacaagaccaagaacttctcgaaacccttcttcaaatagataacccagcacctagcatagcacttgcactagtaaatactcactgaatttaattccccaaatttaactcatttcacaacctctcttgaactggatttatttataaataaatgaaccttttgatctacattagttcagagagccatttcagcactagaattctgtaactcactgaacagagaattttactgtttctatctcataaaatcatgctttatttcctgaataagtgtacagtctttacaaagtaatttatcgtttacaagatgattaagtgttcagtgctgagaaaacccagaaaattgtgaagaagaataaaagagtcataatctcaccacaagaatataaatttttaagtaggttaaaaaatgcttataccaccttcgctttttaaattaaaaccttccattttatcaaatggcatgtagggtttatgaattattggataaaatgcaacttttcactaaaagcatatcaaaatattattttttatagtttaatattagtagttttagcaaattatcttcattctatatgtattactttgcaacatttttcatctgatatatgatgagtgtcttcctataatttcatatgtgatgttttaaccctccctcattttttggttaatacacgctgttaatacttgggtcatattccctctcccactcattttactgagtcacctttcatgttcatttttcaaaagactgtataatttcatcttaaattgctttattcacttacaaaatgtaataaacattctctatgagtatttacctatactattaccttaagcagattaatgtattttactacatccttgtattgtaatttgttcagttaatacctacacattaaatacttgtttcttgcctcttgttattatattcttttttttttttcttttctttttctttttcttttttttttttggagatggagtctcactctgtcacccaggctggagtgcagtggcgtgatcttggctcactgcaacctccgcctccctgtttcaagtgattctcctgcctcagcctcccaagtagctgggattacaggcatacaccaccatgcctggctaatttttgtatttttagtagacacagggtttcaccatgttggacacgctggtcttgaactcctgacctcaggtaatctgctccaccttggcctcccaaagtgctgggattataggtgtgagccatcgcgcccagcaagatgttataaatcacctggtttatgtatgtgatgaaattttattttattatttataataaaactcttgtattgagataaagcagatcaaaggcgatctgtatttgtctccaacagaaagactatatggacctgttctcccaccaggaatgtataagaagatccgtttccttaaccctcaataatattagatgttaacattatctttaatctttactatattgattagtttaaaaactaaattattgccttggattacaatatttacatattggctattttgtaaatcttttattaactgtatattcctgaacgttgtgtgcccattttcttttggagttttcatcttaattttactgacttgaaagcattatgtttgtaaagctttattataaaatcttcaagaacacttggatgaactgggtagtgtggagatcatattcttggatgcttgctgagactttgatatttaagctatttctcataggtgttaatgtttgaacaattgcagccaagtgaccaaaagaaaaattctttggacatttttcccaagcaatttgatggtcaggataaatgggaatgcatgattatggatgaaactagagtccttgaatataattgcactcataagtcaaagaaggcaattcataacaatttggcccagcattttaattttgtctgttaaattattcatgcgaatactttcatgagttaagccatgaatatttgattggtggttgattcataaccataaactatattagccctttatttttctcatttatgtccaattaacatatacgggaaggtggagaaaatttattcttcttaatatgagaaacatctttccccacagacttatcgaggctgtctgatgaacatttactatgactccgggtcaacattacgtttattctggcagtttaataactgttctaataataattctcattacatagagggaaaatattacaaatctctactttacaagtgaggagatgacattcagagaggttaaataatgttccagaatccacacgatatgttggtggctgagattagattcaaatccaggattaaaaaattgaatgttccccaccccacagtggctctgatgattgttctcaatgaacccaggccagtgtgcacataaatcaccactctctgagtctactctattccttttctgttaccagagctaattgctaagtagatatccaatacttgtttagtcatgtcagttttgtatcacttaacaaatatctcttctgccaactaagcaggtatttacagccatttccctgctgtacacaaatatgagaaggtgcacagtttggcaggtggctaagaatgggtggctagatgtgaatgtcaaaagctgctacgtaaaggctaatttgtaggttgtgacatttggtgaactgtggctattcagttccttttaagcctgaacaaagtatggcattttaccttgtcagagaaagagcttcttggtcaaagggctgtgaagatatcaagtaattatttcagtaattacttttagaaatccagggatgggcacccaaaaacatcccagttattttagcttgagttagagaattcaaatacttatcctaataaatatgcagacttaatagaattggtgttatccagcactataacctcataaaatcatcaagaagagtgtatatacttgtatgtgtgtatatatatagatagatagataggtagagatataaaatttagtttaatgacatacttttttcctagcaatataatctgtctatatgctgacttaataactgctttatgagagctgtatatggatcaccattgataaatgcattaaatcagtggttccatagactggctgagaatttcaatcttctgggaagttataaaaacacacttttaactctgagtctctggagattgggatttttttttttttttctgagatagggcctggcaaccagcatttaaaatgttcccaggttaatctgatatgcagcctggtttagaaaccactgctttaactacctaatgcctcatcctcattagaactttattcattaaaattaaatactaatttgccttataatttggaagtctaacatgtgactcagcccaagtgactactgggtttggaagtcttctgtccagcacaaaccctgaaatccttaaaaatgggtgtgcaggtctttcttgtcttggtttctgatcacttttaactctcatctcctgccacttgctacacggatgtgccacattctgtttccttgctattcacagagaatgccaggcctatttatacctcctgttttgatctttagacttccacattttcttgtctgcctgtaaactcccagggatctcaaggattctacctgaacgtccgggccgcttggcctgtttctcactttttcctcagcatcccaaggactcactccttggtaccgactctttccagcctgacactttgttacagtgtgctgggttatttctttacatttttatctcaacccgtatgttggggacagaaaccaaagagcccagcgcctgcacacactgggcactcagtaaatatcccaaatgaagttttctcagatatgcatttttatccccatgacccctctacaattctgttctcaatgctgtgacaaatgatgtctctttcacatggtacagcttctttaaaaatgttctcttttgggtcttcaaacttgtttgctgctctctattaactgtatttcagtttggtgtttgtgagcagtacaatccgtttagtacatctgttctttataagactgcctttcttgtgaaatacttcatattggattttctggagtactttagagtcaatcactgggaaaaactatcaccacagctgattgatccggctgagtcctgctttggacgtcgtttaagactgcagtccatgggctacctctgtctctgctcccagcttctcatccacccagtggacagaaaagctgctctccacagcttgtttggaacgtgcaacctcaactccaggagatttactgagattcgttggtagaggctccaaaggatcactcttgagggagcgtggccggatgatcagtagatgaatgatgcacagctcacgctttcctttcgaattttgcttgtggatcgctctgatagctgaggatgttttcacattcgctgcgtcccccagagcagggaagcgggagcagggaggcgcagtgggcaggcgccgggctctcctatgccctgcggggaagtggaaggcgccgggaggagcgggggcggggtgcagggacggtggaactgaggaaaagcaggccgtggggttattccctgaatgaatcccgacccacacataagctggggttttcccaggagagacctggagttaagaacagagaggaaaaggatggtgggagagaggaggaggaagcaaaggagcagcccaggtgtgtcgtccgctctaagcgcagcggagctcacacgccctgctcctgccacgcgttgccacgaggcttcctcttgcattgcagccttccggcccaaggcccagcttccgcactttaggtgcataaaggggacactcaagggagtcctcatggggtgggcctgcgtcgcattcccatggctgcgagatgccgcagggtcaccgagagggcaaacgaggcaaagcgctgtcacctccgcagagctgacccagccgcccttcctcccgcccgtcctgcaggtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcaggtaagttgtttttgttcctttgatttcgaaattatgtcgaggcagattatgaattgcaatagcttcgatacttttgagaattctagataaaaactggaaatataaatgttttcattatttccgaggtctgaattcacgaggagatccttggagaagctcttgctcctctcaggctgtctcagggcaggcgcttaaggctaatgaggctgcctggtctccgaatcctgagcccctgacccctcctcatggtggccgagtccctgcgcgaaagggcgcaagctgtcacccgccgacctgcagagggcccagcacgccctgccccacaggagggcgggatagactccgggatttgtaggattctagaacgtattagatatatgtggtattttcacaaagccctccacagttgtttctgggacaacagccccacagttgcacacacctctctgcggagaaacgtatgacagcacggaagggatggaagccctgagcctccccaggctggggtcaattgagcaggatctgttgccggtgcgttcagaagagcctgggtttttgccaccaaatgaatttacgcaagaactcagagctttctgggttgcagattcatacacaagggttgggaacctaagatagaaaccgatcccctaagttcctttgccttagtttagcgggctcctctctagattcaggagaatctgtgcagagtcagggaggcccggcccttgccgggcacggccatggctgtgatccagacatcattacattgaacatgcaaaatcgtcttcaaggtggctacaatttttcacatttgggatggggagacaaatgactggaactcagtgatactagtttacaactgcacaagcatactggctaggcttttcaacatgaagacaactaagaggacagtgtcagttctgcttttgtcaaatatatatgcttactaaaataagcagcttaaccagctaatctctaagagcctactaatatgtgtgtaatttttgtagtgatgtgtaatttggaattagatttaaacaaatacatggacaaagtaaaaatctatggtaaactcttcagtttgttccctccttgtcacactcctcaactataaaagggctatcactattttgagtcttttgattataaaatatgtttcttgaagaaaataatacaaagcacaggctagccaaaaaataaaataaaaaacaatcacatgtaattttaccagagatatctacagtaaacctactgggataatctgccacatgatatacataatacttgtatctacatgcatttgtatttgttatcacaatgagattacactgtaatactctctgtaactcttttacactccataatatctttgtatctcttcttataaatcagtacaaccactttactcatgaaaactacagtaccctgactactgaatggctctttagtagtatgttgttggaggcacattaatttatttagacagtctctttttgggggcatataaaggtttatttatttgttttttttttcctattataggcaatgctgtataacaatctttatttagttagatttaggtgactatctacttattcttaccatcagacatttctattagaattttggggggcaaaggcatcagtatttttatggtagatagtgccaaattacccttataaatgtgtgccaattaacagtcttataaagtcattgattcttttcttcaacaaatatttatggtgtacttactatatgctagctactgttctaggtggtagttatatgtataattagaacaaaccaaaacccctagttttgtgggagaaaggaagttcagttctctaaactctaaaagttttgatagttcagacctgatatttcattgcttaataggcagctctttgattactattgaagttgaatattttcaaagttttttggttatttaaaattttactttacatattgaatatattaagcatcatctatatatatataagtgtatttccacatcatattttgcttctaactgacttcttcaccctcctcccctctctcaactttaccgcttatctttttcttctgagaccgctgagaatttcccttcatggtgtttatttcactgataccattttcagttgactccagatagccattcactttctctactgcattgttaatttggcgattatgtttttcatttgaaagcatttttcctactctcccagtattcatttgttatagaagtgatgcacttcaaaattattttgagtctgagaattaagatattttaatattttcttctatttctaagagttactattttaaattgagatattggtttgttctcatttttcataatgttacttaacttatgaaacagagacattcacatgtctggaggtttattttctcatccttacaaaggagtcctgcctacacaggctatcgtacctgttccatcagtgattgcaagtgccccacttctcatggttaatttctgtctaaagagaaaagaacaagcttacattttctcagtttttattttagtagagtggtagtttagttagttatgaggaaaaagtaaaaagctaccaggaagcatccacattgatggaacattttcttgcttttttgttattatctctaatgtttgcagtgatagtcaaaaattagtgggcgagaagaataactatcatcatttgatcattttatgggtgctataactgctcttgttaggaattctccactgacattcattacttttcttctgcatactggatcctctctgagtgtgtaccttgatttctctgaagacaacccctgttgttttgcatttgtattaaacttgcctctttccactctcaaaagtgccctcttatgagtgataaatgatgtggccattccttcgttattgaatctgagcaccatgatctaaatcttggcacaggaatgattcaaaaggggcccagattttcacatcttatagtcctcctgactccctgtgtacacaggccacccgtggtaacccagcacccatccttgctgctccaaatgtgggacaaccccattttataacatctgtgagcagtctccttgggaaggcatataagattgccattacactccctctctttctccttagggtaactccctgttgatagatgcataattcaggcctgcatgtggctttcaaaaatcatgaatgcattagctttgtgctgatttggaagatacatataaatcttatcttattagtgttctgacaattctcaatagagccccatgcttctaaaattttagagttgagaaaatgcaattatatatctacattaaattcactgaaaatttcttgcagaatacaaatcttcataaaagcacaaaccagaagaaatgcactagagaggttcttttctacctgaatccttctacaaatgaagggaacagatgacacccccacagctcatagagggtttgagcttcttgggcccaaacaaacctggggctttggcaactcagtctgcagtgttctccaactcacatgctttggtggccaggtagggagtgaacgcatgacatccacagggctgtaaagatgcttgttttgtaaccagacctccacagcacattgactttatagactgtgagggaggaggagaagtatggagcatgtctgtgttggtttggggtctggtcagccattcatgacccaggcttctgactcagttttgttctgaatcaacttgctctgattgctgttttgagagtgctccagaaattctccctccccactaagaagtgtgagaaaagggtggcagggcctctgtgcctgtttagggtggaggcgagcagcacagagcagccccagagaaattagaggagggtggtgcatctctgagagatatagtgtgaacacagctgcacctgcttgcagacatctgaggctggtaagacctgacggacctgctcaaaaccttgagcagctccatattgcccaagggatgatattgccacatcttagcatatcctacaggtcctcctggtgcctctgcagcctctgccactccctttatctcatgctctgaacttcagaatgacacaatcatacatgatgttgctgcatctctccctgtttaaggaaatggaaactaccttcctctcctcagtcctctgccactcccactctatacactctaatgttcccagcaaaataagaatacttcaaaacccggctcagatgcccccttccaaggatcctctgtgcttgctctctcatctgaatgtctgtcattcctgtgtggatgtcactgtggcttaacttagtgcgggagattcttgcctttcttcctacagggagacttcctggagcttaaggatcaagccttctttatatctgtacctttagttcctgccaacatgtctataaatgattactttcattaaatccttgttaaattgaaataatgaaaatgaaatgtatcaaaaatgtcttccagaaattaacttggacaggcagcagacaaacaaatggagcatagaaagacagctctctacacattaaaaatataaaatatttaggctccatgacctcatcttctgggatggggctcttagtccttactagaggagatggtcctaaatataccactagttcactgcattagaaaaacccgtgagccctccttgaacatggacctgaccctggcccactgtctgctgagtttgttcctacccccaaactctctctctttttctcctagttctccaactaggagacctagaaaaagacctagaaggagcaagtgtaggactcccaagtcctggttgctacaccagttctttaagaacccaagagggccagtggatgtatgtggccagtcggtgcccactgtcaccatccccttctcctgttagcatgccagcagaaactgggtgcgttttttagttttctagggctgctatagcaaagaaccacaaactgggttacttaacagaaatgtattttctcactgttctggaggccagaagtctgaaatcaaagggtcagcaggaccatgtcctctctgaaggctccaggggagaatccttccttgtgtctctagcttcagtggctgccagcgatccctgacatgccttgacttgtggcagcatcactccagtctcagcctcctgtcttcatgtggccttcctcctgcatgtctctgtgtccacatttccctcttagaaggacaccggtcatattggatatggtacccactctaatcctgtatgaactcatctaattatatctggacaaactcattccgaataagatcactttctgaggttctgagtgggcatgaaatttggagggaaatcattcaacccacaacatttcctacaacatcttccttaacaaataccactaaatttgaccaatctcttggccacttgcctacagtagaatcacttggtgttctgtaaaactcaagcttttctgctatatgcagaaggataacagaaattaaattaactgaagactgacagtgattgttggtgtatatttgttggtgttctgtcatctcaaaaacatccaccaggttttgcaaaatggtcaccgggatgtgataaatgtatacttcatgatccagtgatgttaacattcatagagaacatcttcaattatttatattcttctcctcatatatgtacaacttccttctatgtatgtggcatctttatcacatgagatagtagtgattgcttcactttgtttcagtaattcagtgagaggacgaatggaaagtaattggacaattgtttggaagaaatataatgaaagttatttttcttcttattcttagtaaatactaggatggacctaatatatcatctgtgcttttgagcgggatggagaggatgtagcacactcaccagcaggctcttggaagccttttttctggcagaataacatacaaagtgctggctgcccctctgatctcatttcctggtttcccttcccttgtctgcaaggtccgccttcacaccaggcttcgtccaggtcatagaacatccaaactctggaccgactttgcatgtccagttggataccccaagagcattcttcctctcagtcatggcacagaagctgctttctcaatgtaactcgcccatggtccttttacagtccagtgggaaaaaacagatggtaaatgaaatagctgaaactatttgcttgacttaattatgtatacattgtatggggacaaagtccagcactgagtaggcatttttaaaatgtttacccatgagtgaatatatatccttcatgctctacccaaccatgaatttaggatgtacttcatggcccctcaccctgggtgaactgttcttcagctcagcccacctgagattcagtaatttgtgaattgctggtagtcgtacctcttagtgggttgaaatttaagaaaaaagagagagaatccctgatgacgacattctcattgtggacagtgaactcacagatgttgggtgaactcctcagttggcacaacctagccaactagccaacaggactgagaatccatttcaggcctcctggctctaattctcattccacaaacacttacaaggccataagttctaccctgagaaagtttacagtcaagcagagaaatgatccctacaaacagatgggaaagtcttataggtagatacttggtgcaggggttgtgcataagccacatggggagatatttaggggtgtcaaagaaggttttttaaggctatgccccctaaattgcttcttctgagataacaggtgttttccagacgtggagaagagaaagtttcttctcttgtactctctctaaaggaagagtgtgagtaaatgtgaaaagtaaggcaggaagtctagcagaagccttgatggtttctggcaggtattacggtattataaggcattctgaggagaattgacattatcttgcaaacacaatgcagggaggcattaagaagttctaaagtctggggagtgatatgagggggattatttttgtagcttccaggtatgaagtcttatttggagcagtctatctgagtctcttcccctcataggtaactttttctgtctggaattgtgcaagatttcttctttatccttggagtaaaggattcccccccccctactgtttccttatcaaaactgcagatttaagtctttttttcagttcagggtaatttttttggggggtgggggagtacagggtctcactctgttgaccaggctggagtgcagtggcgtgatcttggctcactacaacctccacctcctgggttccagtgattctcctgcctcagcctcccgagtagctaggattacaagcatgcagcaccacatctggctcatttttgtatttttaatagagacagggtttcaccatgctggccaggctggtcgcgaactcctgaccttaggttatctgccggccttggcctcccaaagtgctgggattacaggcgtgagccaccgcatcctgccagttcagggtaattttcttctattattaatctaatttcttcacacccatttttcctttacctccttttagaactcctagcacatctcatgttagggtcttccaaatccatcttttaattctttatctttccttaaggatttctttttcctttttgtcctccttctgtgtggatttttcttatacatcactgtttgtatctaaacagtggctatcctcttactcaatttatacctctaatattatcttcaggaaaccattcttcttggtttgagaaagtcctgtgtaggcatgtgcttctctgtttttttgttttgttttgttttgtttttaattttaaagtgtgtattcctgcagcacctttatttttcataaatattggcactgtttgggtttttctctggttgctgggaccccaggacatgtgtttgttattgctgttttgacagatcagataagtatgttgcctatcaactggacgaagttccgaatcaaagcacattctgcctctgtagggcagcagctgggctgccagtactttctgtttttttcagggaggtggggacctttgcttcctatactctctctcatttaggaatagaaggcatcagctcctttaattaagctttttcttgactattggggtccagcgagagaggggaggctgaggtctctggagatttgcaggtctctgagggccacacctcccaggatgggtcctttctggtccttttccctggatgctctgctcctgttcttcacattgcattcatatgtggcctggcctgtagagatgatggccctgaatttgcttggctagtagcaaatcccatagagcccaagacctcacctggaaccagaaatttatcaacaccaaaagctggttggatcaggagaggtcgaaagactggagctgagagtgtagggaaggaaggaataaagaaaggaaaggaaaggaagggaaaagaacggaatggaatggaatggaatggaatggaatggaaaggaatggaactgaacggaacggaacggaaaggaaaggaggaagggaggaagggaggaatggaggaaggaaggggagagtgtaggctgctgtcttcccagatgccccagtgtttctcaaggttggtttgatccttgtctaaatcagaaccactggggggacttgttaaccaggaaggcccattaggagtgtgtatttgttcagccaagctccttgggtcactctggtgcacaataaattttaagagatgattattagagagagtgattccatttatgaagttcctcgagaatcataggtagtaattttcaatttctagagtctagtaaggacagatgtcaaatgtttctaacatagagatttactttaaaatatagccaggagtttgaaggcaacaaaagagggatagtttaggaaaaagcatttgaagtttgtggtgacaaagatacttttaaaagaagcttgcatttcctaatttgttagaaacctgaaggctgtttatacagaggtcacactgcctacttatgagacataactttgttgtaaatttcagcaagttccatcattgtgtgtttctggccacagctgtagggaattatattaggacagttgtaaaccatacgaatattttaaaatctttattaaattttatgcagtggggaagatagtgtttttctgtaaacatttatttctggatttggatgccacagaggtgtttgcattttaagttgctctggaaacaaagtcctcctcagcagaaatataatactaatttaatgtaatgagttgcatttcttctcaattaaattttgtttttgtttgaatggtaaaagttcagaaagggccagatttagggaagtaaaataattggatggagattaaggatgaggccaatgaattcagtgcattgttaacatatcacaacttggttcgacacatcatttatgagaccctgagttccaacacctatcctaagcattgtgccctttcctcaaggattgcttcattccagtaatgagaacaagggtaagcctccagttaaactccagtgaagatgtatactaaggccaccaggcaggacaaatggagcagaggaggcagggaggacttattatggaatcggtgttccaaccaaggtttccaggccaggctggagatggcttccaatcaagtgtccaggatattggagataccgagacagagggatcagcaccctcaaaagcagatctgcccaatcaaacagtggttctcctggtctgggctgcgctggctaggctgggctgggtgccgtgctcaggaagaaatggtgagcaacaggccctaggattgtggagggattcaaatactatttcaaaacgcataggtaacaagaagccattgatacattttgagcaaagaaaatgtcagattggtatgttagaagagctcactaaaggaattagagaaattgggagtctgtaatgttccattctatgtgtacggtcacactgaacagtagcctaatgagaagtttcttctcattctgagcttacgtttgttctgcaggatgtggttggaaattcctacatttccacctcagacctttctacattttaatgctaatagcaattcagaaaaatattttggactcaattatttcttgtctgagaacaaaaaattaattagagaaatcagtggttacagattgctctgtggttgcttacatttcttctttctttttttttttttttgcattttctgttttaaagcttttttattgctcataataattatacatatttatggggtacatgtgatattttgatacatgcgtacgatgtataataaccaaagcagggtatttaggatatctatcacctcaaatatttataatgtcttactttgggaacatttcaaatcttctagctgttttgaaaataggataaattgttgttaactacagtcaccctgctgtgctatcgaacactagtacctatttttttttataactgtatgtttgtacctattaaccaacctctttctctcccctattcttcccagcttctggtgtttgcatttcttcaatgtagctaatgttttaagttctttaaaaggagtcacttatgtatatttgttaatttatataataattctttccaaaaagaattgaggtcaccaggtatatctatataatctataatgctgattatataccatttttgaaatttttgagacaagtgtttgcaaagattcttactcaaaaagtattttataaataatgcaatgtaagttctgaaaagtaagaaatctatactcttttctaaatactaatttagaattttaattaattaaatgagctcattctcattcagtccaatttagaaaatcttaaaatgtctttttctctacattttctcaagattgtcttataattgaggtataaaatttaatacagggtttgtttctacaactccccacagtgacatgaatagtgtcttattgctgatggtgtcttcagtaaggaaattcagtattggtggttttggctttcagtaatgctgcttgaactacaaatagacttctgagatgtgtgccagtaaaatttaatgtgtacttaaagcacacataggattctgtgttgaggacctctgttaagaaaatgtagctcaatgtagctcacatatagaaaccaaatgatatttcttacattagaaattgttttatttcaggactatgttaatagaacaaatattcagaccaaactggagctccaactttaagagcatagttttgcagattttaatatattaacacaatatgatattatgtagcctttaaaatttgtttttaaaaaccatgtaaatatgtgaaaaatggtggtgttatattaagtgaaaatgttgaggaaaataatgtactgtgaatgtgagtctataaaaatgcatatctgatggcaaaactatacttgtaataaattttccaattttattgcttgtttggcattatcataaaaacagtggaaaattagctgtatctcacttactaggaatcattagatggatcagcctgactagggcacaatgtgaggtcagcagctggttctccattctctgttgggagccactaataatcccactttgtttcctttgtctcacaatgaacagcagcagtgggggcgacaacttggacctcacccgtgtgcttctgcggaagtttagagatcaagatttgccctgtgcagatttaaacccacgccagtaagtgtcaggtgctctctgcaaaagtgaacactcccaactggtaatattgtagcctgggaggactgtttttcttcatgattggttatttcatgtcacaagtttatgttataaaaaatgaaaattagcctaatgactaggttattactgaatgggccttatgggtatcaccatataaaatgatccgaaataagcttcataattaccccctttctcccttcgtacatgcatgctttatattattgcaaaataaattaataattaacagcattcaatttgtttaataaaacccaaagctgaaaagaatgaagtaggaattaagtctgaattatgtcttagctattatttacttttagagaatccttgtacatataaaaaattaattatatatttttttaacttaaaagacttaaaggtcagtactgtacatcaatctggggtgaattactttgaaaatgatctttttggtatttaatcatggttattgtgatgatctttctatgaaacctggataggggaggcctttctttataaacacttatttccctcttattttgctcaattgttatatattgaagatctactacaagcaaagtgctgctgtaggaaccaaaattaatacggaatatggccctggtctcaaggaatttacagttctgggtagagcaaatgaggcaaatgataaaagccataatgatttattaagtgccagaagtgtatgtttttaagtagtaaatataaaaatctaacaataatacaatattggcaatttgttttctaatttgcgatgacatattttgcccattagtcatattggtaattagtgtgagactgaaaaactattaatgttctcagtaagaaagaattaatagataattatgctgcttcactctagtctttgcaaaacaaagtaatttatttaactaaaacttcaatggtaatgtttctatttttctcctctctgatggaatacacagggtgtaaaatatgtctacctttgaaaaattgaaatgtaacctagggccccatggggtccagccctggtccaagctgggatcaaagaagaaccagttagaaaaaaaaaaatcttttatctagtccttctccttccagaggaaaaaaacaaaaggtagaatcaataattaaaggacagcagaacgtattggacattttgtttggacacgtattttacttccagttccttttacatgggttgcagtagagccccaaactctcctcctctcctctctctgttccatgagctcctgccctccagcccagcctgcagatcagcctcatagcttttctcctctgtccgttcttcttctaccttcctggatttatgtttttgtgttctcccttttctttgtgaaatctacctaatctatccttaactcatttctatatttaatcatttctatctatttttgtggtcagcataacaaaagggtaggaggagaggtacatgaaaagatgctgtgaacacttgtattaataataatttatgtccatgttatacaaatagggcttgattcactaggacctcaaatcagagcaaaaagttttacttaaaacctgtagatttccttctgtaagtgtaaaatattgttgaatttgatgatatctacattttacctccttggaagacttgggcaatcacttgataattaactagaggaaacattttaaaataatacattagattctactgataggttgcttttctgttgagatactcagctctgagtgtcaactcaatggtgctatgttgaacttctgatttgtacctccctctcatacgaagacaatgaagagctctagaaaaatccactgttgtctaaatccgatctaaaatatgagttttctcacagtagtaggtgatgcataatttaaaatttaaaatgtgttaaagtagtcaacttttagtagctgacgggtagatatagatatttagctttattttacaaggcttatatctggtggcacttcagtgttgaattctcctactatttctaacacaaaatggtcactttcctcacccattcttgttaatggtttagtacagaacaaaagtcatagcaaatcttatatttctatcaaacttaaaacgccaagtggggagatggataaggtttatttttgtaattaaaaagaaagttattagatagcagtgatacaataaatcatctcagtactcaggaaaatctagaaggctcattattagccaaaaggtgggatcttcagagcctgtcatggctggtgacagattccctcttaggggcctgtaaagaggaaagttgaggccatggatcagcagtgtagagaatgtgcataccagggatcatgatagaggggtaatataggaccagtcttcctgaatccaaatctcagctccactcttactgactgtgtgacccacgcaacttgctgaacctctctctgcttttcttcatttgcatcagtgtgctctcagttctatagaaagaacagtcacctcaatggcagggtagttcttgtagagagcttttgttctcttaaggcaagttcctgcctcagaaagcaactctcaagacaggaggtccttagagcttctgcctctgtcttcgagatttaaaatgcaccttagcactttggggaggccgaggtgggcggatcacgaggtcaggagtttgagaccagcctggccaacatggtgaaaccccgtctctactaaagatacaaaaaattagctgggtaaggtggtgcgcacccataatcccagctactcgggaggctgaggcaggagaatcacttgagcccaggaggcggaggttgtagtgagccgagattgtgccattgcattccagcctgggcaacagggtgagactccatctcaaaaaaaaaaaaaatgcaccttaggtgattgaaaactccaggcagccctgtagtagagagaactatttcacccagtgtgtccaaacctgaaggaccaaatgaccctcctccagcagcctctctgcagctgtgtcctgtaggccactttagggaaatgctttgctaagtcaaagtgtatttttcgattcttaaactttaaaagaaaaattatgtagaaacttctgatttctcatagatcatcccctctgtctctcccttttatgaacattcacacagcttcttagtgaatctgtttgaacacaaaacttgttggaggctgagaagtgctcaaaaaactacctgtcatgggtcattatgtacctctcatggacacctagttttactctataaaagggagctaggagaagaataagggaggatttggaagagaaaaagaagactttttgaagtcatatattaaattataaacacttgttaaccatcatctaaggcatctgaaggaagaaaggcctgctgagtttcagaagtataaatggaattttttttaaaagtacatatcagatacagtactctgattaaatacgtaactctcttaggtgttatttccatgtaaactcttaagtttcaaactggagtccctataagctagtcagccaacaaagtgtggagaaatctttacgttatttttgttgtttcaaaaattacgtagacattgtactttgctaacctggttaatagaaatggcaagtttcttttcactgggcaaggctttcttcaattggtgttatcatactggctttctcattggagcagcacacactttgcatagagctgggatctcgacagctgcttcacctctctggaccccacctcttcttctgaaaagcagggctagtaaggatggtggtaaaaatatctagccggtgcttgtaattcggtaaatgctagttttcttcctccttttccaatttttgagtaattaagagtaattatcattactgaaacaaagtttgatttccaaatgctagaaaaaatattttaaagtatgggactcataaggaaatagaaatgatagggaaactgtggaatacaaatgtgtttttgaaccactgctacaaatggttttcataactgtttctgttgcacaatctttctgcaacagaaagtttaaccaaaaaggtttaaagaggaaatttaaaaattgtttttccttaagtgattattgaattactgtgtcatgccacaaaaaggaattgacgtcttgctgtttattaattgcttcttggtacctgtttatgagactgcaagcctcagtttccaccaggagccccagccgcaccgtgaaagtcctagggagccctgtgatacactcagtacagtaagaaaagtgagccccatgtaatataatggaaatgctggcgttgtaataaaacattgtcatcagattaacagctcaagctgtgaaaacaaatgtaagagctctgccttctcggcagtgggagatgattatcttgtgaactctgttctagtctgatgaaactctcttttatggaaatacaatggctttgtaaatctaaaagatcattccaattctctcctttgttttttaggaagaattcttcatgctggcgcacagatcccttttctcacccagaattccaggattcatgtggctgcctggtaggtttctgcagcatttttgatctttttaagtctaaaattcaagtgacaaaaatgagtttaccctatctataaaattttcatatttgtaactgtgtctttataactttttggtttcctggattagctgtttctgggaaaagttttgtcacataaagtgaatatttatagaacacagatgctgtatagattgacagtgcccctctccttcattgccttctgcctttggtctttaacattcccctggcattcattaagaaaatgactattcttcaagtaatgataaagaagctagaattgccctaaggaaggaaatttttctaaatttcaaggcagcatgacctcaaggttcttgccatatttttatttgggctagatattaacagctaagatgccccttagctctctgactatggttgattcttacaaaaacatgtggaagtaggtgtgccactattgaggtgagagacatcactgtctaatctgtgaaggagaataaattgaaatttatttggaaaactgattggaactcatctcaaagaaaatctcagactctaattaataaaaggcatagacctgctagccacaatcaataagcaagtatgatgacaggtctaatttataggaaaaagggaaaagaaaaaaaatattgaagttaattgagcatctgtaatggaaatggctatttggagaacgtgtttacagggccttcctagttagtggatgatgagatgcaattctccttaatagttgtcaacctaagggaagaaactgagacaaattaatataggtagagagtttatttgagccaaagttgagaacagctatgtgggacacacttccaagttatctttggaagtactctagagaacaaaaaagaagctcaagtgaaatggccttattgtctagggtgtcaaatgaagttatttgtctcatggccaaggaagtcaaggatgtggacacaccaagagtgagcttagagcagaaatgtaataagtgaaagaaagagagaaaactctctgctgcagagagggatctcaaaaaagcgttgtcattttgcagtgaagtgcaatagttttaataaaaaaagctagcagggaagggtgctccatttatatagggctcaaaaaaccggttaggactaggtgtgtcatttccataaggcacgaatccctggcagtccccaccccatctgtttagtgtacatgcaggtccttagcctaagttactccatattgcttatctcctcctactgtgcatgcattaggggcggaaccctttttattaatccattttcatgctgctgataaaggtgtacccaagactgggcaattaacagaagaaagaggtttattggacttacagctctacatggctggggaggcctcacaatcatggtggaaggtgaaaggcacttcttacatggcagcagcaagagagagaatgagaaccaagggaaatgggtttccccttatcaaaccatcatatctcatgggacttagtcactaccatgagaacaataagggggaaccacccccgtgttcagttatctcccattggggtccctcccacaacatgtgggagtacaaatcaagatgagatttgggtggagacatagagtcaaacaatattacccttcaaggtggatgtgcctggcccaggctagctcttcttatctatagtgttgcagccatgttccaagcaagctccccgtgcaagcttccttatgtgagtatgtcgaaaaaggaaaggaatgtgctcactggggcccactgtatgtcagtgaaacttgctgactacacaggaggcccctttctgtgagggaattcatctccccatctatgtttgcagcccgaactttcaggctgctctttgttagaaaataaatgccgctgaggaccttgccctaactatctgcctagccagtttcttccttccttctctctcataatttattaaagaaaaaagaatgaatcaggagagtgggtggttacaaaagtcgtttgtcagggattctcactggcattgttaggttactttatagctctggtggtggcactcagcctagggtccatatagcgagctgcttagaaatgattgcttagcccaagggggatggggtggagtgtgactgctatctcactccagtgcctctctgggcctgattatttaaagggagctcacattcctcagataaaaagtttttttgtttgtcttttttctagagattttagaagccttgcttttggaggaactagtctgctttcttctcttagacgaaagatacacatgtaagcgggaatagtgacacagtacgcttagtgagcactcagagtgttggttgatatgggagaggttttggaactctccatgtttccctcttggccccagctgtcaataaactcagctacatttggtgatcctttgcagtgatcagttatctttttttttaaatacataattattgttttttttcccctggtcttgtttttccatttattcactttaggggcaaagggcaaatttccctttcaccctctgaagcttcactgaaaatcagttgacaaaaggcaggttaactggggaaataccatacaaatgtgtgaatttgcatgggaggatcacatcacagagtaattaccccaaacccccaaagaggtgcagaaatttctatacccttttcataggggaaggaggagatgggaaatgtggataattcttttagggacaggaaatgattgttatagagaaagaatgggccagggagagagaaattaggttctctctaattagatgattagatgattagaaattagatgattctcctggaatttgagtgagcccgaaagtcaggcattatcttgtgaaaaagtccatccaagcatggttgcattcttcacacttcttttctgaaatagataatgagatttcagggaggggattgaggacttatgtgtttcctttggtaaggagttttttggtcagatatggaaattccaaagagaattggaatggaggaggaacaagacaaggtttcagggaccttgattctgaggcttatttctgaggcctttcaattgataaaaatgcccagcatgcacaaatgccatattttgggggattgttttctatgcctcagcactcatgagatctctgattttttacaccacgctcttattctctagccttgatttgatcattctattatagtagtggcttttagtaccaccagctacctaaggcctattgggattagagtgggtaaatatcagaatgattggtgtttatgttcctaaattcacttcaactcacataaactatgagatttcagtaatatgtaagaaaaaaggttttatctgaaaaagttccatagtcaaatacgttttgcaaatgctggataaagcagtattaagcaggtatctttgccacagctcttctaagaagctatttggtgataatgaaattgtccttgaattgacagtggagtagatgcagcattttctgcaaatttgactgcaagagtccttcccttttgtggcagcagtgtgtttcgggatgcactttgagaaatgttggaccacacgttagaaatcagagaacctcaggagacagggagttgaggtggaattaatgaaagtcctaagcaatgggtgtggctactctttggggttgtctcaaaggagacgtacacaaagctgtgtggaaggaaggcctatagacccaaggccagttctctggtctttagtgttcatgttgagccaagttgactgtgttttgttagaaggaaaaatatttctcttcccttaaatacatgtgtgctatccagcagccctgggtctgcaagagcatgtcaatttaatttttttttttttttttttttttttgagacagagtctcgctctgtcacccaggctagagggcagtggcgtgatctcgactcactgccacctccgccttctgggttcaagtgattcttctgcctcagcctcctgagtagctgggattacaggcatgcgccactgtgcccggctaatttttgtatttttagtagagatggggtttcaccatcttggccaggctggtctcgaactcctgaccttgtcatccacctgcctcggcctcccaaagtgctggggttgcaggtgtgagccaccacgcccaacctgtttcctcatgttttatcaaatatgctgtggctgtctccaaacctacaaaaaggttccatggttagtccttctgaggatgaaaacatgatttggaagcgacaccgttagaaaaggcttaaaggggaacaggaattgagctaactctaaagaacaaacagggatttttagggtctgagctccagtggataacaacactatgacccaaaacatgtcatcgggactgagtgtggctttatacagaataggtggagggcatatttgtttcttgtcgctgagataataaattatcacacagttggtggcttaagaaaacatgagtttattctcacacagttctggaggctggaagtctgaagtcagtgtgactggagtgaaattaaggtgtctgaagactcttgaggacaatctgtccttttcctcctccagcttctcttgtttctggccttccttggcctctggtgacattacacacatctctatctccattgtcacagtgcctcctccccttctttctctgtctagtcctcctctgcctccctctcacagtggcacaggttgtaaccagcaaaagggcctggctgctcgctgcttgtagaaagaggccaaaataataacgagctgattaaaagtgagcaagacttttttatatgtgccagcaaggggaagagcagaaagcaattccgctgtaatttgtggagggaacacagggttttttaaagaaagggtttggaatgcagaagaggcaggggtggtaggttgggggttggggagcggggagctaggaggtcccaggaggggttacttactccaatggttcatcttgaattattgtttcatttggtgaagaggctgaccccatcgtggatcctgccaggttataaactaatcacaatcttgtagttagtcttcagccgggaatgggttctggccttgaagtaatcttttgttggggacagattttcagaggtgtctagtcctctgaaacttctaaggaaatatatgaccaggtaagtgagcatggcatgtgcttaacaagcatctaggtaaataaatatgcataaggcatgggggcatgaagtgggaaaggaaagagaaagaaaacatttcgaggctataagtttatctcagagctacatcttgaaactcggaggggaaagaggaaaagggaaaggataaaacattttaaaatgttgtttgaggctaaactgctaagcagctcagttacaaggtgagtgcatgagggtgcactgtcacaatccaggataatcttctggactcaagatctgtaacttaataacatcgtcaagatacaaagtagcatttaaagagtccagagatgagggcctgatattttggtgggggggcggtcaatattcagtttaatacagagggtgtatttggggacacctacacggataatggttagaatgagaccaaggatattttctcatgatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgagccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaataatgagttcatgtcttttgtagggacatggatgaaactggaaatcatcattctcagcaaactatcgcaaggacaaaaaaccaaacactgcatgttctcactcataggtgggaattgaacaatgagaacacatggacacaggaaggggaacatcacactccggggactgttgtggggtggggggaggggggagggatagcattaggagatatacttaatgctaaatgacgagttaatgggtgcagtacaccaacatggcacatgtatacatatgtaacaaacctgcacattgtgcacatgtaccctaaaacttaaagtataataataataaaaaaaagaatgagaccaaggatattttctagtagacctgaattcttgataataattggaattttttttagcaagaaaatcatctaatggaaaacaccattttagaaggatgtatcttgataagtatggggggtggtgaagtgaattggagagaggaaagctggaggtagggaaactttggaggttgttatgttcatcaaggttggctgatttatttatttattttaattgagaagcagaagttatatatatttgtggttacagcatatcatatatcatgatatatatataatacataaaatgatatgatatatatacatatatcattatatatacatatataatatttcatttatatatagtatttcatttttatatatatcatatatatcattttatatatatatatatataatcacacacacccattatggaaaggctaaatccagctttttaatatatgcattacctcatgtacttattgtaggggcacaggaaaacttgcccttcatcctctgtaagtttgctaaaaaatcaactctaaaagcagattaattggagaaaaggcatatgaattcttttaacatgtacagggggagaattacagagtgattatctatcccccaatgaagttcagaagtttatatatcatctcaagtttaccaaaagaatagggctttggatcctggcaaatcaggttatggcgggagaagacgcattctgtactgggacaataaaagattgcaatagagaataaatggatcttggaacagacactctctgtttaggtatggttacattcttggtcttacagggaggagaagaaataaaacattctccttggtgagtctagattttagttaggtaaagaatttcaacttcatcctgtgctttgggagagatggtgggtaggagggaggtcagagagaccttgaagcttctttagctcagcatgtgaaagcaccacattttggggtattgttttctgagccccaacgttactatttgtgtgcatgtgtttgtgtgtgttgaggatacttaaaatctactctttttttttttttttttgagatgtagtctcgctctgtcgcccaggctggagtgcagtggcgcgatcttggctcactgcaagctccgcctcctgggttcacgccattctcctgcctcagcctcccaagtagctgggactacaggtggccgccactacgcccggctaatttttttttgtatttttagtagtgacggggtttcaccgtgttagccaggatggtctcgatctcctgacctcgtgatctgcccgcctcagcctcccaaagttaaaatctactcttttagcaattttcctttttcctttttttgagacagagtctcgctctgtggcccaggctggagtgcagtggtgccatcttggctcactgcaacctccgcctcccaggttcaagcaattcttctgcctcagcctcccgagtagctgggaccacaggattgtgctaccacgccctgctaatttttgcatttttattagagatggggtttcatcatgttgcctaggctggtctcaaactcctgacctcaagcgatccacccacctccgcctcccaatgtgctgggattacaggtgtgagcccctcgactggctcttttagcaattttcaaggtacaatacattgtcactaattgtagtcattatgttgtacaatagatctcttgtacttttgcctcctgtttagctgaaattttgtatccattgaccaacatcctctctgccaatcaccattttactctctgttcctatgagtttgacttttttagattccacaaataagtgagagtcttgctgaattattatgtacaacaattattattctttttagtatctttcctcaagcctttctttcaagaccctgaaagtagtatcttaaatgcatatcgcccttcttactttgctgtagttctttcatgtgtatctgaacctaacagcaaatccatgcatttaggtaagcctgttttcattttcattttgcaaataagcagacaagcttccaaagctgtaatgaatgtgaaactggcccaaatgtctcttagaagtaatatttatggattttcgaataaacatagaaatggaccctccctggtcttaaaagttgaaacttacatttctctcacctgagtttcttcctcaagaaactgatcctcaggcaagggactgaaatacgttagatctctgagttcagaaaatgagactccagacgtcttatccatcatgattgcttccttacccctccttctttcctgttttcccattttcccctccatataacccccaccagttttagatggttgaggagatggatttgagactttctctttcattctcctcagctgcagaactcagctaaaagcttcctccctggcaacactcattgtttcagtgattggctttctgtgcagcaagaccaaacccctggcattttgataacaaaagactcagagacagagtcgtttcctattttaatatatcatcttttctgaaagtgtttgagaaatggaaacaaagcacattaactctaaagccggtctgtggcagggcagagcacatcattgcgcagcctccagtggcctgggttttgcgttgtgttgatcacctcctcctaccttgttaggtgattattccatgatgcagagctggtgttggcatgctggtgagtcgctggagaaaagctgtttgatttctactttagacccttatgaaagagacacacgcctttgaattatcctgcttatcttcctcccactagttgtttctgactctctttcaggttcgtcaaatgcaagatcaccccagtgaaaacattttttttctttttagtttttataaatctgcccaaacttacatacagaaaaggatttgaagttctcagatataattgactgcataagtcacagtggtattctggcataattctcaaatacatgtgactgaaagagattttagaaattagaacatataaagggctgcagataatttattaaaaattgaaagctagagaacaatcacatgtagtttcaagtaatgtcagtgaaccagtttgtgaattataaaaaagtttgtttttatctttttgaaaacaatttcagaagtgtccaaatagaagtgctagtgctccctacctgaccaaccacctgggccacacactgttgaatctctcaggcttcaatatggaggagtacttgctggcaccatctgaaaaaccaaggtgtgttcaatactcttgttgggtctttacttgtttggattactatggaaaacttattgttttaaatgctaatgttcttaaaaagtcaaaaatctaagactgaccttggtgctcataaaaattccacagtgtgtgatgttccccttcctgtgtccatgtttttacattgaaagtagacaaatagttttgtcatctgtttctcatccatttctaatatttaaatataataaagtctaattgaatacaaaaacaaacaaaaaaaattccacatagatgccatggaccttaataagattccttactgctgactttcactcttttaagtgctgggggaaatcctatcaattgagatttgtcagtggcagaagcacgagagccagaagctgttttactgctttaggaaataagagcagataagtttacagcatgcaagctccacctcccaggttcaagagattctcgtgcctcagcctcccgagtagctgggtctacaggcacctgccaccacacctggctaatttttttgtatttttagtagagatgggatttcaccatattggtcaggctggtcttgaactcctgacctcaggtgatcctcccgcctcaggctcccaaagtgctaggattacaggcatgagccgatagctttttgaaggtgggaacttgtgtgcccagaacttagaatattatctggcacatcaaagatgttcaaccagtatctgttgaatgaatgagtgtattcagttgagccagttgggaatgtgtacttattcctttgcctgaatttttgctgagagtagaacactgtgatagaagagaagactattcttcagtctccttttatctagtgagtggaagacaaaatttatttagataatagttaacattatatttttttaaatgttaaccctttttttgaagtttaatagatacaagatactgtgcaactcatggagatattaaaaaaagatataattcccacccaggaaaaattcacagagctacataaagataaaccagcaaatagacaataaaacccagtgtggtaattgataacaatggatggaaatacagggtattgtgggaactcaaaagacaaggaacatctaacccacttgaaattgtctggaatgctttcctaaaccagacaagatttgagtgaaagattaaagaaatagagtagggaagacaaaccagagtggctcaaaagattatgaccactattaagaaattttttttttttttgaaatggagtcttgctctgttgcctaggctggagtgcagtggcacgatgtccactgtaacctccgcctcccaggttcaagcgattctcttgcctcagcctcctgagtagctgggattacaggtgcctgccaccatgcccagctaatttttttttttgtatttttacaaaatacagaaaaagacagggtttcaccatgttggccaggctggtctcaaactcctgacctcaggtggtccatctgcctcggcctcccaacgtgctgggattacaggtgtgagccaccacacctagcccaagaaattctgaataatggatttgtagagggaatgaccattaattaaaataataacagtgctgatgatcaagccctacctgttacatggcatgtatttcctaacaagacagtaaggtgtgacaagtacactttctaatgtggccagccttatccacaccttctcaattatcagtgccttccgttttgcctggcttgggagccaggaaacttgcatcagcacagcacctgtctgcctgtgtgttcatgtcacagaccacagatgctcagttggctactgtcctaagactgctgtacctggtggggttagtaatgaataccctctgattagaagtcctggtgctctgtggttgaagcactaacacaatgttcattgttaacaggcttggaggttggtcttttggattaaaaatccccagtgaagctggaggtgcaaatggaaacatatcaaaacccccaactctggcaaaggtaatcatatttttttatttttttcctgttttagaaagtatttaggaaaactcaacattcaaatataattttgagcacagggttcagaaggaccagattaaatccaatcatttgttactaagcatcaaggaaaattatatgtaaacattgtcttgaaaaaaaatggcttgtttttctttagaaatcgaggaaataggtttttgctttttgttaagacaggacttcacctagtaaatataaagtggaggaaaaaatctattttcaaagatacccacagttgtcataattggaaatatcactagtttctttgctggccaaggagtacttccattcatgaatgtaaatgccttatcttccagaaggctggatagataggcctggagatgacacaaagaaagcagcagttacacagagctactcttaggagtcctggattttcaagccctgccaggactatacctgtgaattaggaatggtccccttagaattaaagagactaggtgggagattcttcagctttgagagaatgaggactgggatagaggaaagatgccttgatccatcagtaggaatagagaagtggtgaacccaacagtgagttgttatttaaggaaaaaagtcaacactaccttaaaatggggaaagcagaaagattcaaagcattcagtctccatgactggagaaatagtattgtgtttgattgagagagaaatcagaaaagggtagattgtgggaggaagttaagtccactgcgggagagtgagtgtgagttcttattaggatatcagtatagacatttcattctgtagtgtgtggatgttgtgtctactcatgagccaattgtggagctatgagaacaagaacaatctccatgagcccaggaaggcactctctctcttctgtagtggggacttgcatggttcatgtgaacctgaaggagcttattgggataaagacatgcacatgttggaggtttattcagtgaaataaaagttcttacaggtgcttcacaatgtcatccctgatgagacagtcatacttcacaatgtaatccctaaacaaaattttaacagtcatgtattacgatgtaatctgggaaaaatttccagtcatagtgtggacgattcaggaatctctccaacagctgaggtttgttcaaatctcttttccttctaaagacaacacacattcatgaagatttaaagcttgatatgaaaatatcattattaataacttgatagaaaaataaaatgtatttgctgacatatattggaatacattatgtggccattatgaaaatatacctaattagtagaaggaatctgttcatttcctctacaaatattccgactttttagtctatcccaatctaaacccttcttacgtattcataggagatggttgtgtctttgctttgaagtgtctgaggcacggacctcttgttcagtgatgagtggctggggatttgtgtgttctcctcacatctctaactttttgtctttgtttagatgagtcttctgtactgacatgtttgagtggtgattgctgaagtttttaatgttatttacgtgtccttcaccaggcacaagcatgcaggtgaattatacttgaccctttggggactgagctcctctccagcaagccaaggaactcaacattgttgtggggtgtaaagggcaatctattatttgaaataccagaactgctggcggctgatactgcttcaaatgattgcatttatctttctgtaatgaccggctttttctttcagcccttaggctacattcatcgacatagatgatatgatttcatagtccttctgaaggaaaacatgaaaaatttgcatatgaataggcttaatgtatggttcaatatcttgtagaatgtctcttgtgtgacctttatgagttctatcattcacatcttgagtgtttagcttgtttaatcaaaacactctttagaacttacacacttcagttaaagaagccaaacacattttcactttcgtttttttcatagttctgttctcccatggaattttatatatttgaatatccactgagagttttttttttcttatagctgcttagttactttttggaggggctgttattcctgagatgaaaggtctgttttgaggtgtcatagtatgttcctaaaagaagattaatttcctatttcattattggactttatcacttcgtgacttatggactggtagggaaggaaatcccacagcttatttccagaacacagcctagttttagaaaaccattcttgggagaaaaagaaaaagaaaaagaaagaaataaaagctttttctttgatctctgttaagtcctgaatggtaactttaagatcatcacaaagtatgcatttattacttaaagaatctataaaacctttctcaagtaaaggccagtttataaaggaaccgatcaggagttccagaacattttaaaatctgttccttggaactctgcaagtcaatcatttattgccaaaatgatgctatgtagcaaacaactgcaaaccgttagtagcatcaagagtaaacatgcatttcgctcatgagtctgtgggattgtgctgctgtgggctgtgcataacagatggtgccaggccccactatctgtggggaatttgggatgctctttatccaggccctggttctacatccttggaatgttccccagctcatcatctgcaatgacccttaactctactctgccaggtgcttccccttccattgccctccatagctatgtgtgaagatactttaaaatatgccttttgagtagctctcagcctgcttcctgcctgtggacagctgggttcttagagctatttacattttacatgtattccagcctggggtaccttcttgatatagcttcctataaagcaccctaggctttctagttttctaactgagatccacaagctactctcacgatcttgttgagatatgctgctctctctaaaattaattagtggcatttggggaatgccagaatactagaggacaacaccctttaggttcctaaaagccctgtgtctccctgagagagtctcttagcagcatcattctttgaagatctcaacaaagttcttacaattgcacccttgacttgatctttcttctgaggccatgtctttcaacattctctcaagagagctccgtacccaggtcaagatgtttattgggcaccatttccatctttgaagttaatacaggtgacattacccactgttttcacactgtaatatgcgtcacccttttttcaattatttatagcagtttgttttttattatttttccccagtattcctaaatactttatcatgtatttccaggcttctcaattgtctctttgtcccccaacttgctagtatcaaaagcaacgccaactattttcggtttttggtacagtaacaccccattccagtgtaaatcactatattggtactctattgccacaataatgctctataacaacaatttcaaagctcagtggcctccacaatggatgttcatttagctcacgggtctgtgaggttttgctaatgcagactgggctgggctgatcttggccaggaatgaacatgtgtgtggtattggcttcagctgggatgacagtggaggtctcagctccactgttgcatctgatgatagcagaggcataagggagacttcaggaacatacatgtgcctctcaattgtgccacattctattggccatagcaagtcacatggccaagcacagcatcagaatgggagggcatgaaagtcatatagcaaagcatgtggatacagggatggtgaagaactagggcccttaatacaatcatgaacagaagttttggcccggtgcagcggctcatgcctgtaatcccagcactttgggagtccaaagtgggcggatcacctgaggtcaggagttcgagaccagcctgaccaacatggagataccccatctctactaaaaatacaaaattagccgggcgtggtggcacatgcctgtaatgccagctactcaggaggctaaggcaagagaattgcttgaactcgggaggcagatgttgcagtgagctgagatcatgccattgcattccagcctgggcaacgagcaaaactgtgtctcaaaaaaaaaacaaaacaaaacaaaacaaaaaaaacaaacaaacacaaacagaagtctcagaatctacaaagggtgaaactagggaggctgagcaggcagcctcctgtctttccagctccattcagccaaagaagctctgtttttgtttctgtactgtagtgtggtgtcatttttaagttttttttttaatcactctacttttaaaacaaaaattaaaataataaaacaaatcaaaacaaaatttaaaaaaccttaattcagggcagggactatccttgtgtcttctattttttccctaaatttgaacagttaagggaatcaagacttgggggagaaggaggtcacagaccaggctagtgggaggttccactttccataggcagtgggcttttctaccagattagcctgtcccttaacttcaacagaatcctgagtttctatcatttccagaaatctggctagtgcctgtgtaggtgtctgtgtgtgagggggcagggtggcatgggggagaccccaaagggtgacagtacagagttgtgtgggtggatgacatggacacacctctgatatatgacataaactccttcagttcacttttgacttttccatcaaaggaacttggaatttaccctactttggagaattgtgtctatgttgctgtagtttttttgtttgtttgttttggtcacaaaatcccactctgtttagacatagctttgaacactcacagttctgtagttagtgggtctcaagctgcacttcttctccttggggtttaaaaaaatgattggcaaggatttctctgtgaacttaagaaaatattttaaaatgagtggtgtgaaagatgagatctgcattctgaattgcctgaagaggtaggctatttgagaaggaattggggaacattgtcttgtgtagtagggttttgttttttttttttctctttttggttttttaactatatgatcaatattttattacttagctgtttccacaaacacaatagctgccacacaagtctctggttaaaaaataattagttatagcatgaaggggtggaaagaaaagagattggaagccctcaagttggaagggatttgagatctggtccaaagtttgcataaactacgataacttgaataggttcccccaagccttaacttgctgtgaggcagcggtaattctaccaagcggattatctgtcacaaaaggcagcctcttctagagaaatgagctgttcagtcaattgaattaagaccaaaatgcatcagttggagtcatcatacttcttgaagacactcacttgcttttcaaattaataatatattttcatttttattaaaatattgatactttgaaatatagatactgatggtttgattagtgttttttatgatgcttctcattccagctttaataacattgtctttctcttattttcacctttctcttgacaggcatgctactttattctccatgctcagcaaatgttcagttcagtttattttgagaaataatgttccatgttcagttattaatttgaaagtaatcattttttttctgataatcttccacacatttaatttgcaggtcaaatttcagtagcttactaactgagaaagaaaaaaaaatgatagggtttggttcctttattcttataagaaaataattatagagcaacattcacatttgttctggggaaaattaatctatttttagctgtaaattatatgctggagataaatataaaattagcagactagaattgactgctcactgtcagccatgcaggaacattactttgaatcctgcactcaggtgccttggaagttaattgacacatacgttccttaaatcccagaatagttgacaaacagacttacgagctaatttcgtgagagccattaaattatctttctttttttaggtgtggtataatcagaagggttttcattccctaccttcctacttaaatcatctaaacaaccttattttgtggcagcacctaccccctactgtggactggagacaatacggtaatgttatttttcatgcattgtaattcactactttcaaaagacaatgtttttaaaagtgaaagaaacagaaaagtttctgaatagaaatgtgaggggcaatgagaaggtttctacttggcaaccaatccgtgtctaaacacaataccaagttgtaggctgtctttccctttgtgtgtcattaaatgtctttattttcttgaacctgtaacctcatctgtaggatgaggggaacaaaatgtgactggagagttctctcctaaaattattttattctgtgacttaatatcttacagaagcaagaaaaattttaccttttaaagacaatattatatggaatactgtaatagagaatacagactgtccctcctccttatcactgggaagatgaacatcacattttgatttatgctgagccctcaattcatcagttatttatgttgatcattgattcattatctatgctttcttattttggtaaatggcacaggtccatttctggtatccagagttaacttactggtttaagtgaatatttatttatttcacttaggtgggataaattataatttgttaatttaatttagcttcttttttaaagaaaggaaagaaacaagaagtataagcaacaggccatgtccaccacaatttattcacaaaatgtatttgttgaaacattaattcacatagacatcaacactaaacaatttttctaatatgctctcactttatttcaatcatactttatttttccatatttatttttccttctacaccagttttttaacaaagtaaatttaattattttgtggcattgtaattattttggaatgctaataggtaatgtaaaagttaaaaatgtacgtgactaagagaagtacaaaaatagtacaatagtcatacagagtagggacagcagaataacatttctaacatatttgaagtgtatcaagaacttcattagatatttaacatccatggtcttatctgatttttatgtcaattttgtaagatagacaatatttgcctactttactgattagaaaactgattttcagaaaacatcgcctatcagctgtggctctgagcaaggtaataatggggccatgactggattctaggtctagctgataacaaactcttgcttttctactacatcaaactgagatgtcattctggtgggcatgaatacagcatggttcacagaggggaagtcattaacactggatcttgaacaatgagcagaagtttgactgaggtcagaaagccattctaggtcttagcaatgcaataacaattatagtgtatgttcagcttatatggaacagtccagtttcacctcatcataaagctgaatgtagagggataattgttgatctctttggaaagattgtttaagatcaaatgctgcttggctttgactgacatgatgaagagtatggactttagtaagcaatggacaggctttaccaatatgtgagaataagaatgacataatctatgtaatatgttaggaagaatgatctggaagccactgattaaagggagaagactggttgtaatttaatgacctattggaaggatactgctcacaattttgaggttaaggccaggatgaatccagaggaaaaaaatgataaatttcagacagatgggagaaaagattgaggcactagggatgggaataaaaaagattttaagaaactaaaatataaacctgagcattttagagttcagtactgatgacattataagaaatggcagggagaagagatgttttcaaggaaggggcgaggtgatttgtgcaggattagagatgctagtttggttcacatacatagatgaaaatgtgcgtaggattcagaaaactggagagaaaagtttggtagagcagtcataggtaacctaagttctaacattaataacaaatgatagataaaggtgttggtaaagtgagatcctgcacgggtcagacacaggctcagaacagaagaaggctatgggtagaacagagggaagaggacaaaggttctgtagcccttgaggtaagaagatcttgcacagaggccagtggagggcagaatttcacatggatgggcaggaaaaatgaaatatttcagggtcatccagaagaagtagaatgcagacgttttgctggtgacttccagagggctagttcaatggtgtttcagaaatggaaaattaaagtagaaggaattaagcagagagaggttgttttaaaaacttgagactaaacagataaattctaatttgacttgttgatgcatcatcatgggaaaggaaggtttgtgcaataaattgggaatatacaatacatagcaccacaggaaggtgtgttggcagttattatcaaaatattgataaagaactcccacgagcagggttctgatgaaaatatttcatcacatcccttgatgcttgcttgttcctgtgggaaatggacagagctagaactattagcttaatacttagagtgaaacaaaccttgccccaatgtggaacttcagtaaatcccatgaaaacagaagctgtgtcttgctccctgttcgtctcagcagtcgcacagcaccaggctcaggggacattcaggctataacaagtgaatgaacggatcattatactacacggacaatatatcacacttctcatgacaatggtttttgatgaggtttcagcagatgtacacattctaatattagagatttctgaaccctgatgcaggccgcttgataagaagctattttcttagaacccaggctggccctttctctctaggagacagctagctgctcctgacctatcttctcagcctcatgtctcgcttatggcccctcactttcccctccgtgtagctggcctttgcatcactgccctgccatccctgtgagcctggtagctgcattgcctctgctgagactgcctgtcttctcctgcatcaccttaagcatttctgcttaactttctaggcccatctcagacatcacctctgttggaatactcaccacccctgcaggatgagttagtggcttctctttcttctcccacagttatttgcttatgaaattcatccatatatttatttctatcaagcattcatataatgacagatatttcccagacactgtgttaggtcattgctgtattttaaatgtgtctcccaaaagtctgtgtgttggaaacttggtccgcagtgtaacagtgttgggaggaggaacctttgagaggtgcttgggtcatgaggcctcctctgtcatgaatgaattaatgtcagtgtctcaggagtgggctacttattgctgttgccatgcccttggacttcccagactccaaacactgtaagaaataacttttttcctttataaattacccagtctcatagctgggcatggtggctcattcctgtaaccccagaactttgggaggctgaggcaggtgtatcacctgaactcaggagttcgagaccagcctggccaacatggtgaaaccctgtctgtactaaaaataaaaaaattagctgggcgtgttggtgggcacctgtaatcccagctacttgggaggctgaggcaggagaattgcttgaacccgggaggcagaggttgcagtgagctaatatcactgcactccagcctgagtgacagtctcaataaataaataaataaataacccagtctcaggtattctattatagcaacagaaaacagactaagacagtcattagagcagttgatacttcacattatcattatttgtttacattcctttgttaataaaagtgtaaacacttcatggaaggtgtttatactactgatgtttgtgttttctaaagtctttattcataggtattcaataaataggtcatttaagtgaatttgcttttgcactatattttagggttactatagtacattccattatgataattacattctaaaataaagataaatatgcagcaaaatatgtacttgcttctttcgttattaggaccttttaagttggcataattttgttaaattaaaatattaaataaagatataaaataatgaacctaagaggaaatttcttttaataagattaacagaataagtgaaaacagaagattaaatagaagtgcttaagtagataggaaggtatcttcctctgatagagtaaaaatgaaaagggataaagtattattttattttgtgttattgggggtggttgtgggtggtgatgatagcagttgtaaaggttaaacttcttcaactacttattgaaatttcatccaaaccttggcatgccagtaatgaaatgccaccatgtgggaggaattaacctcagcaatgtcatgaacaagccagatccatggtcattaaactgtctgtacattggaatcacttaagcatttaaaaaatattgatttatgttgcttatccaaagattctgatttggttgatttggagtaagtctttaacagcaggcatttttaatgtttttgggtgattctaatggtaaccaagtttgagaaccactgggttaaactgataaacttcccagctgattcatattctgaccactgaagcaggaaaacagacagaagtgtaagttaggagtcagtttagagatatccacactcaccttctcactgctaggaaggaacctgatggatacctggctactgggtgtcaggggaggactgttctgtattagaacaagaaagagctcttgactttcttttctccccatttgtatatctcttttggaatcccctggagggccacaactcattagtatgctgcaaaccccagggaggaaggagaagggtggtgcatgttgcatgctaggatgatgggacagagatgaaatgaacctgggagcagtggatgacatgcatggtagattttcctgctttgcttttgatgaaatgagaaacctgctaaaatctccaaatcacaatgagagagtatgagcatgagaacaggggaaaatctctgatctgtaatagagctactgaatgaacagcattggctgttggaattcggctggcatccataaccttcaacatgcccttgagagctttgggtatatttgagatatttgagagagaagatctggtggtacccgagtgaaggtaaaggggcaccctggtaagggaggattctgagcaatgcaaagcaccagtactagcttgcccttgctggaatcagggagtaagaaacaaaaggacagcaaagccagttatcaaacccagtatggaacaaggactgatcccccaaccacagagaggaggacattgcataccttgagagggtgttttcatggggagcatctcatgatgtgtttatatctgcataaatagaggaaaatgtgtgaaccctatgaaagagaggataaaagataagaagaaaatgccaggctgagctgcagtgtgttacaaaaacggagctagctaagatgaagatagaaatatgaattttcattggatgcagtgaataacattattgattgattacaaacctctctccttcacttagaattattgacttaaagaacaaacatgcagtattctctaagaacacacagggaaaaggtgacacagtaaaactgatcagaggggaaaagctagaggaatcgggtatagaaaaaaagcagatgaataagaaagtaagaaggaatgatgtaagaagaaaatgaatcgaacacaaaacaaaacaacaaaataattctgtaccaatagattggaagagtttgtcatgattctatcaaaatttatgaattaggtattatggcagtagcaatgattgatgcacaaatttgatgaattttctaaagttcaaggataaagaaaaaagtttttacaaagctatgagtcaaagcacattagtttcaaaggaataaaaataagactggcctctgacattttttataatttctcttgagacttcatctttgacccagggattatttcaaaacatgttgtttaaattctaagtttttgagattttcctgtggtctttctgttactgatttctggtttggttcatcacggtcagtgaccatactctgcattatttcaattattttaaattggttgaagttcattttatggtcaggatattgtttatcttgaagcttccatgggtgattaaaaaaaagtattctactcttgttgttagaaatgtacattatatgtcaattagatcctgttggttgattgtgtggttttgttcttccatatcttcactgatcattgaagattactgaaccttcactgaagatcatcactgacacatttcgtttgctgagaggcgagtagtaaagtctccaaattgtggctttgtttcttttttcagtttcatcagttttttcttcatgtattttgaagctctgaggtacacgtcaaatgtgtgtacacatttggcatggtcacatatttctggtggattgagccttttatcatttgggatgattatattttcctggtagattaatcctttgcatatatgtagtgttcctctttgtcactagtaaatgtagttgctgtgaaatctattttatctgatctcaacatagtcactccttctctttttcttttgattaatgtttacataatatatctttcccgttattttatttccaacctatctcattgtgtaaagtgagttttgtgtagagtgtatattgttaggtcatattttttaagctgcactgcctatctctgccttttaattggtgtttgggaaccattgcatttaaggtaattactaatatatttgggtgtaagtctgacattatcatttgttttatgtttcctctgtttctcttttcttgctttccatgagttacttgagcattttttttgattctattatgatttatttatagtatttttaagtatatacattcatttagttttcttagtggttcttctaggtgttataatacatatatatgacttatcacagtctactgatattgttatttactaccttgggtgaagtgtagaaagcttacttcaatttacttttaccctgtttacctttaaaatattattgtcttaagtgtttcctatacacaccacatcagatggtgttctaattcttagttaagtcaccaaatatgacttaggaaactcatgagatgaacaatagtctattatatttacttctatttttaacgtatcttgatgttcatctttccttttgtaagttctaagccttttcctgttatgatttcctttgtgcttatgtaacttctttttgctattctttaagagtaggtttgctaatgaaaaatttgcttatttttttcaactgatacgatctttatttcaccttgattcttgaaagatattttcactgaatatagaattcatggttgacaattaaagaaaagctcagcacttgaaaaatgtgctacttccttttggcttccatggtttcaaattagaaatccattactattctagttggtattttcttccttctctctttgtgacggctttaaagaattttttttgttgacttattagtttctagaaatttaattatgatgtatcttggtgtggctttctttggttttatcctatttgggatttatttagctcttggatttttaggtttatggtttttttttgccaaacttgggaagttttcagctgttatgtctttgaacactttttcagccccactctctctttcccttttctctaagatcaggtaataagattattagctcttgtattgttttcccagaggtctctttcctgagtctcattttttaaaaagtttatttctctatgttatttagattggataagttttatttttttcatctcgagtccatgcagtctcttcttttttagctgcactcaactgtggagcatgtccagtgggttttaatttctgtcattgtatattttagttctagaattttcattcattttttaatcatttatattttctaatgagattttaatttgtttttcatatttaaggaaaattcaaaattactttttgaagcatctttatgatacatattgtcagataatttcaacattcagttcattttgacattaccattttttattgcctttttcaactggtaatattctggctcttgttgtgaaggattattttcagttgtatcctaggcattttggaaactgtaatatgtgactctggattccttttcctagcaggcaagccctctgttgaggaatcatatgagagccacctagatgtatatgttttgattccctgtgggcctgatgacaccaccctggctaggcaaaggtagagaactgacttacactgcttttgtgcagatgagtgggaccagatcgcccaccagcctcactgacacattcatggcaaatgaggcactgactcatgctgtctcattgtctctaagtgagtgggggagtagagtctgctccccattgggccctgatgacgctggggacaggtagtgaagtaccagctggctcactttgaaagtattctttagtctcatcgaagccagatgggaatggatgcttggcatccctctgtgccctgctgccactggggtgggggcagtggtggaaccagggtactgagtagccgtattctgcacttctgggttcagtctcattgctgtcaggtagatatggaggctcagctctttgttggtccctcatgacatgagaagtagagtggcggctagccctgtctcactctgctttgtgaagtctcattgctaccaggtggggatggagtctcaacttgcctcaggaccccagtgagaaaaccactgtgccccttgtctctgtcaggtggggagtggaagattcactacccaatgggccctgctgaaacctgagatggtggggacagttttgctggtggtgtttgcctagagtaaggcagatattgctaaaaagtagttcttttgttagaccactcttttccgggtccttgggttttttatttttgggagcctttcttatttgtacttgttgagtttcaatttggagactttggcaatgccttgttcaggatatatgtgaggtgataaggaagccagaatatttactgttgtattgttgaagtcttatagtctcagggcaccatcatcttgtttgcaccccagaatcttcctatttctgtttgttgtgttatgtccagcagttttttattgtaaaaatgaggacttggcagaactggggctgctccatctaggaggactatctctgacatattagccacaacctcaaaggcaaagaataatagaatagcacctatggaatatggaaagaaaaggctatactccccacattctgtacctagtgaagatgtttccataaagtacacaggccacagagatatgctcatatagaatgtggctcaaaaatatactgtagacatattgtccattagaaagaatgccaggaggtagttatttgagatattaactgaaaggaagatcatgaaaatattgaatgcacacaatgaagaaaagaacttgggtgagcaccggttgtagtgaaggacatagattatgcaaatgtttgcatgcatgtggtgaaaaattaatggaagatcaagaattacccattaaactgaagatatgtaatataaaacttaataataatgcatacatgtagagaaaattctcaacagaattaagatccaaatgcaaacagtgattacttctgattggttttggataggattataagttattttaattttattctttaccctatttaaaaatgtaaaacccttctacaattggcatctattactcatagagtaataattaatattgagaaaaatacattttttcaggatagattgatgaggaagagagagagaaagtcatcaaaacgccttgtagtcagaagaacgcatatatttcttttaatagtttgttagattgaattaactttttactcttacatatttcactgatatctcataatgaattaattaaaacaacgtaaactttccacatatattgatgataagacaagtttttccttttggtagatgcttacagacatctgggcattaatacttctaaagatatacattttataggagtaatgaacccgaaagtgagtacttgaattggagacatcttaagtatcttgctatcataatggatattggacaaaagcacagatgtgcatttttaccaatgacaaataaacagagtctggaaaccataacagatgtagccataatgagaacactaaatgagaaaactaattttgtacattcatacattgctgtgggccaattcctggaaagaaaagccggaatataaatgataataacaatcaaacaaagaaaaattattcaaatgtactcaacatgtacattttgaaacgtcatttctgaaaacttgtgaagtaatgtcgtaaagacttcagtgagattcttctactcaattctggtgttgaaactatgccccttttacttaggagccttggaccttttaccaacatcattgtctcaagattctatcacaatacaattgttacctacctagagtactgagtgctcaacatacaatgaaatctacaacccaattacagagattgtccattgcaataatgtgttttttacagcaagggtatcaaagactacaaatgattttcctagtctcataggaaattgatcagactggtatccagaaaatcagggttgtagttctcactctggtaccaattatgcttgacctcagataagttagtagagtaagcttatgcctcagtttccttacctgcacccactcaccaaccttggctacacttcctctacagtaggctccatcacgtctcgtaggattcctctttatgagacagggcatagctatcctctctttctttggatccatgaagagagttctgctttctaacgttttacaattttaaagaacaaggggtatcatgggaaggtgcagggtagtgtgagggtgagcccatgccgttgcaattgctcctacctgctgctttttgctcagggatctaggacaaccaaggaccttaggtaggagagtaagcttccacctgtgtcttgtttgttctttctttattcattactcttatttttgagaaaatatccattatttatttaagtaactccaagtccatcttcctttttgaaaaataagagtaaaatctttttagcaccaatttaaagatatatttgcttgatttttaatgtatgtttaattctatgcagctgctttcaacgaatgactatgattctaaaaacatctaatgtagtgattgataagctaaattgcaagataaaaatgaaaagttcacccagtgttcctaaaccaaaacattgcatgggtttcaccctgcacctctctgccacccctccagtcttcccactgaagctccagggcagccctgtaggactgtactttccttgcactccagccctgtgctggggtatcctgtgcatctggaatctacctttccttagaaagctccccgacttcctcccaccctgctgcacccaacctcttaggtgaccttacacaggacatagtcctgtgagtgggctatagtaccctcaccatggtgtgtccctcccatcagactgctgcggcataatgggcagagaaaagatgcgtgttgaatgaattctccgttctgtgaaggaagaggaatcaaatctctatttgacccttggtgaaactcaattactgtccagtgccccggttttcaccaccaaaatcataacaaagtcagaacattctttaacccttggcctgacaggggcaggctgttgtcttataaaagctggtggtcaatgtccagtggagggaggtggggagtgaactcaagactgacagcaggtccagggttttctctacttacttgatgacattattttcctaaacactgtggtctaagccctctcattctctgtgtattagctttgaaagataattttttaatttcagagtaaaaacatgggaatgttaagccccaaaatgcttaggaattgtccaagagctctgagcactaagcagaaaggccccattccaaggccatgaggattccctagagcgccccatgagaggaactgtagatcagtgtgttctttaatagagtctttaaatatttactctatgacaatcatgtaaattataggactctaaagcctgtgccaaatgaaaatctgtggcccctctgaattatttatgagtaagggacctaggaagagagaggcagccactgtagtttgtgggggttcaggtatttgcaccagtggttttttacttctaagacctaagtagagacagagctcatggaagattacagctatgtgcaaaaaatcggaaaaggcaggatggctgccatcagtgggctgtctcctgaagttcattacgtgaaatttatcagctgctctcttctgctgtcatagttgaggttttcatttctatgttatgctgtcattgggatccattgcggctcattgtagaggcaggattttcagtgctctgtatgttagtaggtgatttgatgagagagacacatacctgtgactccagacatgtgggttctgcctgtgtcaggagcaggttctaaactccaggaaaagtcacaacattcctctgattctgtttctgcttctggaacacaagggcctgtccaagctagaccacttcatgggatttcattttcctaaaagaatctataattctaaaatgctgaaagctgacttacaaagaactgtgcatagcatactagcttccttaacacaatttcaccatcagattactgaatgagaaaatgtattatgaaaacttccaggagagggtctggcacgttggggaattactaactacaggagcagtcaatcatttcaccagcgagatgggagaccagatgtactctcgcctcctagatgaaaaccctaaaagaatgacacaaatccaggaaatgtgctaaaatgaagggcaataaattcataacagaagaactaggatacagaaagcaaatatgagaacactgtttttaatctttcagcagtgactgtcatggtttaaggtaagaaaaggtatttatgcgacttgatcaaataaagatccaaccttggtagtttaatattttattattgagctccccacagaaacagcagtgttcttttggcagcttttcactgaagaatgaatagaacagaggccttcaacttccagccctgtatccttcccactgtatggctatagtcttaggaaaaccagacacgtgtgctgaagaagggtgtatgatatgctggcagggaaatagttgtggtgtctgcagactaaggcctgaatctcagctgtgtcatagctgtcagtctataggaacatttcctaaatatctgtgcttcagatactgcttctgtaaacaggcataataattctgatgtgacatagttgctctatcagaatttatacaaatagtctaatgtcctaaatagcatacagcacatggctacaggctaatttttgtgtatttctggctaccaactctttctctctgctcacaagtttgaaaggacttagagtttgagattttcctctcctcctttttgcccatcttcatactcctgaaaatttaattaatcctttttttgtgaggataactaagatctaatttctcagcaaatgtttagtatgcaaaacattattaactgtagttgccatgctatacattaggtctccagaacttatttacatatttacttatgtatgtatttatttattgagagagatgaggtctcactctgttgcccaggctggaatgcagtggcgcaatcatggttcactgcagcctcagactcctgggctcaagcagtcctcccacctcagcctttcaagtagctgccactacagttgcatgccaccatgccctgataattaaaacaatttgtttggtagaaatggggtctctccatgttgtccaggctggcctcaaactcttgggcttaagcaatcttccttccttggcctcccaaagggctgagattacaggtgtgagctaccatgcccaggctttatttatcttatgtctggaattttgtatcctttgactaacatctccccattgcctctttcccctggcctgaggtgacagccttctactctctctttctgtgaatttgacttttaaaagttccacacataaatgagattttgcagtgtttgtctttctttgcctgacttatttctcttaacataatgtctttcatgttcattcatgttgtctccaagacaggatttccttctcttttgaagctgagtaatgttccattatgtgcatgaatatctatcttatattttctgtatccactcatttatcaacagacacaggttattttcatatcttggctattgtgaataatgctgcaatgcacatgggcctgcagatatctcttcaagataatattttattttactttattttttgacatacatctagaaatgggtttgctggagcatatggtagatctatttttaattttctgaggcacccctatagtgttttccataagggctgtactaatttacattcccaccagcaggataaaaattgtgataatcattttgtaatgtatacatatatcaaaacattacatagtacaccttaaatgtttgcaattattatttgtcagttatacctgaataaagctggaaacaaaacaaacaaaatgaaagcaataataattgaaaaccaaggaaattaaattcagcgttggacagacatgaggcaggagtggggtgtcagcagggttggacaggaagcataagcaaatgacaacatatgcctgcagccatagagtttggggaaatgatagcaatccagcttttcaaatgggagcagtgggagaatacaaagattgggtttcactttaaaggagatctgtgtctaggtaaagaatatgggctctatatttttctatttctttctggaagttctctaggctttctgggtgagggattcatgagtgtgcggagaggtgagctgagcagggatgcacatgtttgtgagtgaggcctggcactgcgaggatggagttcacgtgaaagtaacaggactcggtaacttcttggatgtgtggggtgaagaagagcagggagatggggagggcttagtgttttttgagcctgggtgactgggaagatgatggggatatttgccccagggtgtgtgtgtgtatatttaggttaaacaatttcagtattctactgtgttcctcaaataatataattccaagacatgtactcagctaaccacatttctctggatcctcttaatccagagtgttctcattcttacgtagagtctagaagagcacacaacattgcaaatatactccacagcaccagtggtccacgggccatactttggcaggatctgatactttataaacactgtctaatgtcgcttggctttttctgacctcctgataaggttggttgacattgggctgcacatcaagtgagaagctccctgtgagtcaacactttagctaggaaggacaggactggcaggccccatgaggtgtaggctagaaataaagcttggtgaaagaaagacacataggagaaagactggtgggtgttattggtccagacaggtgagggatcaagaccacacaattcagttcatgatgaatgtggtaagtccaggatccaggaagcgatgcagcaggtgtcaggcacacacactgcgagcctggaccagaatatctggacagtattaatttataatcaaaatttattctggaaaactgtacagtggatttgctgaaccaacagctcctactgttgttgcttttatgagccggaacttgccttagtacgtggctgagttcccaatagaaggaaaaaaaaggctggcatagctggggagaagagcaggtggcaaagggacagaagtccagatgcctggtcgcaaagctgttggaagtttggagcactgtagcctgttccaactctgtaccttttttgtaggcttacttataccccatgatgtttcagtaaggatttaatgtgctctcataaagcagtgccgataagataataccgataagatgaattaaaatacaggtgatagtataaattaaaatacagatgatagggtaaattaaaggcgagccaaaagaaaaataagcaaaatctaggactggcaacatgaaatggagcaaggatttgtgcctttggtaatggcctccacatacaagccacacatttgactccaatcactgacacaaccaattaggcaaaggaaatctgattactctcacagtccacaatgtccaagataaaacacgaaccaactttatttatggagttcttcttaacacaatattgactagaatttctggggaagcactgtcccactctgtgatattataaacagctcttataataaaatgcttttaattgataagctgatggcagtttcttcattttggccgctggcatcacacacatgcgcaagcccaagaaagcaaacaaagcaaaacaaaacaaacaactccaaaaccaaaattggttcagtgaaacagtcgttatctatctatctagatgtggcttgatctagaggtgaatattgatctgattcatatcagatagtcttctttgcatattgttacttagcctgagtatgtttcctctctgcaaacataggctatgggatacttatgaggattacacaataaaacatgagaacctatgaacatagggcctgtcatgtaaagcatgaacaattcatgctggttatgtttgacaacaacagcaatgacagaaatcccagcacatatttgctgaatttcacaatggaatttgccatttttttctgctaattgaccagggcctgggcaaagcaagcaggatacattgtgatggcacagggaatctgcgtagcctgtagatgagctgcgattcaccatgcaggagcaggctgaaggctcacttttcaatttgtctttcacaggaataacactctacagccacccatatggaggggccttgctgaacaaggacaagatgtgagttgatggaatgctgaggggtgtgtgaccctgactatggaagaaaatctttgtgttacttagggatgactttggtctctcttttgcatttgccccaagagatggcttatagagttagcaggaaatgcccacaggacttgggcatttctttgcaaagtgtgagaaaaacgactattaagagagtcagtacattgactgagcttaaaacagatgagtttgtcatgcaactgtacttctaagcagaaattcttctaagggaatgatttaccagaaacttatgggactgtacatcttctgaagagttttcggggttaaaatcataaacattgcattcatgtacataaacatagtaacgcctccttgaatatttctcatgcaagattttcctcctgatccagatggagacatgggtggggataaggccagagctcttcaggtacagaattctgtgtcagttctcactgtctttgtaaagggtagcatgcttccacctgtcttctctttttctcccccatctcccttctctattatatggtcgacaaacttttaattaaaagtcgataataaaagtgggtatttttgaaaaactttttatgacctaccaaattaagtcgcagaatgcaaatctgcttaatgggcattctctgctcaagttgttaatctggcaggaaccggcaggaagcaccggttgggttgcagcttgtcctcacgttcacttaatgattttcagggttctagctttaacagtgtctgacacctgccagaattccaagagtaggctagctgacatctgttgtagaatgcgacacgatggagcagaaggcatggcacagcagatgacttgtgctgaggagttccatcgtgtcggcctcctgaaagaccatctgtggtctgactgttcctaaaggagttgagaggaggcagcaattgacttgagtaaaagtagtagtgttccaggtaaaacaattactaagaaaatgtacagtgtataatattacagagcacctcaatctattgcaaaatcttgttggtatttcatgtgactaaattcagagatgggccagtgcagtgtggagctgtagtgaaggctcctctctggcaggtgctactgtattgcaaagcagtccctgtgtgggcaaaggtcacagcttacccggatgctgctcagaggatatctttcatcttaattgggagtcaggctcaatggtgaagagcagattttgacacaagaagactccgaaatgccctcaaactgtgctcctcagttttgtcttctgtaaactgagcttagtcatccatgtctcaaaaggtggctgaggggatttaatgagggaatccatgcccttagccaacatgcctggctgattatgaatttttaattagcagttttcactgctgtcatcattgctgattgttattagcaaagaaggcttgtgttcttcgtcaggtgcctgagagctgctctgttccacccgcagcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatggtaggatttgggaatgagattctgtgtgcctccacaatagtgatctaaatagtgcgtgtatggagggatggaggggggcattggggccctggctgccttggagtgtccacaaaaaggggtcatcttattgataagagcatttcagattaagtcacctttactgatcaccatagaattggttcataaggggaagactgataagcttcaggctggagaactgggaaattatagaactttacaaagatgcaaagtttcttattgagaagatgagaaaattattacctttactatgctcttttcaatggggtagcagatgaggtgataaaaatcattagaaatgatctttcatctgcatgcttaacaccccctcctgtgagacctgtgcctcattgcctaataggtatggcgggtattattagcatttttggaatgcactcagtttcccaatggaaaccctccagatcagtgtctgccatcctgggggacaataacagatgctttgtctaggtgttccctattcttcaggacatttatcttaagtaaaaaaaagcatcttatatgataagttgttcttagtggtcaatatctactgtcattgttctctggtggagctgtctttattttgtaggaaagtgatatccttgccctcatacatatgattcatcttgtgatacagaaaatcatacataagtcagtggaaggccggaggtcaaccatttactgagcaccttccatgcactaggtgctgtctgagctgtgctacaccaggcacaaatttccgcatattaacatgttgctttcctgtaaggtttatttctttgagctggcttagaatttagctaatttattttcttttgatcatgtaacttggatttttgttttgttttgaaagtacaatttatcggggtcacacctaagttacctaacatttcaggagttcatttaatttaatcagaggtttccctgaacctgcctggtgatagatatcacctgggacatttggtaacaataaggattcccaagggcctatccttcgagattctattcagtaggactggggggacttggaggtctgtgttttactaggtactcaaggtgatttatgaatcttaaccaagattgacaaattctgggtctttaaacccttatctttactgagggacacttgaaggcaggcaagtggaagtgacttgtccaagattttacatctagttggtacagagatggcttctcagtgccagcctctgtctcctggtccagttttgttccctgtgctacacactgctgctggctacttgtctctctgccgtctgtcatttaacagtgtctaagggccacaactttcccagataaaagggaagaagtgtgtggcaagagagaatcacaacacacagggggccacgtttctaggacaccatggggctttcaaagtctccaaaaccccaggatcttccttcttttcagcacccttagtttattatctctttatgcctcccactcagtctgactcttctttactctgtgatgtttgatcttggtgattaaggacaggaagggtttcttgcttcttgcttggatggttttccatcttcatccaatcattctctgcttattctattcaatcactaatttaataaatatttttgaggatctgttgtgggtcaaggtgggtccaaggttgctatagactaaatgattatgtccccccaaaattcatgttgacacctaatccccagtgtgatggtatttggatgtgggatcttggagagataattaggttctgagaatggagccctcctgaatgggattaatggccttgtaaaagaggccgcagagagctctatgtgaggacacagtgagaagtcacagcctgaacgaggaagctggccctcgccagtcaccgaatctgccagcaccttgattctggtctttccagcctccagaactgtgagcaataaagttgtgtggtttataagatacttggtctgtgttattctgtcatagccccccaaatggtgttgggcataaagccatgcataaagcagagaagattgctccctcaaagagattcttatgagaggaagcagaaaaactagtaaacaaacaaataaataaatgcgcaggatacagttggccatgactgggtctgttgaaagaatgaaagagattgatgggatggaggatgacttcaaatgtgaaggtcaaagaagacagtgaaactttacctgagatctgtgaggtaagaaggggccctgcccatggatgacgtgcaggaagaggtctgcagcttgaggctctaagagaagaaggaaccaggcgtgtgagagcctgaaggaaagccatggctattgttggcctgcagggagcaccttaaggtgaggctggatagggaggtagtgtgaggagcctgtccttggttctacgtgtgtgggaggaggctgtgtttcatgaaagctgattggattccttgaccctcctcaaaggagatggatatgcatgacagtagtagtcacctcaggccaccataacaaaataccacaggctgggtagcttcaccccggaaacttgattctctcattgtcctggaggctggaagtctgagatcaaggtgttggcagggttgattccttctgaggcttctctccttggcttgtggacagccatcctctccctgtgtcctcacatgtcagccctctgagagtgactgcatcctgatctcctctagagacaccagtcatgttggatgagggctcacccaattgacttcattttaccttaatcacttgttcaaagtcctgtcttcaaatacagtcacatcttgaaatactgggggttcaatgtataaattgtgggggggtacaactcagattaaaacaagcgactttccaggactaattccacggctacagaactcctaatgtgcaaaataggaaatatatttgtgaagttgaaaggaaacttcaggataagtagatgataataaatatgaccatctgatgtaacagctctcccttatttctttttatcttctcagctcttttacttggtttccgtctgcctgtgtgttgccgttattgtcgccttccagttaacagcttttactttccgcaagaacttggcagccacggccctcctgctgtcacttttcgggtatgtgatgagaaacgctgctgcagaattacggtttgttttctgaaagagaaaaccctcaggatggctttgaacctgctgtcgacttcatgatttcctctcttttgaagcaattatgttgcttctgcaagggacacggagcaaacaagcctgagcaggatgatgaatgccccgtggaggaaggaagggctgacctggtcgtgatgaagacagcactgccctgtctcagacaggcccttgagctgtttgacaaacttgtgcagctggaaatggattctctattattctcactttgacattaatcaggggctcaaatacataatccaattaactcggagattgcatttgtggaggttctctcagcaagctctctggcattttttctcctctcctctaatattagtagtttgaaaatgttttgtctaatttctatcacttttttttcagatgaaaaaatagcaaatggagaaaagtcattttatgaatttctgatttatgcatgctagtcaggatcattgctagtggcctcaaaattatatctatccggtatcaggatatatatgtcttcttatttgtcatgcacgtatgcttatatacaggctaactacataagagatgcttagtagggaaaatcattatcatactaatttattatacttcaaggctattttaaaagataaaacagcttgctcttatttaagaggattacaaatgaagtgatttttacagtttgtatttatataagtgccctagaattattcaaaacatctaattagagacagagttttacttaaacaaatatataccattactagatgattgtataggtgggtgggtggatggatggaagtatgtagataagagaaagaaagatagacagggagagagagattaacagagagagggaaagagacactaagagagagagggagagagagattaagagagagagagaaacaagacagacagacaaacttttgggggaacattgatattactactcactaaccccaatgctgtagctttggtaatactaattattctgtctaatcctcagttttttctttgtaaaacttcatgtcttttgctataaagattaaatagtttatatgaatatcatggacaatgactggtacaaaattcccattaaattaattttagccattattgttactctttagaattattttactctttagaagatgtaatatcctgagctataaaacatgcttatagtagacatatatttattatatttagctagaaatttatggacttgtgtataaagatctatgtgtgtgtacccagctctaagaacacagtttgatttcagtttattgatccaattgaatggatagtgttgtcatgtctccctctatttcaagtaaaatagactttgctataaaattatttttgaattttaggagagtatatctcaaaaactgagttaaaacttagatgaaatggttagaaagccttgaaaacacgcttttagaaatttttattagttgttttgattgtgaaaccctttaagaatttgaattaaactaagaattctcttcatacataactaccacatttttcaaagaatttctggagattcacaggtctgttgaagcacaatcataggcaataggggttacacgcttctggttaagaactcttaggttgcagagactggaaagatgtcagagataactcagaccgtgtttgtaatcatggctaatcccagggaagaagagcccccaaggaaagtttatcagggtcactgggtgacatccatgggaatgcagatttagaaggtagctctttcttcattggagcacagccagtggaactggtgacaacctcccccgccactgtaacaggaggggcagtgagagacccggtctggggaactgctgtctcctgtgtgcctggcaatctctgggtgaggatagcagaattggctcatgcctgctgtccttctaaggacctatgggtacacggagcccaagggcaaactcaggaaagctgaatcccgagctgaaacctaagagcacgtccaggcattaaatggctgcttaaaggcaggaatctgaaggaataagggatagtatacacgaattgattcttttaagagataacaagataaacatgcctaatcgcagtcttattgtttttcttctttctatcaaggacaatttgttatttaaactataaaagggagagtcagggagaattagcatccaaaagagggaagtaacacctaaaatgaatgaaagaaaacagagcctaacttacataaagatggaaaccttaagaacatatttgatgtatatttaccgctaaaagatgagattgcagaatcctgcttggtgtcttgggaaatccacaaagcatggggaagcggccgattttcaaaaggggaattttcttccgccataaattccatgatgttgtgaacagtaggccagtctctagcaaattttaaaatcattaaaatgatattatattttaataaaagcctggagattgttgaaattcattgtaattttcacaaaaaaataaatataagccaatttcatttttttcttataaaataggagacgggagctgctaatacgttaatttgagccaagtattttaaagataactaatgaaaatgtagtaaaaaaagtgatggaatcatagcccgttgaaaaccacactggaatactcttcattcatctagcaataggaactctcatgtggcttcatttaggacaatgtctctgattctttgtttttcttaaataatgctttgatccacttgtcaaatatttaaatgacataacccaacatggaaaccttatgtaataagtaactagatacagatcctgaaccatctcaaaggaagtagagcctaatgttgaggtggtaattagtcactcaagtgcagatcaggtatgcagactccacagcaagaccgggaggctgctgtacccttagattgtattgctggatgtggagatgctgatcaaagcagatgataatcttgctgtgtgttgtgccaggccaaccacatcatgttctctgtgaggtagctttacctaaactcccctaagtcccacaatgcaaaatttaacagagagagctggttgaatatcgtgttgttaaaggagcagagaaagacccagtcttttgtagtggaggtttaagcagaataacatggctatcctcagctatttaaaggactgtcacatggaaaagaaaagcaatttgtcacgtgctgttccagaatatagagtttgaatcagtagctataagttggagagagttttcattcactcttagaatgaattttatagcaattacagctgccccaaaatttggctcacaaacttctactactgcttatatttctgttgcaaaaatacttgcaattctgtgatttcatttgattctcaaaacagttgcgtgaaggagtgtagcacttgatttttgtctcagaaggcacagtaaaggaaagagggtaggtgtgtggtgtgggtgaatatgtgttggggtttgaattctctctgtggtagtttatttcagacagagatgttgataatgtacagccctaagaagtcatgacttatctctctggtaattattttgatttaattagttgattgtcttatgtagcaactgttttagaacagctcttgcctccattgtgtgctttgaaataattaatgcccacattttgaggcagattgctattgagtagagtgtctaaaacactatatgattttatatatcatattatatatatcttatgaactatgagaatgtatcttttaacccaggaaagcattccaacatcatggatgtcatatgaaagggggtgcatactagactaagagttaacttgagggcctggcatctcttatatcattttgaagtctcatacttttcagaacttgttaacatattaggaaaacctcagacattttgcaggcactgaagtgtttcaggttaatccaattattcaccataagaaaacagtgatacatttaccttgagtgagcagagaacttgttggagctccggatatatgagaatcttttgggaaagttgtgattcaaaatcagtgacttctctgctgatattaggaaccatcgttcaaagtgtacttcctttattgggtgcagtggtattatttcaggaaggagatgagggaagttgccatgagtgaaacctggctctagaattgaggagacggaatgaagaaaatgagatgttttccttttagggacatttgggtggtatcttagatcctgatgtcatctgacacatgtggggactgcttctagggttcaatgtttagcaatgcttcttactccccagctttggggccacatggaaatgaatcccatgttcatctacttatcacctgcaaagctcgatcaagtgtctgaactctgcaaatccccattgttctgcctgtaagatgacagttacagtgctgtctcctggcttgctggggactaaaggaagattagggcacactgaggagttacagatggtaccccctgtgcagtggatgctggaaggaggctttcagtttttatttttaggccttattttttttacgtagctctgcagctttttatattcttgatatcttttgattctcaatataatgaataagtattattcctgccttcctgatgagaagcagagcagagaagctccttttggagaagagaggttggagaagtcagccgactttctccaggccacagagccgacaagttcaggcccacgtacaacccgtgtgtgtgttgtgaccccatccggtgttctttattgcattgcagagtcctctgaagccccaggaagagtgtgttgtctttgaaaaataccgtggaatgtattatgtaaagttcatttctgttcaccaagtgaggaaaaattgctgggccaataaaattgcatctataattcagtcttacggctgtccccttatctgcatttttgctttcagagaattcggttacccacagtcaactgtggtctcaagatattaaatggaaaattccagaaataaacaattcatcagttttaaagggcacagtgttctgagtagcaggatgaaatcttgtactgtcttgctctatcccatcagagacgtgaatttcccctttgtcctgcatatcctcactttggacctgggagtcagtgagttaccaaattgactgtcgcagcatggcagtgcttgtgttcaagggacctttgttttactagatggccccaaagtgctagagtaggcacgctggcatattgctgtaattgttctattttatactactcattgttcttaatctctcactgtgcctaatttataaatcaaaccttatcataggttgtatgtatggggaaaaacatagtatatgtaggattcagtaatatctgcattttcagggattcaccccaaggtcttagaatgtatctgccatagataaaactactgtaaatgttacagtaaaacaaacattacttttcactttacttttcagatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaaggtcagtagctttgtagcatcacctctacacttctgcacctctagtgcaaagacggtgttaactcatgcctcttttgttgcttttctgactggaattcaatggaaatgcattggtatccactgtctttaaactccagagagataaatggattctaattaacaaaaaacacattgccgttataaaagccatgcctaggcttagcaacaattgacgaaaaaatgttctgtttcggccactccattcttgagggtagagccatgaagatgttcactgccgcatccctagcattttcatcagagactatttattgatgaattactgatgaatggtggaagagtgagtcattgaaacatgccctctcaatgttcaccatcgtttgggtcagacactacaagatagaatgggccacacaacacagctgaccatgctctcggggcacagcatgtctgaatgatgatctggcgggattctaccctcttctctgggatttctggaacaaatttaattttgctgttttccaagcatggcagccaagggctttcctgagcctgaggcccgtggtcaggaagaacttctccttgtgaggtcaacgccactctccaataggccgttctgattagcaagtcatttcttaaatgtcatctccagctggtgtctaggtcaaggtgaacccattagtcctgccacattcctttcactcctgtctcctcccttagtgaggcctgcctgggtgtttgcctctgctttaatacatctttcagcccctcagcatccccagtgctacctggagatacagacttcagattttgcactttcctctgcacccttattgcaatccttttcattctgttttcttttctcagctctgaccacactattctctcctgattccctgctgcttatatggagtctgattcctcagtagttcccaaatgtttggccagctcaggggctgagaaatgacctggaaaaggtactgagctcctagttttgaagcatgtgctgcagttctcatttcaaatcaaacagggactgatgcctatttaattgggatgagtctacttcctcatggctggactttcagagacttagtaaatttgccactgatagctaacattagtttttattactgtgcttcatatttggatagaagcagtgaactctgtaaacatctattatgcattcagtgatggtaataatctattttggtgatttttacagatttattattgacactgatttatattaatatgtctacactttaaagagaaaacttgcagaaccattgattggctttagcttgaggagaaaattgaaatcagtagagatagtgtacaatttccctcctccctcatcggatctctagcatgacatgaaccatcaggatgtcagtcatgaatcatggtgaaactgaaaagagactcacagtagataatcctattggtgaggaacttgaaagcagagagcttccctggggagtggagtcacagaagtgagatttagctccaaaagaaaaacgaagaagaattgtccatatccaaagaggaagctgaccaggaacctttccactcatgaggttttaccagtgtggcaagtggaaagccttgttacctttaattataaacagcattgcttacttgttaaaaaaaaaatcaacaggcaatgaagtgtttgccagaaaatggatctaaatcaattggtaacaagtaattaaaagcagcttattgcttttgtttgggtctttcttttcctttgctctttattttgatattatttgcttaggaagcaaccttattcaaatgtttatttcaaataatttcaaattttcatttgtaggttatggagctttgtagcattaattcttatagaattaatgaaagaaaccaaaaaaggtgactggattctcagatcactctttttcttaaaaaataaaaatattttaagttctggggtacatgtgcaggatatgcaggtttgttccatagataaatgtgtgccatggtggtttgctgcacctctcaacccatcacctaggtattaagcccagcatgcattagctatttttcgtaatgctctccctcccccaccccatcccccaacaggccccagtgtgtgttgttcctgtccttgtgttcatgcgttctcattgctcagctcccacttataagtgggaatatgcagtgtttggttttctgttcctacattagttttctgaggataatggctttcttgctccatccatgtccctgcaaaggacatgatctccttcctttttatggctgcattgtattctatggtgtatccatctatccagtctatcattgatgggcatttgggttgattccacgtctttgctattgtgaatagtgctgcagtgaacatatgtgtgcacatatctttggaatagaatgatttatattcctttgggtttatacccagtaatgagattgctgggtcaaatcgtatttctggttctagatctttgaggaattgccacaccatcttccacagtggtgaacaataagtctgaatatctagtgtaaccagtattaaccattgtgtttacaaattatagtgttaattaatcattttcattgttaccaaatcacagtttatatgatgacacattttgatttcaaacacaagatctggaacatctgtctttcccactggtgaggctccctgttggagcgagggggatgtgggggagcaaaaactcatgttttctaatttatttctttgtataattatcattttcacataatcctaaatcgaacacttatggattgttattctgtgagtttgtgcacctgcatcccccttctatgtatggattatttgttaactcagtgttcatatattgctaacacctttgttcatacttgtgtagagatcattgtgatttccttaaaagtagatgtaaaaatcatcactgttctcaagcaagaaaaccttgaaaggcaaataccagtagatctaattaatatctctaaacaaaatacctttgttttgatggctgtctgagaatatcagtgaatagttgggatagggaagacctggaacacagagctaaccaaggagaaaaagaagttattggtatatattatgaaaaggggaatagcttttaattggattttttttctttttttcactgtgcagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggtgggttctgaaggactcatcctcgagctgcacttactcctgcaaaatgagaggaagagaaaaattcatcctggaggttgtaaaataaaaattatatctgatcagcattatacatagttctaatgcgttaagattttattattttttaaacattgattggtgtcagtcacccacaccaggaaggaaaatttcaaaggataaggtgacaaactgtgagatgatctttccaattatttgtctcagcatattttctttttttaaaattttttttattgtactttaagttctatggtacatgtgcacaatgtgcaggtttgttacatatgtatacatgagccatgttggtgtgctgcacccattaactcatcgtttacattagatatatctctgaatgctatccctcccctctccaaccaccccacaacaggccccggtgtgtgatgttccccttcctgtgtccaagtgttctcattgttcaattccaacctatgagtgagaacatattttcactttgaaattgctgaatttctctgttactttgaagcagctaaggtaaatttggttaataccataacattatttttacaactaaatgccaagaactctgggagcaggaagataggaaaattcagtacagatgtctgtgtgtcctttgctggatcttgttgcttatgctgctgtactctgatctttgtcaggtgaggtcgaaagtcagtagcatggggcatgtgtagacatgtagatatataatgtggtttatacacatgcatgcacacacatgcattcctactactataaataggatttaatgtggccttgaaaggatatctgaaatattgtcagataaaacatttgaactgcataaggaagcaatgtgctttcctgtgtagggtccacaatggttggcttcccccccatacccaagtggcctgaattcattggcctgctctttccaagggctatgtatttccgtctgacctctacttgagggagggatcctttttggagaaattaccaattaagaccatgtcactagaaaatctattaaggattataaagacacatgattaataatttatggtgatctcttcatagaattatttttcctttcagccatttcctgacatattttgttacataaccccttttaataaagtaaaatagacaccgttttgagtataaatcccaatgtgcttttgaattggccacatcaccctggagtctgcagatttccaatagctgactgaacctggagtaaaatgcagagtgccctttaaacataatttgttctctgatgtcccttactagtttagtctattttataaaactgtaatgtaggatcccccttggcagatttcagggtactccattttcctatagtatcaaaagatttttctttaaagagaaaaatctgtattacctttactttctagagttgtaagtataagttgaattgtattttagaataatatccttgttacccacagtaaagagtcaatttttttctctacatgaaggttacagagcatagaaatttaagtgaatttagacactagttgcctactaccattttatggataactgtcataatgactgcatgacccagtcaatttacttttaagacccagatctaactaagccactaatcattgtttgaaaggtaaagcccaaggttcttagcaagcccccctgaagtgtggtgccttctgctcagtgaaggtgtctgtgatcctcctcccatcccacagggatatttgttgccctgcctctggggctgggctgatgccttctccgtgtttctgttacgccctctttctctattagggcacatctatgttggtttatggtatcgatatgctactcataattgaatcttgcaagaaaatagggagaccctgccctgtgcaactgggaatggatagatcctgccttcccagcctgagcagggcccctgtcacctgcacccactgctggacatgagtgctgagatcccacttccttgctgtccttccctaacctgcgctgactcctgtccagctgtcccactgtcctgctgctggccttgggttgtttgccatgaattcaggtttccattaggacctgagccctagttcctgcctattttgtctcctgcctagagctgcacttttgctgtctgtaccctaggtgctggctgggttggaacagccacactgttcagatatgagatatgctgcatatctggaaagttctgctatacctaggtcccatctgaattcttcctatttaatacagggatcgtttgttagtcattttcagttagaggataactaagtggcacatttctgggcatagttggattcctgtattaggacactggattgttgtgagtgggtggaccagaagtaagctcagtcaattgtctccaccaaccagaattacttgaagagatttaaatgaatgtgcacacctgggcccctccctagaactctgcaatgagaagctctggggatgagacccaggagctgttcataaagcttcccaggtaatcctcctgaggagagaatgagcaagctgatgtgggttactgtgaatactactctgccaggcaggagggaatacagtggcacaacttcctgttggagtgggaagacttccaaaagtccaggatagggtgaaaggtcaataaacacaccttcatctgggagagggaaataacattcaaacagaaaagtgtaaaattcaatgaattttcacaaattgaacacattgatgtagccccctctcactaataaactgaatactgccaacacttcagatggcctctcataaacttctccatcaatagctgcaccctaggtaactgcaatccttatttttatttttattgattcatttttcttgcctttgaacgttatataaatgaggtcatgtaagatagaattctgagtatctagctatatttttctcatcgtctatgttctctgtagaataaattatatattgtcaaatggtgattttatatgtggaaaaataataaagaaaagttgctggggatactgggagcttgccatggatattggattttatttttaataccttttttattttgaaatagtttaataatcagaagaagttgtaaaattattatcgaacattgctatgtaccttacacccagcttctcccaatgataatataataatatattacatggcaatttacactgtcaaagccaggtaattgatgttggttatgatactaactcagtcgttatcattaaaatataatcattaaatatattttaaatgattaaatataataattaaaatgttggcatattatagtttataggggaaattgaaatttattggaaagttaaatgtgtcagattgcaaattagaaagaagattaaaaagtgagcagctcagatttagagaaaataagagttgaaaattaaatttgcattcctctgatagatacttactgaatactttttgcaaagtattgtgcaaagtgctggttatataatccttttatgcgattcaacatatactataaacttacaatgtttcagtacttttatatacaatctacattattaaatgacttgtttagtaaaaagcacttaataagtaaatgccttataataattttgtgataagctattttaacatttagtacaattaatctggcatgatcttattcataaaattaaaaactagctctagtttagtgccaattcatttcagtatcttttaggaatgtatatatttcatttatgttagacaataaaaaatggattcttgcctgataatcaggatggcagaactggggtgctctggacaaagctgactgcccagaagtccgaaggtgatatcttcaattttttacaaatctctgacctttttgcctcttctagactattctggtatcatttgctaggtgtgaattcactctgatttcatcttcccaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagaggtaatgaagcttctatttttaatcttcttctgttgtgaacctgtacaactctagtagctgatctgcttgtgttagtctcagaatatttgaaatcagagccaaaaatagccttcaaattttagaaattcctacaaaatcagtaggagcagaaccaaatagagggtctgttgactatttcatagtaaaaacttggctgattgataggatttattttgttttataatgttaaaaatttcatgtgattgcatagttttaattatgacttgggctatgggataactttttgttgagcaaatatttttttgaatctaattaaggaaccacttttatctcttactgggacatcagtactctaagtgtccaattaagcccatctggcaaaatgctactcagaaaaggtaaagaacactcatccacctagcaatagctcaggaatttttgttcacaggtaagacattaattctagttataatgtttaatcagaactgacagaagccatataaattgttcctgatttatgcttaatgtgtaaagggaaatcagttctggaagtgattgccttcaattaactgttaaaaataaaagagcaccttgcattcatacggttcccagctcctgagaaattcaaaataggttatattgttatctgattggtatctatattctacttgtgatctgacagtaggtgtctcagatatgtgtattctgaggtaaagagaagccgagagatcaatctgaagtaatgcaggcatattcttactctctgaactatgatttctggtagattagaacaaaatgttaagaaaggatttttttttttagtagttgttagcttctgctctaagactggctatgcaatcttacccatcttattgaactattttttgtacccttgctttaaaaatcatgattattatagttttgccggtacctctccatagtagtttgaggcaaaggggtgtgggagggccaagattcactgaaaatcaactgacaaaaggcagagtaacaggaaaaaggcatatgaatttatttgattatagttttacgtgatacgagagccttcagaatgaagacccaaagatacagggaaactgtctgtttttatgcttaggttcaaccaagtacggacagccatgtagaaatatggttggacaaaaagagtatgacccaattaatgctattaggctgagaggggaagcccagcaaggcctctctgtttagatgcgctttttttttttttttttttttttgagttattatctacatgtttatgatgttttatttttattgttaaaaattttattttaagttctgggatacatttgcagaatgtgcaggtttgttacatagttgtaaatgtgtgctgtggtggtttgctgcacctctcaacccatcacctaggtattaaatcccacatgcattagctatttatcctgatgctctccctcccaccatccctctgacaggccccagtgtgtgttgttcccctccctgtgcccacgtgttctcattgttcagctcctacttataagtgagaatgtgcagtgtttggttttctgtttcttccttgtgggtgtggggcaggaccctctctggaatgcaggtctgtcttatgacctacagtcaaacaaggtaggacagataacttctttaggggtaatttttgtactgaaaaatatgtaaaaggggagaagttagggtaatatttttggttttatggtggctttggggaaaagaggttctagtttctatgaccagcctcaggggagaaggaggggccggagacagcagggcaggaaaaggtcagagtaaaacttttgattctgaggctgcctttggggccttcactttggggtattattttctgagtcccaacagggctaagagataaacttgtaaaacattgacagaatgatgctccaggtatcttaaatggtccaagatgccatttaaagttagattttattatcttaagctcttataagcattacagtttaattacctagatggagagtgctatgcaaaagtctgtggaaaatacagaaatgactaagatacagtcctgtgttgtttaacaatggggatattgtctgagaaatgtgtcattaggtgatttcattatataatatactttcacaaacctacatggtatagcctacgacacacctaggctgtatggtaagcccattcctccttggctacaaatctatacagtatgtgctgaatactgtaagcaattgtaacacaattgcaagtatttgtgtatctaaacatagacaaggtacagttaaaatatggtattgtcatcttgtaagatgaccattgtatatgcagttcatcattgcctgaactatcattgactgtatatccttctccatctagaaattaataatcagttaggaaacaaaatatcataagcatgtactatgttacatgggagcataagcattgtcccaaggcagggactgtgatataataatgtaatattttttggaagtcacagcatcataataattgttatcctcccaatttcatttttgtatatattaaagtactttctaaaaagaactgaaaggtgcatgagtggtattgtcttcaatgctgtcagtccagagagggtggctgtgcaggcagggaaggaaaggtgggaggacagggtatgtggggagagctttattaaaaatgtggtttatagctaagcctaaaagcgttggtagaatttggataggctgatggtggtgtaccctggaacatggacagggtaggcctgggggagacggactcatattgcaaatggtgggagagatgcagggaaagcggggaaaacatggtaattgaagcagatggcaactcatggggttgtgaaattcagaggtccaaaatagggtgaggtgatggttaggtggggcttggtggcagaaaatccagaagcagtcactttccaagatttgaggagccaggaagccagtttgtatccatagatcgcagctcctagccatcagaaaacagctgtcttggaaggagattgacagaaccagagagacactgtcaccaaggtggactctcaggcacagtatatgctgaggcacatgatagagacaaagtgtagaaaagacagcaagaaggccatttttcacattggctgtaaggcgagatttgatcaagaactgagttgactctatgctcaatgtcagaatatagaacgagagtttctcttttaattaatatcaagattagcttagactctgagttaggagtgaatttgcaggaatttacaggctcttcaatggaaaaagaagatatataagaaagctgtgagcactacacacacacatacacatacacagacaaacacatatgtatatacagtagaagatggaatcttttaagaaaatactttaaaatacacaaaaatgaaattaggagaataataattataatgatgtgacttcctaagaatattatattatctctgcataatttgggggtagttggcatttacttctcatcctcttgagttttccacacatgaatttattgtctgtaaattactgctgaaattcttataccattcaagtgccatgatgattttgagaggactttgtaatctatacagtgttttatacactattgtcattttaaaactccataaataacacaaaccagcaaagtcaactcaaagttggctaaaagcaagtgctgtttctgatataattttgattttatttaacttgttctatttatttagcttgtttgattgaatgtgctttacttaactttgtttcctcttagtgctttggacttctaggggtgaatggagctgggaagagcacgactttcaaaatgctgaatggtgaagtttctctaacttcaggacatgctatcatcaggactcccatggggtaagatacagatttcatcatttttgttgcttaaagagataataagcccagagaacccccagcattttccctcagtcccgtggaataaaatttgaaaacatcattttcctccaaatttaccttccaattaccactcctctgatgtggggaaaagtttccaaatatgaataaactgagctcagtacttccagctggagtaaagggccttggaggtcttatcacagagcagccaaaggcagacgtccctgggaggtatcagagtggattggaagtgcccagctcctctctgcagatggaactcaggggagcaggaaatggccaaggggtggttcttctttattctcctctggataaaacttcaaatgttcccatcagcctaagtggccagatggtttccctctttttaccacccagacttcctctttcaggtggtcatgactccttcagggtgggagcagtgaacacattaaaaaccaagaaagcggcctctaggggagtaggcaagatgtttattccccttgctttaacatatgtgaggtccctgggcaccctgcacactcagaggctgcctgaggccagatgacccctgcaggctctgtgggtaacatacactcatgcattcctttatgtcactcttacctgggccctttcactcccatttcacagggcacctgattcttcacctccttctaaactgtgtgcttggttgggaacattcagggcatggtgccttcacgcccctttctgcacctgtgtggtagtgtgtcttcctttttcccctgctctgatcaggactaatgttaatgatgtttctctctactgcaagaagaaatcccctgctctaaacctctctgtgctcaatttgctctttgatttgtgtgctatcaagtttaccctaacagcaaactgggctcaatatcacaaactaaaatcttagacctttaatttcatagccagtttctggtgattctttctccacataccactcctgtgctgtgccttctaatatggatgtcctcgtatcccattcttttttcagcactgtgttacaaggccccaggcatctatctttcttttttcccactacagcaaactcatggtaacttgatgggtagtcaaattcatagctgtctttatgaatttaaacccagcacccaccagccaacaggttgagatgcgacctccagctttctgttcagtttctgatccgcagagatatttatttttaagagaggttatatgttcttgaccctagttttgtagcaatgaatatggcaaataaaaatcgattaaacattgttttgtggatgtagagaaagaactgtaaaggattgtgtctacaatttcccactggaattttaattgactttatgttgcatttataaattaatttggaaagaactaacatttgacaatctctttttttttacaatcacttgctaaaataaatataattcatttgtgaaagtattttaattaatccttgcagtctattagaagagaatgctcttatcagtaattaatgaaacagttttctacactttctctacagtaatgtctcctttttaaattttattttttatttcaataggtttttggggaacaggtggtgtttggttacatgaataagttctttagtggtgatttctgagattttggtgcacctcacccaagcagtgtacacagtacctaattgtgtagtcttttatccctcactcctctcccaacatttctccccaagtccccaaaattcattgtatcattcttgtaattcattgtatcattcttatgcctttgtgtcctaatagcttaacttacaattatagtgagaacataagaatgcttggtttttcattcctgagttacttcacttagaataatagtctccagttccatccaggtggctgccaatgccattatttatttagttcctttttgtggctgagaggtgtttcatggtgtatatatatgtatatatatacacatatacatatatagatgtatatatacacatatatacatatatattctttatccacttgttgattgatgggcatttgagctggtttcaaatttttgcaattgcaaattatgctgctataaacgtgtgcgcaaatatctttttcatataatgactttttttcctttgggtagatacctagtagtgagattgctggatcaaatggtagacctacttttagtactttaaggaatctccacactgttttctatagtggttgtactagtttacattcccaccaacagtgtaaaagtgttccctttttaccacatccatgccaacatctattattttgattttttgattatggccattcttgcaggagtgaagtggtaccacattgtgttttgatttgcatttccctgatcattagtgatgttgagcattttttcatatgcttgttagtcatttgtctatcttcttttgagaattgtctattcatgtccttagcccactttgtgatggtattttttgtttctttcctgctgatttgtttgagttctttgtagattctggatcttagtcttttgtcagatgtatagattgtgaagattttctcccactctgtgggctggctgttaaccctgctgattgcttatttggctgtgcagaagctttttagcttaattaagtcccatctgtttatctttgtttttgttgcatttgctttttggttcttggtcatgcagtctttgcctaagccaatgtttagaggggtttttccgatgttatcttctagaatcattatggtttcaggtcttagatttaagtctttgatccaccttgagttgatgtttgtataaggtgagagatgaggatccagtttcattcttcaacatgtggcttgctaattatccctgcaccatttgttgaatatggtgtcctttcccatctttatgtttttttgtttgctttgtcaaagatcagttggctgtgagtatttggctttatttctgggttattgattctgttccattcgtctatgtgcctatttttatacaagtaccattctgttttggtgactatggccttatagcatagtttgaagttaggtaatgtgatgcctccaggtttgttctttttgcttagcaattgctttggctatgtgggcttctttttggttccatatgaattttaggatttttttttctagttctgtgaagaatgatggtggtattttgatgggaattccactgaaattgtagattgcttttagcagtatggtcattttcacaatattgattctacccatccatgagcatgggatgtgtttccatttgtttgtatcatctatgatttctttcagcagtgttttttacttttccttgtagaggtctttcacctccttgtttaggtatattcctaattttttttttttttttttttttgcggctgttgtaaaagatgttgagctcttgatttgattctccgtttggttgcttttggtgtatagcagagctactgatttgtgtacattaattttgtgtcctgaaaccttgctgaatttatttactagttctaggagttttctggatgagtctttagggttttctacgtatacaatcatatcatcagcaaacagtgacagtctgacttcctctttaccaatttggatgctctttatttttttctcctgtgtgattgctctggctaggacttccagtattatgttgaatagaagtgctgaaagtgggcatccttgtcttgttccaattctcagggggaatgctttcagcttgtccccattcagtataatattgtctatgggtttgtcatagatggcttttaataccttaagttatgtcccttctattcctattttgctgagggttttaatcataaagaatgctggattatgtcaaatgctttttctgcatctattgagatgatcatgtgaattttgtttttaattctgtttatgtggtgtatcacattaattggcttgcatgtgttaaatcaaccctgcatccctggtatgaaacacatttgatcatggtggattatctttttgatatgctttggattcagttagctagtatttttataaggattttttcatctatgttcattagggatattggtgtgttgtgttgtgttctttttttgttatgtcctttcctgattttggtattggggtgacactggcttcatagagtgatttagggaggattccctctttctctatcctgtagaatagtgtcaataggattggtcccaattcttctttgaatgtctgatagaattcagctgtaaattcctctggtactggatttgtttttgttggtaatttttttaattatcatttcaatcttgctgcttgttattggtctattcagagtttctgtttcttcctggtttaatctaggaggattatatatttccaggaatttattcatctccttcaggtttcctaatttatgtgtgtgaaggtgtttatactagaattgaatagtattttttatttctgtagtatcagtaataatatctcttttttcatttgtaattgagcttatttgaatcttctctcttcttttcttggttaatcttgctaatggtctatcaatttgatttgtcatttcagataaccagctttgtgtttcatttatcttttgcattttttttgtttaaatttcatttcattctgctctgatcttcattatttcttttcttctgctgggtatgagtttggtttgtttctctaagtctttgagatgtgactttacgttggctgtttgtgctctttcagatgttttgatgtaggcatttaaggctatgagctttccttttagcattgcctttgctgtatcccagaggttttgacaggttgtgtcactattatcattcagttcaaagaatttttgaatgttaatcttgatttcattgttgacccaatgatcattcaggagtaggttatttaatttctatgtatttgcatggttttgagggttcctgttggagttgatttcccattttattcaactgtggtctgagagagtacttaatataattgtgattttcttaaatttactcagacttgttttgtgtcctatcatatggtctatcttggagaatgttccatgtgctaatgaatagaatgtatattctgtagcacatgaatgttctgtaatcatctgttgagtccatttgttctagggtatagtttaagtccattgtttctttgttgactttctgtcttggtgacctgactagtgcagacagtggagtattaaagtcctccactatcattgtgttgctatctgtctcattttttaggtgtagtagtaattgttttataaatttaggagctccattgttaggtgcatatatgtttaggattgtgatattttcttgttgggctagtccttttgtcattatataatgtccttctttatcttttttttaactgcagttgctttaaagtttgttttgtctgatataaaaattgctactccagcttgcttttggtgtccatttgcatggaatatctctttccacccctttaccttaagcttatgtgtatccttatgtgttagatgagtctcctgaagacagcagaaatttggttgatgaattcttctctattctgccattctgtatcttttaagtggagcatttaagccatttacattcaatgttagtactatttgttgcctgaatgtcttgtttgtttgtctgtttcattgtgttattgttatataggtcctgtgagatttatgctttaaagaggttctattttggtgtattttgaggatttgttttaagatttagagcttgttttagcagttcttgtagagtggggctggtagtggcgaattctctcagcatttgtttgtctgtaaaagactgtatctttccttcattcatgaagcttagatttgctggatacaaaattcttggctgataattgctttgtttaaggaggttaaaaatagaaccctgatcccttctagctttcaggatttcttctgagaaatctgctgttattctgatagcttttcctttataggttacctgatgcttttgcctcatagctcttaagattctttcccttgtctttactttagataacctgataactatgtgcttatttgcatggttttgagggttccttaaaacgtaggtgatgatcttttttcaatgaatttcccaggtgttctttgagcttcttgtatttgaatgtctagatctctagcaaggccagggaagtttttcttgattattccctcatatatgttttccacacttgtagatttcccttcttcctcaggaaaaccaattagtcttaggtttagatgcttaacataatcccaaacttcttggaggctttgttcattttttaaaattcttttttctttgtctttgatgaattgggttaattagaaagtcttgcctttgagctctgaagttcttgcttctgcttttccagttctattgctgagactttccagtgcgtgttgcatttctctaagtgtgccttgatttccagaagttgtgattttaaaaaatttatggtatctattacactggagatttttccttccatgtcctgtattatatttttgatttatgtaagttagagttcacctttccctggctcctccttggttagcttaataattgaccttctaaattatttttctgacaattcagagattttgttttggttttgatccattgctggtgagctgatacgatcttttaggggtgttaaagaattatgttttgtcatattaccggaattgtttttctggtttcctcctcatttgggtagactatgtcagagggaagatctgggactctagctgctgtttagattcttttgtcccacagggtgctcccttcatgtggtgctcttccccttgccctaggaatggggcttcctgagagcccaactgtagtgattgtttttacccttttgtgtttagccacccagcagagctaccaggctccaggatggtattggggagtgtctgcaaagagtcctgtgatgtgatccatcttcaggtctttcagccgtggataccagcacctgctcaggtggaggtagcaggggaatgaagtggactctgaggttccttggttgtatttttgtttagtgtgctggttttgcattggttggcctccagccaggaggtggcgctttcaagagtgtatcggctgcccttgtggaagaaggatcaggtggtgggtggggccatagagttcccaagagattatgtgctttatcttcagctaccagggcaggtagagaaggaccatcagatgggggcagagttaggtgtgtctgagctcagactctcctttggtggggcttgctgtggtggcagtgggggtgggtgtgtggttctcaggccagtggatttatgttcctcaggggattatggctgcctctgctgagtcacacaggttgccagggaagtggggtaagtcggcagtcacaggctttaccccgctgccatacagcctgcagtcctaaagacaggtctcactcccaccgtggccctcccaacagcatcaagtcaatttctgggcagttggtgaccagggctgagaacttgccccagagaactcagccttcctgctgagaaagcaaatggactcatggttttccgatgtctcattgagccagcagcagtgatccagttccttcaaagggtctgtggattctctcagctttcctggtatgttcctagggtaattcttgtagcaaaagttcacgatatgagtcttcacatgcagctgtctgagcaggagctgcaggctagtcctgcctcctttccctctatggtaacatctctgattctaattctccttattgctttccttagaactatcaaaacaatgttaaatggcaatgcattttctcatttaatggtaatatttctatttatgaaatgatggattgaaaattatctacaaattttcatctaatgtagacattattttgttggcaattttataaaaagttcttacaagaatattttaaatttatcactttaaggccaggtgcagtggctcacacttgtaatcccagcattatgggaggccgaggtgggaggatcacctgaggtcagaagttcaagaccagcctggccaacatggtgaaaccccatctctactaaaaatacaaaaattacgtgggcgtggtggtgtgtgcctgtaatcccagctactcaggaggctgaagtgggagaatcacgtcaactctggaggcggaggttgcagtgagccaagatcacaccactgcaccccagcctgggtgacagagtgagactccatctcaaaaaaaaaaaaaattataacttcaacatttataaagttgcatgtattttatagttcttttccttttgacaaatttgttataaataagaggtagttgattatccacctatccttagctttccataataaattttatttttgttagatttttaatatttttgttaaatttcatatgctaatagtctatatagattttatatttattattcataagaaaaattaatttgttgaaaacatcattttcaatttttgctattaactattttgcatttttgtaattttgacaatttgtgtttccttagaaactcattaatttaatttaaaattgcaaattacttacataggattataactatggttctcctaaaatttgtatttccttcctatacctgtgtctgtatatttgtgttttatttctataagttatattttccagattctgacttttatttttaaaaggatgaaatattaatttatttagaaattcaaattatttttgcttttcaaatttatcaaactttgtcattcttcttaatcccccaccatgcttttctcaatctagttttgttgttttatttctaactttttgatttaagtgttttttgtgtttttcatcttaaaataaaaaatcaaattatgaggactaccaatatgctttttgtacagcttttaccttgatcctaaaaatgtaataaatcatagtattgttgttattctctaaatgatgttagaaatacattttcagtgccacaaaggaagtagcactcgaacatgaattttctcagcaaggcaattttacttctatagaaggatgcatctcacggatggagcaatggcgagagcacacctgaacaagggaggggaaggagtttttatccctgacgcaggtagcccctactgctgtgtcattcccctattgattagggttggaccacacagtctaagctaattcctactggctattttaaagagagcagggttacgagccagagtggtgggatgagcagttctggtgggaaagacggttacagaacaaatgactaaatgtgactcaggtcagaacaggtgaccaagggtgactcaggttgcagcaggtgatcaggggtgactcaggacagagcaggtgatcaggagtgactcaggatggagcaggtgaccaggggtgactcaggactgagcagatgaccagggaaacagttgtgaactactgattacaactggtggggaggttgtttactgaaactaggggaaggagatgaggagaacaaggaagttaaactttaaaatgaaggtcatagaactgaacatactgacatactgatactttgaagagaaacttagaactcactgtatttaacaatgacatatatgattttaatatagtatttttatcaaactttagaaggctttttttcagatactcattatcttatttttttctttctttctttccttttttttttttttttttgaggtggagtcttgctctagcacccagcctggagtgcagtggtgcgatctcagctcactgtaacctctgcctcctgagttaaagtgattctcctgcctcagcctcctgagtagctgggattacaggcgcatgccactgcacccgactacattttgtatttttagtagagatggggttttaccatgttggctaggctggtctcgaactgctgacctcaggtgatccacccacctcgacctcccaaagagctgggattacaggtgtgagccatcgcgcccagcctatcttatttcttccttcaatatttttacaaaataattttaaagacttttttgaagtttaatttacatatgaaaaagaacatccaatgacttttcataaaatgaatataattatataatctgtacctacctcaagaaacagaaccagaccaccaacccataaattccatctaatcacatccctgttgaggttaactcttatttgcatcttttttgtttttaatacaacttaatgtattattaaaggcaatcttgtaaacaaaactcaggacaagaagtagaactttggtagctaacttataagtcattctatgtactccattccaaatacaacctcttccatttaaatgattttttttgaattcattacgcaagagtctattcctagacaccatagtttaatcttgcatgtttgtaagatacttgatagggcctttaagttactcaattcacaggtcctttctccattcctttcatttctttacaaactctctgtcgaagaacctgaactgttggacatggtgagttggcctacaaactttgctgactgcatactgatgatggaatttaatatgttcatttgttctgtttcttgcaattgcagctggattcagaggtttagttagacgcaggttcaatcctttggcatgactaaacaggagatgatgttctctttcatcaagaggcacataatgtctgggccaggtgaggtggctcatgcctgtaatcctagcactttgggaggctgtggcgggcgaattgcttgagcccagagtttgagaccggtctgggaaacatggggaaaccctgtctctaccaaaaatacaaaaattagccaatctcataaccttgtgtaaaaataataaatattaaaatataaaactaaaaaataggcacataatagctggtctttagtctttttttttttgcttttagcagttttgatgtttaatgcttaggtgaattcatccattgcaaaatggtcatgttttaacctagtctttttgttttcatttactagtttggataattttgtacagagatgctttaactgtcttttatttggctactcagaggtacagttcatacaggaaaagagacagaatttatttacccagttttcacaataatcaattggttttcagctgtcctcagaaagtgacagattaggttttcatgtatttgtttccttgtatcattctgacttcattctgatagaattagaatgtatcacaagtgtcactttgtgcttagttatctcttttacttcttagaatttcccttttttattctctcgacattctcctctagtcatttcttcatccatatactagaaataataactcaaatgtttaaatgaaggttcaatgctataccacataaaatccaccttgtgcagaaacagacatgctgttgtcatttaactgcaactaacttatatgaagaaaattgcagacctgaaatcaaatctatcttgctccaaatgctacatgctatatctgtttctgtctgtcggcagataatgcagttttacttgggttaatctatgtcaataggtgaaaactcaacattaagagctaattatgtttgagaacagaaagtagagaaaatttattagttgagcaagtgtttgaggttggtatgtgtaaagagagttgtgatactacttactctgaaaggaaatcctgctgtatgggattgaatctctctcaagtgtttccttgatttttctctgcagtcatagaagaagtaagatatttttgttgaatttggaggtaggttttgaaaaaaaaaattctaacttctctatttacaagtacatgtagacaaaagaattttaacttataaagcaaaattaggtttatttcttcatccctggaagactgactctctcctttgtaattctatttcatcatttgtaaaataattggaaaatgaaattcaaataactactcttgaaaagaagaataaatttacatacaaataatggtctgcaagtcccttattatactccatatctgtgtaattagtttaattataactaaatcatgcttgcattaattatattttaaccttgattatttgtaatgttaattgcacattggtattcaaagaattaaataggtaattagcagcacaatggaatttttcactacttagagagttgaaatgtaccttcctgcccatgaagcccatagcttattgctacctaattgaaacacatctactcattcattcaatatattaaggtatttttgtctcttctttgaggttatattatctaaaacagggctcttttactttcctgtttaatttactaatctccatgaatgcacatcttcaaacttgagagtaatacatgtctaaatatatttcaaaattgtccactgtagtttggctcagagcatgtcatgttctcctgatatactgatagttgtctcaggccagaaatcacatgcatttttattattattattttctattctctgtagctcttcttcctactatcgtaactctcaactttttgtcttggcaagttgtcaaggctgcagcatgatagactaggtcccagaggaagtgaagacaaggaagtgaagtaaggaatttaagactaagatttgttttatgaatttgatcaacacagttgagaagcaggcataagaataaataattatttgacttaaaactagcagtctcatatctggaacactaaagtcctgctaaggtagtggcaagattaacaaaaggctctaaaaattggagacaagttttctgatgaaaatcttatgttgtgatatttacttaaaatatgaaaggctgtggcatttttatttggtcagcatagtgttaaaattttggatttggattggcgttggttccagtttgtcacagttgccaccattgcttgttgccttattgatggacaccatcaaacatttacttggactattacatctgaaattattgaaatttgtggctcctgaacaccataaatgttaatctcattagccatgatttactgtgtctctcttattcgccgagtattaagttaggggctttacattctagatcttatttgataattataatgacaaagaggttgttatcctaattttactgacaagaatctaagattcagaaaaattaagtggcttgccggaagtcaaacttctagaacatgatggagctttgaatccaagtttttgaaactctaaatcacatgcagttcctatccaccctttgactattagagaaaacaaagtagtcacaatcaatgagacagaacataaaatattttaaaagggagaagaaaaagagatatatatatacatataaaatatcatgtatataaatatcatatgatatatatcttagttatatctatatatatattttaaaaggaaagttgacagataacagagcaggcacatatttttataataaatattattgggagtatctttccttaaaaaatcagacactcagaaactgggttaaaaaaggtatttttttttttacatgacacaacacaccattacagtgaaattaaaaataatggccattatgcaaatgaaaacaaaacaaaactgtataaatacgttaacatttaaatatataattcaagtaaaggtacatatgaggcaaagacactactaaataaaatacattctttgatgtgaagtcattgcagtcaagaaattctgtatatgaaagacatagaatgataaggtgtaaagcaaagtctgttgggaaaaccagaaagagaatgagaggatacgttggaaggaagagaccttaactctttaattatctaatagttacaaagtgtaatatatttggagaatgagtttcacgtcatcaacacaagaaacaagactgtttatcatacaaacatgacaaatacaactcttcatttttatttatgaagtactagagtaattcctgttaaaataagaaacagaataacatgatcaacattattatttagcattttctggaatttaagttcctgctataagacatagtttaaaaaatagtatgagtatttatactgctaattattatcttttgtgtcatcatacacttaaatacccaagaagatcaattaagaaataatttcaactgaagtggccagaaaaaataataaatacattcaaggctatataatatgaaaaacaattacaatagaaaaaaacacatgcaaggtaatgaataaccttagaaggaaatatggtcaacctatatgttaaaatgtagatgatgttttcagcataaaagaataaataagtaataagataataccatgttgctgaatggaaaagctgaatcatcttactattactctcctctagcaagttttatagatttaatgtaattccaattgatattgcagagaatagagtaggctttacacagaatttctgaagttttaaacacaagaataaatagatgggtctaatcgtgacatttttcaaaaagaataggttgataatggctaaatgacttaagaaatatttcagtgcattatattgactttgtaataaaataatgtctttctaattggattgcttaatcgataagagaaaatcaaaatataaaaaaggtagtatacacattttacattagtgataaaaggaaaagaagttgcaaaattttcctgagattggtattttctatccctcaaagaaaattagaaataaggcaaataaacacattgtttattcaataaggacatttcttttagacattaaattaatgtaaaatttacagtagaaaatacagatatatttaaacatagaaatttaaatttcttctgtaagtcgaaacattaaaattgaaaggctgaaaacaaggatcaaataagacaaagcattaataggtataatatgtaaattactgtatagtgataaggaaaagactacaattacaatacaaataggctagctgggcacggtggctcacgcctgtaatcctagcactttgggaggccgaggcaggcagattgactgaggttaggagttcgagaccagcctggccagcatggtgaaatcctgtctctactaaaaatacaaaaattggctgagcatggtggtgggcacctgtaatcccaactactcgggaagctgaggcaggagaatcgcttgaacccaggagtcggaggttgcagtgagccgagatcgcaccgttgcactccagcctgggcaacagagggagactccatctcaaaaaagtaaaaaataaaaaaaataaaaaataggcataagacttaagcattaaacacaatatgaaagtgaatggttaataaacattttaaaaatagttgccatcattaatataaaaatgcaaaacaaacaacagatacatatatatttttaatcattataaacaactaaaatgtagtgcacaatttcatgaaggtatagtaaagtggacactgttatatgcttatctttggaatataaatcataattttactggagttaagcatggcaatatatataaaaaatacttgggctaataattttccttctgggaaatttgtgcctagggagataacagaaacttggataaaggtttaaatgaaaatatatttattctagtaaataattgagaaggtattgttcctatatatttaacaattacattaattacaaaatgttggtgcaaaatcatttaaaataatattaaatatattaaaatggaagattagcataacttgaaaatgctctcattactagataagaattatctaaaacgattatattagtacctatctgaggtcacaagaaaggagggaaatttccaggtgccataaaagaagaaaccaacaaacctgatgtgatactgtgcaatatatatttttgtcttagacccatttccaagcctacaactcctaaaattcttggaatgtccaaactgatgtaatttttatgctaatgatttatggcgctggcagcctctaggtcacttcaggatggggctggtcaccagaaagaccaaggcaggattacagggttgggacttccagccacacccctcaatctcaggggatgatgagacgctgaaggttaagttgatcacaaatgaccaacgatttattcaaccatgcctctgtaaaagctctgtaaaatcccccaaaactgtgttcagggagtttctggatacctgaacacttgatagttcctggagggtggttcccagagagggatggaagctccataccccttcccacatgctttcccttatacatcttttcatttctatcttttgtaatagtctttgtaataaactggtaaatgcaaataagtgtttccctgagttctgtgagccattctagcaaattaatcaaacccaagaagagggtcataggatccctggccgatcccaaaaggtcagaagctcaggtaaaacaacctgaggcttgtgactggcatctgaaagggagcggtcttggggactgagccctcaacttgtgggatctgattatgtctgcaggcagatagggtcagaatagaactgaactagagaacattcagctggtgtctgctgcagaaatgattgcttgattgttggtggggagaaatccccacacatttggtcacagaagtcttgtgttgattgttgtggtgtgagagcagaggaaaaacagagttttcacactttcattccagagtaattgcttgtgttgccacctaagaaaggggcaaagcatatgtaaatttctgatttggaggcataggttttaatgtccctgatggtgcaagagctatgactgcagctctgcatgtggagaagcattgaactgaaactctgtataaagctaggatcgttgaaaggctgcatccttactgaaggggtaggatctagaaaagaccttctactggcatagaaagataataggaaaacattaatttctgtctaggattagaggtgaaaagaaaaaaatctcccctggaattttgaaaacctgagcttataccctagaactgaaactcctagaattgtgggagtttaaatttgactacctgtgatctgagaaccacaactccccctacccaagaatataacataaacattgacctcagtttgatgatacccatgggcacttttaagaagaaaacacaaatctttgcaaggatggtctcacagctcatatatcattttttttcaagagcccattaaagtggagtgactaaacaaacattacaaaacacacaagacaactatctactatatagataaattaatggctatcacaaaaaggagaattggcacacaaagaatgtaatgtaagagaactacaatcacaaagaaaatgtaagaagtaccatgatatgagagagaatagatttgaaaaaaaaagtactaagattaaaaactgtggctattaaaaagaaaaacaatggttgggttaaaaacaaatgatgtactgctaataaaaaatatgaaaatgaaattatgtgaaatatggaggatagaaagaggtctaacataagtctaattagatttctgaacaaaagaatagagacaatgggagagaggcaccatttgaagaaataataggtgaggattttctagtgttaagactgttgcttccttcaattgaagaaacattacatttattgaatataataaatgagacattcatacttaggcactttgtgttgaaaccaagaattccaaaaacaaactcttaaaagaaacaaggtggcaggtcaccacaaagtaagaaatacacctgcatctgttcacaataatagccactagccacttgtagcatctaaaattaaatgtaaatatgttaaaatcaaatcaaattataatttttttctcagcagccactagcaacatttcaagagtacaagaaccttctgtttcaggcagcacagatacaaaacattttcattgttgcagaaagtttaatttggcagtgatgaattagaccaaagaccaacttcttgacagcaagaatataaacagaatccagtaaaatgaaagaacataatgaatcaaaatgcattaataggtcaatagttgttatatatagacacagaattataggttaagttttattttttcttaatccttcctgtactttccaaatcttgcgctatgatcgtgtgttagattatcagacaattaaataataaacgggatataaactcttaagacaaaagcctttctcttcacatttcaaactagcattttttgagtttgctccattttaatatatgcaactgggataaactgttttttccttaggttttcccgttttttaagtgaccgtatcatagaattcatgtgaacaataactatgaagtgctatgacaccatcaaaattctaagtattatgtatataatacttaaaaatttatgtataaattactgtgcttcatataaaccaatgcactaccaatatatacaaaaagacatggaactcatttattgcttttaaatgtttcatcttcctttagactaatatgaatcacaaattagagtagtttgaatcataacctcaccaactagcaactagttgacaatttaattttctccatttaaaattaaatgacaatttaacaatactaacctaggaaaacaatgaaagaaagtcctctctaattttacatcaaagtgatttttattcttgcagacaccagtttaaaaaaatggtctaactgtgcctctatgtttgtatgtatcaattatctgtctgcatgtacacatgcttgcatgtacatatacacaaaaatgctcatatacagtgtatatttttttcattcatttcattcagtttttaaatttacatcatcatatcaaaatgttttcagaactgctgcacagtcttcacattaatgcctaccttgtattccactggttttctatgccagcatgtactgagtcatttctctattacatagttatattctcatttgaatttcccttccctggaacaaagtatctcttagctgaaaaagtcttattctgtgaaagaaaatgctgcctcttccatgctatgtctaagatatggcagaatgtgcaaactagcagaaagcatctgtatttagccacaagcattgacttcagtcggccccatgtagatctgtattagatgggtttccctgctgcttgctgcctcaggcttccatggggagcacccagaatacagtatgtgcagaggtgttcttaatttcacactgaagatgctcactcctctgcacacatggtccgtgatgtcccaactttacactggtgtaaaaatgatacacatttcagtgagtaccatactttgggtacccatacaatcattcttttcactttcagtacagtatttactaaattacttgagatattcaggactttattatgaaataggttttatgttagatgattttgcctagctgtaggctaatgtaagtgttctgagcacacttaagataggctaggataagtgatgatgcttggtaggttaggtgcaataaatgcatcttcaacttacagtattttaaacttacaataggtttattgggatgtaaccccatcctaagttgagaagcatttgtatttgctacttgttgatgtttacttcctgtttgctaacacactacctgtggtgtggcttctgtcatccacgatgtcttttgtgtcttttcaagaacaacaaggttgatgcatagctagaactgataatatgttctttttagtggaaaatatcttctgtatataacaaactgctaactgctcatacacagcgagtattttcatttgttagttttcactggaaaatattgtttatcctataggaatacatatatttctatattcctatcccgatatgccactataattaaatcatcttgggtacagtctttgtttcattacgcagtggtattagaaaacttctgaaagtcccctggcggagaaatgtccctaagcattttgttaattaagggataatttcactgaagaggaatattggaaggaattgctttctttctcagacatttaaatataaaagccgagttgaagtctttgttaatctagaatctatttttctttctaaggctatgccaacataaaaccatattttctttagttaatgtaatacagtactgggagtgaaggatgataaaaacaccagcatgtaacacattttttttttttttgtccacagattgttaaacgtcaaaagcaacctcacgctatggcttatgtattgagctgtgtgagagttcacatgtcgacttccaatcttcaaattttagttaatatattgtttgagctccctagcgcttcatgggaagtcctcactgggagaccttatctccctttcagctgctctcgttacatagaaactaagccaccatgagcaatgtgcaggttccctcatgccagggtgttttctgcatgccttgcttgcacagcttctatgttccctacatgctccttacacctggggagctctaatcctgtcagtgccaggcacaggtgagtctactgactcacacaggaagggaggattattctcagcttctttctaagattgaaacttgactacatctctattaaaatagagatgggtggtggttgcctggtaaacctatagccagacaactctagcctatttaggagtcattattttttctttactttttttaaaaaaaatttactttaagttccaggatacaagtgcagaatgtgcaggtttgttacttaggtatacatatgccgtggtggtttgctgcacctattaacctgtcatctaggttttaggccttgcatgcattaggtatttgtcctaatgctttccctccccttgccctctacccgccaacaggcccaggtgtgtgttgttcccctccctgtgtccatgtgttctcattgttcaacttccacttatgagtgagaacatgtggtgtttggttttctgttcctttatgagtttgctgaggatgatggcttccagcttcatccatgtccctgcaaaaggacatgatctcgttcttttttatggctgcatagtattccatggagtacatgtaccacattttctttttccagtctatcattgatgggcatttgggttggttccatgtctttgctaccataaatagtgttgcaataaacatacgtgtgcatgtgtctttatagtagaatgatttattttcctttgggtatatacccagtaattggattgctggatcaaatgatatttctggttctagatctttgaggaatcaccacacgtcttccacaatggttgaacaaatttacattcccacaaacagtataaaagcgattttatttctccacagcctcaccagcatgtattgtttcctgacattttaataatcaccattctgactgacgtgagatggtatctcattgtggttttgatttacatttctctaaggatcagtgatgttgagcttctttcatgtttgttggccagttgaatgtcttcttttgagaaatgtctgttcatatcctttgcccactttttgatgggattgtttgtttctttcttgtaaatttgtttaagttccttgaaaattctggatattagacctttgtcaggtgggtagattgcaaaaattttctcccattctttaggttccctgttcagtctgatgctagtttcttttgctgtgcagaagctctttagtttaattaaaccgcatttgtcaattttgaattttgttgccattgcttttggtgttttagtcatgaagtcttcataggcagatgaagcatagctaacatttctgtcctatgcttaccacaaagtagctgaatatttatttttatagaaaattctgcgtttcatatattttcttctttaccaaactctttgaagtctctatttttcttttttttggaaatggagtctcgctctgttgcccaggctggattgcagtggtgcgatgtcagctcattgcaacctctccccaacctgattcaaatgattctcatgtctcagcctccagagtagctgggagtacaggcgcctgccaccatacctggctaatttttgtatttttagtagagacggggtttcatcatgttggccaggctggttttgaactcctggcctcaagtgatccgccccccctcagcctcccaaagtgctgggattacaggcgtgagccaccaagcctggtctctactttcttttttatctttgagtaacaaatctcttaatttatgtgtgtgttgttgtttattcttcttttttcagtggatgatgccactggctgaataatactgtgaatccatctatttatctatctacgtacctacatacctatctatctcatctatctatctttttaatctatccatccgtctgtccatccatccgtccatccatccatccatctgcttggcagacctgcacaggtcatccatgttatgtcacctccccacactatcagtgtgcaccaactgtcatcccaggcagatactgtttttaataattttacagataagactaatagaggccaactgaaaattttttttaccttccagctctttactgagcattctattttagtcatatttctaaatatttcaagaattattttttctctcttgacttatttatgaaaaaaatggcatcctactttttagaaatgcaatatctaaataaatcattttttctttaaatattgatgtatttttcttttaaattagtttatctgcattgtttcagctacctgaattttctggagttttttgtttgtttttgtattgttcatgtcatatatttccttcaaatagctaatgttttgtgattgtctactcctacttaatatgtgagcattaaaatccttaatgaaaacccttggtatatggctagggcttactgactgttcactatagagtgagctatcattttgatagaatttggtgaggcaataaaagtaaaatgtacatttaaacttcatctttaattagatgtctagattaattaaaaccacttttgcattgccactataatcccatgtgattatgttgtattcctttgaatttttcaaaaatttgaatttccagaatcaatagtgaaatatttttgagttacagacacataaatctaaggattattagatctgtcctttttctcttcagtcttgataatgttctttgattttagatttagactgcttttaggttattactttattattttttcttttcaaataaattcgtatgtattgcactcttttttttttttaagatatatgtctgttttaatttgtttctactgaccaccaactttttcattcattataataatgcttaattcccagtttggtaaaattaatcttagttgtgttttatttttgtaacaaaggatgactgcagtgagagattccctgtcctgattccctgactaccagagagtaggtttcagccttcccttctgaaagacaagaatgcacatgccattctaaggtcacacattttctcaccagactctgggcattatcctactgtcttctgacagtcagcatgcaatggagaggtccaaggcagcctcactttgattcttgttcagatatttacatgttttatgttctttcctctgaagttaaccaaaaaaagcaagaaaacaaaacccattaaactccttgtcaaatcatcaaggcttagtagtattttcatttgtccttttagcctttattcatagttttgtttttaatttaagaaaataattttggtttccttgcagtccttactaattttaacctattaacctgttgttctcattctggagggccttaaaaaaaaagttacaattttatctcagacattcctttccttgggttttatgtttctatttcattgaggctgcttcatcttgcattcttctggaaataccagtgtctttccttaatattcagatacatgttttgctgaatcttagagattttgttccttttccactgtttatttttagaggatgttgttttactcatctaagaaaatgtaaactttttattaagttgatgttgatcaacagcaatggacagtagaattctctctgcttactttggtggtggttggatacagaatttggacctacaacataggttgaatagaaatgtataggtcttagttcagtcttggtttttagcaaggttttactttgtacttcctttgtattgtaggagcattgttcctcacctttgttgccttttttttttttagaaaaaaatatgtattgacaaattataattgtatatatttacggggtacaaagtaatgttatgatttaagttgtttaatttttaatatttgttggtacataagggttatatatatttatggggtacatgagatactttgatataggcgtacagtgcataataatcacatcatgacaaatggggtatctgccccctcaaacacttatcctttttgttataacaatccaattatactattagttattttaaaatgtataattaagttattattgactgttatgctataaaatactaggtcttattcattctttacaactacttcttgtacccattaatcatccccacttccctccctacacacccactaccctccccagcctctggtaactatccttctattctctttctccatgaattcaattgttttaatttttagctcccacaaataagtgagaatatatgaagtttgtctttctgtacttggtttatttcacttaacacaatgaccaccagttccatacatgttgcaaataatgggattctcttttatggctgaatagcactccactgtgtatatgtgccacattttctttatctattcatctgctgatggacacttaggttacttccaaatcttacctattgtgaacagtgctgtgataaatgtgggagtgcagatatcccttttacatgctgatttcctttcttttgggtatatacctaggagtgagattgctaggtcctttggtagctctatttttagttttgaggaacttccaaacttttctccatagtgactaccaatttacattcctactaacagtgtatgagggttcccttttctctgcatcctctctagcatttgttgcttgttgcctgtcttttggataaaagccattttaactggggtgagatatctttttgtagttttggtttgcatttctctgatgatgagtgatgttgggaactttttcgtatacctgtttgtcatttgtatgccttcttttgcaaaatgtctattcagattttttgcccatttttaaatcaaattattagatttttcctgtatatctgtttgaacttgttatgtattctggttactaatcccttttcagatggatagtttgcaaatattttctcccatgctttgggctgtctcttcactttgttggttatttcttttccagtgcagaagttttttaacttgatgtgatcccatttgtctgtttttgctttggatcacttgtgttcgtggggtattactcaagaaatttttgcccagaccaatgtcctggagagttttccaaagtaatagtaatagtaactgttcaagtaatagtttcatattttgaggtgttagatttaattctttcattcgtttggttttacctttttatatgatgagaaaataggggtctagtttcattcctctgcatatggatatccagttttcccagaaccatttattgaagaccatcttcttctgaatgtatgttcttgacacctttgtcaaaaatgaatttcctatgggtgtatggatttgtttctgggatttctattctgtcgcattggcctatgtgcctgtttttatgccagtaccatgctgttttggttactatggctctgtagtatattttgaagtcaggtaaagtgattcctctagttttgttctttttgcttaggatagctttgtctattttgggtcttttgtggtttcatataaattttagggttgttttctctatttctgtaagaatgccattggtattttgatagggattgtattgaatctgtagattgttttgggaaatatggatattctaacaatattgattcttccaattcatgaatatggaatatctttccatttttttattccttctttgatttctttcaccaatgttttgccatttttattgtagagatctctcacttctttggttgggttaatttctagatatttaatcttatttgtggttatattaaatgggattactttcttgatttctttttcagattgttcactgttgtcatgtagaaatgctactgatttttgtatgttgattttgtatcttgaaactttaatttgtttatcagttctagtagttttttgtgctagagtgtttagatttttttcaaatataagataatattatctgcagcaaggataatttgagttcttcctttctagtgtggatgccctttattattattatttattattattattattattattatttgattgctctggctagaagttccagtactatgttaaataacagtggtgaaggtgtccttgttgtgttttagatcttagaggaaaggctttcaggttttccctcattcagtgtgatactagctgtgggtctgttgtatatgacttttattatgttaagggatgttccccagttttttgagggtttttaatcataaagggatgttgaatttactgaatactttttcagtatcaattgaaatgattatatggtgtttatccttcattctgttgttatgatgtatcacattgattgatttgtatatgttgaaacatccttacatccctaggataaatttcacttggtcatgatgaatgatctttttaattcattgttgaattcagtttgcttgtatgttgttgaggatttttgcatcaacattcatcagagatattggcacatagttttctttttttgatatattgtctgatgtgggtattaaggtaatactggcctcatagattgagtttggaagtagtctctcctcttctacttttcagaatagtttgagtaggattggtattaatttgttaaacatttggtagaattcagcagtgaaatcattgggtcccaggctttattttttgctgggatattttattatggcttcaatcttgttacttgttattcacatgttcagattttgaatttcttcatggttcaatcttggtaggttgtatgtgtctaggaatttatccatttcctctagattttccatttatgggcatatagtagccactaatgatcctttgaattgctgtggtatcagttgtaatttctcctttttcatctctgattttatttatttaggttttccctctttttttctcagtctggctacaggtttgtcaattttatttatcttttcaaaaaacaaatttttattttattgatcgtttatattattttctttatttcacattcatttatttctgttttaatctttatttattttttaccaattttgggtttggtttgctcttgcttttctagttctttaatatgattattaggttctttatttgacatttttcttcttttttgttgtagccatttatagctataaattttcttcttggtactgcttttgctgtatttcatagattttggtatgttgtgctctcattagcatttaaataaatttttcaatttctttcttaatttctttactaatctactggttatttgtgatcatattgtttaatttccatgtgtctctgtaatttccaaaattcttcttgttcttgatttctagctttattctcttgtggtcagggaagatatttgttattatttcaaagtttttgaatcttttaagatttgttttgtgatctcatgtatgttctttccttgacagtgatctacgtgctgagaaggagaatatatattctgaagctgtggagggaaaggttctgcagtatctgttagatccatttgttctatagtacagattaagtccaatgtttctttgttgattttctgtttataatatctgttcagtgctgcaagtggggcattgaagtccccaggtattgttatattgaggtctatctctctctttatctctcataatatttgctttatatatctgagtgctcctgtgttgggtacataaatatttacaattgttttaccttcttgctgaattgacccttttatcgtgatgtaatgaccttctttgtctcttcttatggattttgtcttgaaatccattttgtctgatataaatatagctactcatgctacattttggtttccatttgcatggaatatagtttttccatccctttattttcagtctatgtgtatttttataggaaaaatgtatttcttgtaggcagcagatcattgagtcttgtacattttttttcatttggccactctgttttttgattggagagttttgtcaacttacactcaatattattgataaaaaaggatttactcctgctatgttattgttttctgtttgttttggcatcttctcatctttcttttattcctttattgaagatgattttctctggttgtatgatttaattttctgctttttattttgttgtttatctgttgtatgttcattgatttgagttaccgtgaagcttgcaaatactattgtataacccactattttaaattgatgacaacttaacagtgattgcataaacaaacaggcaaaaggaaactactaaaaactctaggttttaatcttgtcctccagcttcttaactttttttgtttctctttaagttttttgtactatctatgtcttcaaaagttattgtagttattatttttgattgggttcatcacttagtctttctacttgataagagtagtttacacaccacaattacagtattataatattctgtatttttctgtgtgctcactattaccagtgagctttacactttcagataatttcttattgctcatgaacaaccttttctttcagattgaacaaatgtttttagcatttcttgtaggacaggtctgttattgatgaaatcattcggcttttctttgactgggaaagtctttttttttcccttcatgtttgatagatattttcactggatatactcttgtaggataaaagttttttctatcaacactttaaatatgtcttgccattccctttttgcctgtaaggtttccactgaaagtctgctgccagacatattggagcttcattgtatgttatttgtttcctttctcttgctgcttttagaatcctttttttattcttgacctttgggagtttgattattaaatggctcagagtagtcttcttttggttaaatctgcttggtgttctatttgtttggtgcaaaagtaatcacggtttttgacattaaaagtaattacttttggcaattaaaagtaattaccacaattacatttgcaccaacgtaatataaccttcttgtacttaaatgttgatatccttctctcagtttggtaagttctctgatattatccctttgaataaacttcctgcctctatctctttctcttcctccactttaaggtcaataactcttagatttgccctttcgaggctattttctaaatcttatatgcgtgcttcattcttgtctgttctttgttcttttgcctcctctgactgtatttttaagtagcctgtcttcaagctcatcaattctttcttctgcttgatcaattatactgttaagaggctctgatgcattctttagtatgtcaattgtaccttccccttccttccttccttcctttctccatccctccctccctccctccctcccttcctcccttccttccttcctctctctctccctttcactttctctttccctttctctttctctcttttttctttttctttttttttttttgacagagtctcagtctatcacccaggctggagtgcagtggtgcaatcttggctcactgcctcaccctgtcacccaggttggagtgcaatggcgcaatcttggctcactgcaacctctgcttcccaggttcaagtgactctcctgcctcagcctcccgagtaactgggattacaggtgcacaccaccacgcctggctaatttttgtattttttagtcaagatggggtttcaccatgttgcccaggctggtcttgaactcctgacctcaggtgatctacctgccttggcctcccaaagtgctgggattacagacatgagccactgcacccaggaatcaaatgtatttttcgactctagaattacttcttgattcttttgattttttcaatctctttattaaatttatctgatagaattctgaattccttctctatgttatcttgaatttctttgagtttcctcaaaacggctattttgaattatctatgtgaaaggtcacatatctctgtttctccaggattgatcctgccttagctcatttggtgaggtcatgttttcctggatggccttgatgttcagagatgtttgtcagtgtctggacgttgaagagttaagtatttattttagtgtttacagtctgggcttgtttgtgcccatatttttggggaaggctgggctactgtcatagtggcagcctttttgctttcttctttggccccctctcagctgctaatgtctatctaactacctaacataaccactacctgcctaccacctatgttcactcaaggccctagggctctacaatcagcaggtggagaaaccagccatgtttgtgtcattcccttcagggggtgagttcccccaggccctggctggacccagagaagctgtctgggatccagggattagagtcaagtatcttagaaatctacctggtactctattttgctgcggctaagctggctgtcaaaccacaagtcagaatccttccctccttttcctcccttttgactgtcagaggagcctctctcagtggccaccatcactactggctcacagggagttcttcaaggccaacgctgatgtccctttaaagcccaagaatcagcttgtgataaatgctgccaggcctgtgactcacccttcaaggcagtgggctcccttctggtccaagacaggtccagaaataatgtccaagagcctaggcttggactctgataccctaagagctcactcaggtaccataagcgctccaccccactatggctgagctggtacataagattcaagacaaagtcatctttcctttgccctctgcccttctcaagcagaaagattattttatcatagccactacagctaggaatgtgctggatctctcctgaagccaacacaactcagtctcatccaaggcccatggcatattacctgggtatcactgccagttattcaggactcaaaagttctttcgtcatcgagtgatgagtcctgccacgactggggccttcctttcaaggcagcgggttcccttctggctgaagttattctagaaatgtcatcccggagcaaaggcctagattggaggcctcatgaatttgcctggtgccctatttgattgtggctgagctgttaaaagtcctgtttattttttctctcctctctaacagaaggaaggagtcactttcattgccaccagctatgctgccttgggttgagggaagggtggtgcaagaacttccttagctgaccccactggtgtctccctaggtcacatgccaccctagtccactggctgtaatcccagcctagaattaggatttgcctgggaattttagtccttgtgttctaggctccctttcaagtttacctaggaccctagagccctttagccagagatggtaaggcttgctgaaactcaggttccaactgctgggatggatgactcccctccagctagggctggtccaaatgctacctccatgtgtgggcactgactgagccctgcatgattttgctctctgctgtgacagggcagcatttagttcagtgccaagtcccccagtcactgtgctcttcctcccccaagtgcacagattccctctccacaccatacagctgctgcaggggtatgggggagggatgtaatcagcgatttatgactgtctctcccaccctcttcagtgcctcttttagtgatatgaagttaaaaccaggtactgtaattgctcacctaatttttggttcttatgatggtgctttttttgtgtgtagttagttgttaaaatttggtgtttctgcaggagggacaatcagtagaggcttccattctaccatcttgttccacctctattgtgatttttgatgagaatatggaataactaaattaagctgattagcatacccattacttcaaatattttaacttttgtgtgataagcatattagacggttactttctagcaatattgaaatgtacagtactcagttattagctgtatttagcatgttgtgcaatagatctcaaaataaaatcagatttatttattctatctaattgagcctttgtatgctttgactattatcttctgattctcttcaccattcagtctttggtaatcatgattctactgtctgtttctgtgatttcagttgttttagattccacatgttagtgacaatatgtggtatttgtttttctgtatttgacttatttcccataacataatgttctctaattctgtccatatcatcacaaatgacataatttcttcctttttaagggctgaatagtattccattgtatgtatatgtatatatatgtatgtatgtatgcatatatattttttctttattcattttctttatttatccatcccttgatggacatgcaggttgattccataacttagctattgtgaatagcgctgcaatgaacatgggactacagctaactcttcaacataatgatttcaaatctttcagttaaatacccagaatcagaattgctgggtcaaataatattatatttttagtttttttgagtgatctttatactttctctttcataatgtttatactaatacactttcctatcaatagcatgtaagggttcccttttctccacatcctcaccaacacttgtcttttctctttttgataacagatttaacaaatgtaaagcgatatctcattgtgtttttaatttgcatctccctaatgattagaaatgttgaacatttcttcatgtatctgttagctattcagatgtcttatttttagaaatgtgtttcttgcccattacttaattagattattggttttctttctgagaaagtttgtttgaatttcttatatattttggatattaatagcttatcagatatatggcttacaaatattttctcccaatccatagattgtctcttcactgctgttttctttgatgtgcagtagctttttattttgatataatcccgtttgtctttgtttctattgcttgagtttttggagtcaagtctaaaaaatcattgcccagaccaaagtcatgtagttttttctcctatgtttttttttcctacgaatgttatagatttgggtcttatgtttcaatctgtaatctattttgaattgagttttggatatcgcataagataagtgtccaatttcattcttttgcaggctgtcttttctgaaagctttctgaataagtgtagaacatgaaaacaggccccgtctcataagcagcccccagtgtttgaggagcaaagtgccctgtcttctggttggaaagcttccttcctctgtgagccggggttcagaggacatatgcatatgtatggggggggaggtggatacaaagtttgcctgccttttttttcttcatatattctctctttatgatttgaatccttattatgatctgagctgcagttgtgatagtttttggttgttttagtgccactcttcacttctgtcttgtaactattaagacaccttctaatgttattattatactgcttttttgtgggctgagtttttaattctatgggcattttagggaaatattagaaatgtcattccttaatgacatctaaggttggaagttagagctttggttttgaataataaatccgataagataaagtgtgaatcaccatgggcaaaaactcttcttttcttcagatatctaggcaagggaccatggggaatgaaacaaagagaagagctgaggagttaaagaagcagaaatgacatatgcaaacatagattgggtaccatagaacctaactcttgaccagggccagtgaaaaaaatagaatcaaatataattctgaagtagagatgtttgagtcaggattttctgaagagtgacatgttaataagcaacagagaacatgaaaaaggaaccactgggggactagatgctgtctttacttttagatgttattattttattttttggtgtttgttacatgttcaaaggtacatatgcatcctgaaactgaaaggcataaagttgtgattttgatataatttgttacctgtgaatacggtagatggttgccaaaattatgtagcataaataatataaacatgtggtatcatcctctgtaatgatactaatatgttgtgatttccaaaaagaatgatgatgccttatagctttgagttattacatatatgtatgtgtgtatatatatatatatgtctgtgtatctacatatatatattatgtgtgtatatatatttatatatatgtcttgtgatattgctttagcatttgcatttggcatgatcatttaaaatatttttaaatatgcaatgcatggccatggtataaatatccaggctataaaaaggtacagtcaaggtgtgtcaaagtcactgaaaggtatagttttccccagtcatgcagcatttctcttcacagatttcttgtttagttttgtgtaccttctatgtgtagatttgtgttacagtgagaaggagttgttcttcagcacattctttccaatttctaaataataattggtcattgtttgctcatctgtgaggtcagtttgggttatttatatttcctgaagaaagagagggttaaaggctagggtggaaaagtattgggtacctagtcggagtagggaaatgtgtcattaaggttctcccttgctcctcccatgatgaggtctcagcagagatgatgaaggactcagataaagagataagaatgaagtcacctgggctagaaatgccaatacatgtaagagcatgcctggccaaaggagcctgagaccttgactgggacttctctcagagacttcagtgtgttggctgtgcaccaagtctcatagaggaagggcaactttcccccatgaggcctgtcaggtacagattttgtaatggcctgtggtcaggcctgaaaagttgcataagtctttaattggaagcaagactcctcaaatccccccaccccaatcatgtttaattatatccgtgtatggtctagcttttgttgtttttgtttactgcttgtgtgtgtgtgtgtgtgtgtgtgtgtgtgtgtgtgtgtgtgtgttttgcatggcctcatctttcttcctataatttggaggatttctagcctgtgtttagcttctgtggtttcctctacaaatataactctatataatgcttggtttcctacttctttacagggactatattaactcttcagtataaacaatagcaaagttatttagtatattcctaactccacatgtcatctcctctctttctttttaaatagatctcctttcatctttttccctctagcttttttcttttgggaaagcatcatggcatgagactagaagtgagacttggacccacagccagaggttctgggtgcaacacatctctcagatctaatctagcacattgatttggtccaatgtaactgtcatatatggtcctgaattctgtcccctttaaatctgtaaaataataataacctcaatttatccatgtctttttttttttgaggtaaaatacattagaatctctgaaagacactgacagatttaaagaatggtataaaactgaggcattatcatcttatggctactggttatcaacagcttattaacaaaaaaatgaagctcttttttctgatagctgtagtttcaactttttttttaataataatgattcttagtgtattttgacacataatatggtaaagtaacctgtgctcacataggaatttgtttttaatatcactttaggaaaataaaaatcttagtaagtttaccttcccttgcttaaatatctaaaaatatcagccaggtagagaatagttgtactaacattctcaatctatcaatatcttgtaaatagtaaagttttggtatttctttatataaaaatttcttatataattaaaaagttaaatagattagaaaatacgttagaaaaatttgaaatactaaagtttaaaaacctccctgacaatatctattatggaattaataatgcatttaaaatttttgaatctacatatatttggaaaataatacaaatatgtgtaagctatattacagacaattgttatgtgaattagtggctctcatatttactatccggaatctgtaaaatttaacagtgacttgcttgatctctaacactaactttgtggaagaattagatttggtaaaggagttctaagaaaactggaactgtattgttttctggatagtttttaaaactgaacctgtgtgtgtcataaattaagacaccaaatgaaagaaacattaaatgaaaagtctgagtgactgcggaaacggtgataaacataagccaccatttgttctttaaaaacatgtctttgatatattagtcttttcctccaataaattattaagtgggaagattggcagctgctatgaacagagcatgtgtgtaatttaatgagcttttttttttttttttttgccagtagtttataacattttcttcatgggcaagaacaaaaaaaaaaaatctcaggagtatgaaaatataattgtgtgttaatttttctgttttgaaaagatgtaacttaatcagatttgtgacgtctccctcagccaagcacaaaggaataaaatgaataaaaatcattactgaagtcccgaaatgaatgactgttttctcttatgttgcaattgtagtgatgtttaaataccaatctgaaatacccgagagaacttcaacttgtattagagggttatataggtgtgtatgtgtgtgtgtacctttaaaccggggggataaacttattctacctttcaaagaagataaggccgggcgtggttgctcatgtgtgtaatcccagcacccagactccatctcaaaacaaaacaaaacaaaacaaaaacaaaaacaaagaagaaggtaaaaacatattcctaatccatatgtaagaaacaaatcagcatgagagcatcgtaatctttctaaaacaatgtcaagctgtcatggagtgtatgctccctgaagctgtctttggattcagtttctttggttttggtcacaggctcagggccttctcctaacaaacacatggcccatgtttaagagctaacaagaccaacagacaggagcctgtgacattcctgttaacacacaaaaacaattcagatattcaggatccagtcacttgatgaaagggcaggtggtaaactgggggttaaccttcctataaagtatggccagtggcagtagagaatccagcagtttggaagcaaatgaatttaaaatactatctggaaagcaaatcaaatcaggaccattgagctgttctttcttgactctcattgacctactttcacggtttacagactgctgataatataaaggaaattaaatgcctgcagtgagaaggttcttgatctggcaaagacccctcagagtgctccaaacattttatttaatttccaaaatttcttgatctgttatgtcattaaataaagggggagaaacagctagtcagcatgcatcatgataaaagccacttgaagctcacttttctgtcccacccaggactaaaaaatgtcttgcctttccaagtggtgctgaagcgtaaagcatacagttatgactttcactgctaggttgagataactgaaatgcaagtgcatggaaaccgtaaaatggatgtgagcattttctaataatatcaatatgattgacagtgattttgattaaggagatgttggttagcatctcacagagatagattagaagatttatatagatgagctcacttcttctaggtcagtcagaatgagctctggtttagataataagctcttgccttgctgaaaggctttattatcatatgacctccttttgtatgcaaatctgcacaaggctgtacccacttagtgcttccatctggattataagaagacaccatggaaaatgggtcctgttcacttaaactgagttgtcaggttggtcttcgtagatccttatttgcccccaaaattcacataaagaaatttagctattcacagagcagcaggtatttaagccaataaaatagagcatgggaaatcacagtacagtttgacttaacatgtctttaaaatgctatttgagtactgacctctactgtggtttagcacactctggatcttctccgcaaacattctaccgaactacttatagtgatagacacatcactgcttaataaaatctaaagaattgatagatatgctgtgtgcaaaagttgagtgaggtgattcccactaactgcaaagcaactgcaaccattttaattgtacggcacacagaagataccctgctctgaaagtggaagtaaaggttcttcatttgttttcattatgaagtcatgcccttagtttaaaaatataatctaagtaattaaaaattaggcagctgtcattgaactggatgacgggttgctttgaaggcagaaagaccttttccattgttgaatccctgtgttcgcagagtgctgtatttcctgttttgaagtagaaagatactgagtagaaaaaaatgagtatgggccttgggcagtgcagaggctgcaagggtgctggggtcattggacaatgcaaagaatatctgaatatgtattccatatctttatatgttttagaacatttaaaatatatattatatggctttacattgttagggagctcattgagattggggagtagttggtaggagaccatccaaacacattctatcagaacttatataaaaccttttttagacatgaacatttgtgctaggtgattaattaatgtgtggagattaccaacaaattttaaaatatcaacttaaacattgagtatataatactcataaatcataaatatatgggttgatgaacttttatagtattagcatacatgtaactatcatcaggagagagacctttggcagacccccaagaaactcctttcatgaccctatctaaaccaaagataaacactgttctggcttttattagcataggttagttttacttgtttgtgaattttatataaatgagatcatacagtttatatttttacatgagcgattttttcctataaaatcatatttgtaaaatgcttccatattgtcacatgttgcaatagttttattgtcattaataatgacagatatttgttaggaacaatccccaatacgtatatgaatgaaattgcctccatagagcatgtgtgtgtttagcttttgtaaatactggtagtgttttggttaactaagacataattcacatactatcaaacttataattttttaaatgcaacaattcagtgatttttaccatattcataaagccatatgatgatttccactaactctagaacactttcattactttgaaaagaaaccctataccaattaacaatcattctccattgcgtccccccattgtcaaccattaatttactttctatctccatggatttgagtatcctggaaattccatataaataggttcatacaataacttccttttatctcaaattcttttcctgttttatcataaaagggtattgaattttgtcaaattctttttctgagtttaatgagatgtgtggtttttgcactttattccattaacatggtatagatgattggtagaatcaacaaataattaattttatatattaaactaactttgcattcctggaataaattacacttgagcatagtgcctacttctctttatatgggctggatttgatttacttgtattctgttgaggatttttaaacatctatttataagaaataatgttatatagttttctgtcatgtctttagttgtggtatcagggtgatactgaccttatgtaattagcttgggaattttttttctcttctactttttgaaatagtctagaagcattagtattaatccatttttaaatatttggtagaactcaccagtgaaaccatttggtagtgggcttttatttatgaaaaggttttttggcattgtttttattgtttttattattattattactaattcagtatctttatttgtggatctgtttagattttctttttctcatttggtcactttcagtattttctgtctttctaggaatttgtccgtgttatctaaatttcttaggattttggcatacgaatatttagactattaaaaaattttccatttctttaagattggtagaaatattttatttcttattttagtaattttaatattcttgttcccttttgttggtcattgtagctatgagtttgtagatttgattgaccttaaagaatcaagatttgattatgattattttctttattatttcttccctattttatttatttctgctcaaatcattatttttttattctgttttctttaggtttagtttgctttagtttttctaatttcttaatgtaaatggctaggttattgttctgacatctacctttttaaaaaataatacagatattacagctgtatcttctctttatgtacctttttagctgaataccatgttttgatatgttgtgtttttgttttcattcatctcaaagtattttttcattttccttttgatttcttctttgacccattggttatgaaatagtatgttgtttaatttctacacatttggaatttcccaaagattgcttctgtattgatttttaattttagtccattgtagtcaaagaacatactttgtatgatttcagtccttttcacttactgagtttttttgtttgcttgtttgtttgtttgttttttgatggagtgttgctctttcacccaggctggagtgcagtggcatgatctcggctcattgcaacccccacctctcacgttctagtgattctcctgcctcagccttccaagtagctgggaatacaggcatctgccaccatggccagctaatttttgcatttttggtagagagtgtttttcatcatatcgggcaggctggtcttgaactcctaacctaaaatggtctgctcaccttggtctcccaaagtgctagaattacaggcttgcgctactgcacccagctaataagtctttttatttgtttgtttgtttttttaatagccaaacacttgttctattctggagaattgcttctatatacatttgagaagaatgttcagtctgctctttttggatggagagttctaagtctctatagtctcttaggtctagttatcttgttgtattgttccaatctcctatatttttgttaatcttctagcatagttattctattaaatattgaatatagtgtattgaacttgttctattgttgaattgtctatttctccctttaatgctgtcagcatttgctttgtgtgttgtgtggctctgttcttaatttcatgtttttatgattagtctgtcttcctaaggaattgacccttctattgttataagatgtttttctttgtttttagtaacaatattttcttcaagtctattttgttatatattagtagagtcacctcagctctcttttggatactgatttcattgtatatctttttgcatcctctttttttttttttttttttttttgagatggagtctcactctgtcgcccaggctggagtgcagtggcgcaatcttggctcactgcaagctctgcctcccaggtttacaccattctcctgcctcagcctcccaagtagctgggactacaggcgcctgccaccacgcctggccaattttttgttttttagtagagacggggtttcaccatgttagccagggtggtcttgatctcctcacctcgtgatccacccgcctcggcctcccaaagtgctggtattacaggtgtgagccaccgcacccagctgcatccttttactttcaaactatttgtgactttgattctaaagtgtatattttatagacagcatacagttggataattaaaaaaaaatccagtctgccaatctatgaatttgttaaatggtagaattaattgataattatgtggtaattacattaaatgtaaatgagctaaataatctaattattgagatggtaaaattggtttccaccattttactatttgttttctatatttcctctatatttttcattcctctgttcttctattactgccatcttttgtgctaaataagtattttctaacataccactttaagtccttattgtgtttttttgctatatatatttttgagttattttcttagcagttttcctggggattgcaactaacatcttgagttaaaattctctaatttagattaataccaacttaatttcaatagtttataaaattgtgtttctacatagctcctctcccatttatgctattattattacaaattacatttttagagattgtgtgctcatcagcattgatttttaaattattctattatggaaatgcatttaactaaaacagaaaaaggaattacaagaaacacgtacatttatcttgtcatttatatttctttatatggtaatcttaaccagtgctttttgttttatttcattatgtggattcatgttactgttagtacttttcatttcagcttaaagacttcatttagtaattttgaggcagttccactgtcaacaaactctctcagtttttgttgagctgtgaatatcttaatctctcattaaattttaaaagatagtcatttcttctttatttcttctttactgtagaattctaggctagctttttttttttcttttaaccttttgacactttgtgtatgccatcctattgtgttctggcctctgtgatgtctgttaagaaagcagctattaaccttcctggagattctttttacactatgagtcacttctctcattgccatcatgattctccctttgtctgaagtctttgacagtttgattatgatttgtctaggtatagattattttgtatatattatacacataaggatctcattcctgaatatatacaacattattattttctttcaatctttataactttctttttcttgccttattgcactggccagcactggcattataatgttgaatagaagaggtggtaatggggaccttacttttgtttttgatatgaaagggaaaactttaaatattttatgattaacataggctgggtgcagtggctcatgtctgtaatcccagcactgtgggaggccgaggtggatggatcacttaaggttaggagttcaacagcagcctgcccaacgtggcaaaaccccatctctactaaaaataccaaaaaattagctgggcctggtggcacacgcatgtaatcccagctacttgggaggctgaggcatgagaatcatttgaatcctggaggcagaatttgcagtgagccgagaccgtgccaatgcattccagcctgggtgatggagtgaaactttgtctcaaataaaataaaatacatattttattattaacagaaatatatagcttttatggacttggcatacattttaaaatcagattaagaaagttcttttatattttcctttctagctcaatttttgacttttatttatttatttttataaagaatatatttagagacagggtcttgctctgtcacccaggctggagtacagcagcatgatcatagctcaccacagcctcaaacatctgggctcacataatctttctgcttcagccttctagtaggtgggactacatgcccagctatttttataagcaataattttaacattttactattttttctcaccttttctttatactcttagtatattatgtgacattaaataatttttaaattttatttaaaaaatattgaattcatggataaagttgacttggtcaaaatttaataccccttttatatatcacttgatttaattgggtaatagttactaaaattttgtggtgattattatatgaaattatcttgtgaattttacttattgtaacacatttgccaggtttaattgtcaaggaataatggcctcagtaagtaacttgaaaattgtttccagcctgttttccagaatagtgtatgatccatgtaatttttacatagatgtttcaaagaatgccctaatgaaagcatttgggtctaaatttatcaaaacaattttaattaatgattcaatttcgttttacatgtagaaatttttaggctttctatttcttccttttcttggtttattatgttttaagggatttttctattccatctaaattattccatttctatgcagaaatttggtgcataatatactaaaattttatttttaatatctatcttaagtgatgttagtattcctgatactggtattttgtatcaaattatattaatgtttctattcattactatgtttaaagtactctgttactgtcttaattttgcttattataactttccagttataaaatttttatttgattttttaaacagatttcaattttctagtataattcacctctttttcctcttttttgttcatttattaattaaactatgttaaagtctatgtctgataactccaatatctatatcacttgtgggtttatttttattttatttgttttttatcttatttatttatttttttaagtggtattcctggtgtattcattttctaggactactgtaaaaatataccactgtctgggtgcagtggctcatgcttgtaatcccagtgctctgggaggttaagatgggaggatcatttgaggctaggagtttgagaccagcctgggcaacatagcgagactccatctccacaaaacagaaacaaaacaaaacaaaacaacaacagcaacaacaaaacatttaattagccaggcctgatggtgcatatatgtagtctgagctacttgggaggctgaggtgggaggattgctggagcccaggagttcgaggctgcagtaagctatgattgtaccactgcactccaagctcagctacagagtgagactccatctcaaagcaacaacaacaagaacaacaacagaacacaaacttagtggcttaaaccaggaaaatttattctctcatggttctagaggcttgaactccgagatcaagctgttgccattagttccttctgattgctgtggggaagggatctgctacagccctgtctccttggcttataaaggaccatcttctctctgtgtgtttatatagtcttccctctatatatgtgtctgtgtccacattttcctttttttaaggacatcagtcataccagattaaagcccaccatagtagcctcatttggatttgattttctctgtgacattttatcttcaaataaggtcatattccaaggcatggggagttaggaccccaatattattattattattactattattttggatgggacacgattcaacccataacaactgataaattttgattaaatgaaaatatttagagtctctggatgattctgttttacttcaaagagaattctctttagctttgatatggaattagaatagataaaattatctcagaaaatgggatgatcttactaaatacgttttttaaagggcttgtctatttttacatttccggaggcttcactgttcaatggccctgactgaaagccacgttcatttgccagagtcccaacacctgaatgtctgcttaatgacagtttctgttatcccagctggttattccaggtttgttataaatttgataggtttagttactttttagattcttagatttgtgtcttgatttccctcttcaattatagacctgcattactcatacattaatgaacatctcaagcatgagacacctagagttacagggtttttcttactttcttccccctgggatattggcctctcaagtcctgtctgctctggtagccctgaatctcaatttttatctcttccaaagactaataacagctttgcttagctcctctgccttttagccatcactttctccacaacatcattacttcttcttcctcattttatatgtgtgactaatatttcgaggaaaaacaaacaaaacacatgtctcctctcagtgagtttcttctttttgggatttgaatctttaattcctagtctttaaatagatttttctgcattttatccagctgttccattgttttatgggctattgaaaacaactcccattttagcatcaattttgataataaagcaaaaggataatatagcacatggatggtatatttgaagccacaggtaatatatacattaacatttataaatattcccctatccagaaaatacttgaaacttgagtttccagtagacattttttttttgcataacacatgtaaacattttatggtacatacttagacttaacatttattcattgtctatctgaactataaacttaagtggatattttgtatttttttctggcaatcttgctctctttagaagaatgcataaacaataatacaccagaataattatggtacaaaagctgattggagcactatggaaagattctaactaaaaattatacatggatatttttattatttaaatataagggaatggttttttaaaagttgatactctaaagacttaaaggttaaaattttatgacataagtgtggaaactttcatgataaatgtgctagctgaatttgaaagataggagaatatggatgtaatagaaactaatgtaaaggaaattaagtacccagtagatcttaaattctgttttctcttatatttatcacatacaacagaattaaaagtgcggaatattaaattagcgctgccagtgataaacttgagaaattgttctactgtgtagattagaagccattgacatgatgagtaagagaatggtatacaatgtagaggatggagagatacatttaaaatttatagcttttcctgtgggtcagagatgtggaacatgaaaaaatgaaacaaaaactctactgaaaaaggtactgagttgtggcttttggtacaacatttaaagagcttgcaagttgtcactttcattttcacaacaggaaaataccttaaaaactaaaaattatcaactcttcttagatccctcagagatttgaggtcagaaagcaaactgctaccccagtactagagagacagtcaggggaccccctacacccatgggttcatatccatggattcaactaactgtgccacaaaatattcagaaaaaaagggatgattctgccggtactgaacatgtacagacttttcctgttgttagtattccctaaaaaatacagcataaccaccgtttatatagcatttacattgcattaggtattataagtcatctagaaatgatttaaagtatttgggaagatgtatgtaggttataagcaaattctacagtattttatataaaggacttgagcatctgtggatttttagtatccaaagggagtcctagacccaccccccatggatatagaaaaacgactgtactagaaggaagcccaggactgtgaatcaggagacccagaagcagaagtcaccatatgaggccaggatcagtaggaacacatccgctataatcaaaaagtgatgtaggctcagtgtggactaacttgaaagtagccttgggggctcctcactgatgagtattacctacaggaaccctaccagattctccatgtgaagacaggggaaaaatcctttcgtgctttcagcaggagttaattatatagaagtatgcccagacctctgtaagcattagaaagaccagcccaaaggggaaactgcttttccagagcctaactgacctgggaaaagggaaatgcccagctcaggctctagaagactgagacatgattgtgggaatatagaactcttcccctcaaccaactcctcaccaccacatcagtggtgctcctgtgtaataaccagggactaagagaactacaagcctcagactctatttaagatggaatctctaggcaaacccaaagacaactgggtataaacagaaggacactagaactaacaccactgagacagccaccagtaagcacaatataacttctagtcagataaactcaaacctcacactaaaagcccaaataacagcttaacaataaagaaatagacatcatccaaactatgctgtcaaaccacaatggaattaaactagaaataaaaaatagaaggatagctttagaaatccccaaatatttggacattaaataacctatttctgggtaacacacacgttaaaggaatcagaaaagaaattacaaaaattaagcttcaatgaaaatgaaatttaaacctatcacagtttgtggaatacagcaaaagttgtgcttaaaggaaaattcatggaatttgatgcatctgttagaaaagattagagacctaaaatagataatctaagcttatatgttactaaactagagggagaggagcaaattaaattgaaagtaagtagaagaaaagaaatgataaaaattagtggagaaatcaataaaattataaaaaggaaaataataaagaaaaatcaatgaaactaaaagctgaaatcaatgaattaaaagatgaaataaataaaattgataaactcctagtgagattatccatgaaaaaaagaaaatacaaattactaatatcaaaaaccaaagatgttatccttactactctcatgaacattaaaatattaataaggaaatattttgagcaactctatgcccacatctttgataacttacttgaaatgggccaattccctgaagacacaatttacccaaacacatacaaggagaaatagacaatccaaataggtatatatcattgaaagaaattgaatcaataactaatgaccataaaagcaaaagcactagacttaggtgatctcactggtgaattctaccatttaagaaagaaatgatatcaatttactgcaatgtcttttagaaaatagatacagaacaattatggttaactgtttttatgaggccagcattatcataatactgaaaccagacaagggcattacaagaaaggaaaactatagcctagtatctcttatgaatatacatgcaaaaattttcaacaaagtatcaaattgagtctaacaatgtacgaaaagaattatatactatgacaaagaaggacttattccagataggcaaggttcgttcaatttttgaaaatcaattaatataatccattacaacaatagaataaaaggaaaagatggtttgatcctattaacagatgcataacaacatttttcacaaaagccaacacttattcatgatactaactctcagcaaactaggaacagaaaggacattcctcaacttgataaagaacactgtaataaaccttcaagtgatatactaaatcatgagaagctagctacctttctcctaagtttgggaacaagatgtcctctctctccattcttacctcaatactctgccagcaagcagtcctacgtaatgcaataagagcagaaaagggagttaaaatcacacagattgtgaaggaataaataaaactgttattgcttatagatgacatgattatatatgtagaaactcccaaagaattgtcaaaaaaatactcctagaactaatagccatttatatcaaggtttcaggatacaacgttaatatagaaaagtcatgtttccctatatatctacaatgaataattggaatttgaaattttaaaaacatatcatttacattaacaatccccaaaatgaaatacttagctataaatctaacaaattatgtgaggaaaactacaaaatcctaatgaaataaatagaaaaagctctaaataaatagatattccatgttttggggtagaaaaacttaacatcaacaagatattggttcttcccaacctgaatgttaggtttaacacaaccccaatcaaaatcccagtgttactttgtggatattaacaaactgattttcaagtttatgtggaaagacaaaagatccatgataggcaacacagtatggaagaacaaagtctgaagactgacattacctgactttaagatttactataaaagcacagtaattcccagagatagccccacatcaatacagtcaactgatatatgacaaaagaacaaaggcaaccatgtgggcaaataatcatctttgcaacaaatggtgccagaacaaatggacatccacatgccagacaatgaatctgggcacttaacttatacctgtgacaaaaattaactccaagtggatctatgacctgattgtaaaatacaaattataaaagttctagaaaataacataggataaaatctaggtgaccttggatgtgacaatgcctttttagagacaatatcaaaagcatgatccataaaagaaaatgttggtaagtttgacttcattaaagtacatttctgctcctgcaaaagacactgttaagacattaaaaagtcaatccatagactgggaaaaaattttgcagacccatgtctcataaaagacttgtatatgaaatacataaagaatccttaaaattaaacaataagaaaacacagagttaaaacatgggtgaaagatatgaacagatgtatcaccaaagaagacagatgcaaataagttcataagatgctcaacatcatatgtcattggaaaattgcaaataaaagcaacaatgcaatgcatctatatagctaatagaatgagtaaaatacaaaacactgacaataccaaatgttgacaacagtgtagagcaataggaactctcatttgctgctgatgggaattcaaaatggtacaaccactttggcagacagtttggcagaatcttataaaactaaatatagtcttcccacctgattcagcaatacatattaataaaaaaacagtttgattatgtatgtagacacaggagtttcacacaaaaaataagactcaaggagctgcccagatgattgaggcttatgtaccatataaggctaaacaaagcaaaagggatttggggattctgggcaggggaggccagctatgggaaggtgaggggaggaaatgtatggtggactagggttgtctcattatgcagataagagtctctccagttcagagttttctgggaaagtagctctctttctggtagggagacatctttacaaatgaaaatttcctttgtaaatgtgaatttccttttcaaaagaagacatttatactgaatttttaggcagttaaggagagataaagagcttttcctttgtcctctggttctcagttgcctttagctcaaaataatccatatgccaaagaggcctattttggggtgacttcttgtattcttcacgtctcatgaaatgaacctattattgtgaaatgaactaattgttttaaataaactgcagtggacttgttattgatgagccacattttaaaaatgggttggtgccagtttgggaaactgctgttctcagcctgtgctgcttctctctgcagagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggtaaatctccctggggtcttctagataaagggacccattgaggaatgcttggtgaccacctctggctccaaggcagctctctcaccctatgaggagaaggaactgtagtatcagataaacttacctgcaagagattttctaatatgattatactgaagaaaacattaaatatatttcccttattttacattatatatttaaaaggtatctgtgtgaggcagtcatgtggtcggagttaaagcataaatacatcatttataactttgtatcccccttgctcttttcttcctctctaaatgccttttacatttattgaactacaaacttgtattcaggaagaaatatcacaaactctgtattttcagggcttgtgaaagtgtgggcacaaattatgtgtggaatctgggggactgctggaaggaatgacttcctgatgagtgggcggacagattcctcctgccaggggattccttctgccaggggattcctttctgggtggtcttaggggaatgaaggagtggcagaaactgagacccccacctccatcactgcctgtgacaggagagaggcaggtggagcagtgagagagcaaaagacagctgccacttcttctgtgtgagtagaggtcagcgaagcagagcggacagccttgattgacagctcaggatgttgtaccgtgagccaccaaaattgcagttacttaagcacatttttaccttttctgcacctcattatagaaagtctggggtgcgtgctcctcagatttctggattctgaactagaagcagaaataagtggcttatattatgcgtttgcaattagattctgcgggagagggaaaattctaggactcacaggagacaaaactaatagccttcgccttcactggtccatgaacgttcattctctgttctgtttttataatgcttcagcatttgtttcttatttatgctttctaactttaagtgaaactaaacagaatgtctgcacctcattgtaaggactctggccccttttcccatctcccgtcttaataaagcaaagataactgaccaccccacagagacctgctggttgtagttaaacagttattggcatccgtggctaattgttggatcaatttttaatcggtgtttatctctgtcagctcctctttgttagtttttgatgaaagaggcgggtgcttggcaaaggctttaagctggcacttttgtttttcgagggaaacatgcttatgaaaaagctctcgttaatgtaggtcggtgctttctgtcattcagggcaattgtgtcttgatattcatctgtcttacaactttgtttttctgaattgttctaccaataaaagttatttaaatggtaaccaattaggaactgccttcatttcctttataaaactgtaactgattttgcagacagtattgctacttgctcttgtttctaagatgtctgcacacttttgcatctgtttccaaaggagttagctccttttctggaaacaaattttcttttctatatattttgggaatatttaagttatagaacaggcatatccattttgaggtgcttatcacaagatgtccagaaagaattattataaaataatggaaaataaagttttatctttcagtatttattccacatcaggtactgttctaagtattttacagcaaccatatgaagtagatgcttattcccattttacaaactgagaaattagacacagtttaattgagacacagagacacaggaaaactgagacaccagagaaattaggccacttgcccatgttcacatggctagtatttggcaaggttttactttgaaaccatataaaccagctccagggtacaagttcttgactaagacattactctgacacttagtttattcaggctgttagttgtataagatggaatttctggtggtattaacagttcagtcttatttttataaccctgggatggccaaagaagtggaaactgtgtggggttagtgcatgacttctctaacatggggctcctcctgctgcctggctttccattggtctggagttggactcaacatgtgtgcctcacctccaggctttcagaactcatagatatgggggtaatctttagacacatctgctgctcaccttagttgttttcttcaggctgccatctattttcattgtaacatggagagccaccattgtaagctctatgattctagtgcaagaccctctgtgcttgcggggaggctcctttgttcagccttacagtcccctctcctccctcccggggaccctcagagcccatgccatggctgagccagtccacctgtgctccacttgctggtcatttctaagtatggtcaaattgctcacttcctcaacctttcaaaagtttgatgaggtaagaataagatgccacttcataaagcttgaacttaggtttgacaagttaacaatgatttccaaatttcccatgatttacactgcacaaaactgtgcagtgtacatatttgagcctcaatttaattaaccttgtaaagcatgttatattaagttatatcacttggttattaccaaatgatgcaagagatgagggctacatagtctgggatgctagagaaaatgtgtcagagttcatcatgctaggtagtttcaatgttagtgtcataccataacaaacaaccagtacttctaaatgggaagagatttggcaaattctgtgttttagttttccctggtatagaagaggtatggcccctcatcatcttagttttgttaatacctgcacattcctaccagggactgtccctactgtgtcttgcttccccttatcttctgtaaagacatgacttttatatttaagttttcttccattcacacagtcagtttagctagaaggagctagaatttataagatagtaggaatggggacaggaggtcatcttcagaggaagggccaggataaacatttccatctgaaatccttggttccctttccctactttacgactcattttggtctttaatctcacagaaatgttgacctggccattatgtgtgctagtggaaacactttggctttggagtctgatagatgtatgtgtgaatctcagggcaatttattttggctccagtgatgtttatggaagtcctactatgtgccaaacatgaataaacactggggatttccatcccagtgcatatcccattgagattcatcccaaaaccaatgcatccgcaaacgaaagcatcccaaaacaaatgcatcccagtaacttgcctgaagtatggtacaatttctagagcttcatgagagaaaaataccaaacctcagagagagattctgtgaacttttgacattttgggattttaggcagtattttgccaactgagattgctaaggcattgcttttgccattactttgacagtattgctgagtgcagaaaagactacagcaaaatacttcttattaggctattttcagttattttctgacaacatgacattcagaaaacattggatcaaactaatacatttgttcctgtatactctggaatctttcctatggttaaccaatccagaatttgcaggctgcaatatttaaccttttgtgaaattgggaaaacatgacatatgtttcctaacttcataaaaatatgcaataataatttggcaagtttattcaaaatgtaacttgcattctcaggtgcatttctccagaaccaggtacatatattattatttttatttcatttgtcagtttatcagttttcttttatgtatggctaatctttgaataacatggatgagagtaactaaacatttctttctaatacatgcacacatacacacattttcattctctttttcttgtaatatttatagatctaaaaataaccaaaacaatcattatcacaatttgtcatttttgccagcctcaccactgttagtacagcaggtccccaaataacattgtttagttcaacattgtttcattacaatgatgagaaaagtaaaattgattttctgccaggaccactgtcggagaggagtttgcacgctctctccatggctgcatacattttctccaggtacacttgttttctgtcatgtcccaaagctgtgtacattagtttctttggtgtgtctatattgagcccatgtgggtgagtatatgtgggcgtgtgagtgtaccctcgatggaatggcatgctgtccagggctggttcctgccttgtgcactgagcttccaggatgggctctgaccaccctcaaccctgaactggaataattgggtaaatcatgtttttgttaatctttcacaaatatatgtgtagctcacatttatttcagtgtttgctattagaagtttttttttatttagaagtttggagatgtttttgtgaccagacatatgacataggaacttttatttctaccaatcagcttatggtaaaattggtttcattaaatgttgattcggttaaagcggtctccaagaacatatagatgacattaagtaaggacttttttccgacagataaagctttctaacagggtctatcatgctcttagttttcttctcttttatggggacatctgcctccttttccaggaagcctccctggtttccttccttcatctctcatatgagtgtttatctagcactgatttacacttcttggccattcttctgtgagaaaaatttggacgaagctacatgactacttctgctatctctttaattcctgaaatgccaggcatttatatttcttcatttataagacccttcctttaatatttgtgtttgtttgcttgtgatgaataaaacgttttgttttgatattttaaaattcacttaagtgaatttttattcaacttgtgataattaaaatagttgttctgaatggagccaggaaaaaggatgattcatataaaacattctggggaaaatgactttactttcaataagaccaactactggccttgagaagattttcttaggcagatagcaggagattaaatatttcatctttatatatcttttaggccttgaaatctgcatttcctagaattatactattttaccataagaccagtccttgagcctcttcattcatttgcaacatattttgaagttgcacaagtaaagccatataataatttctgttgaaagattttactggggggcataatgattatcctaatatttgtagaggttcttaatgcttcattatcattattgttattatcctaacttttatgtacttgtcaaaaagagtatacacattagtttatatttattcagttatttgggatgcacaattattaaccaatctttttagtcctatagaatttttccctcttctcctaaatttgaattaaaatatgatcttggtcaatttggctatatgattatatctaaaaaatgaatctatattaatacttctatggtcataagagttaaataaaattgtttggaaaatttttaaattatgctaagttggaaacaaaaaaattgcttaccttggaccccaggaagaattaatccagcataggagatagaactggaaacagaaaatatagtgtggtacaaattacagtgggaaatgctaaataaaagtgttctatagacacatataatacacagaagaggtgacacatatatcacacagaagaagtgacaattattttttctgatgagagatatgggctgggccttctaggatgtgggacaagctggcagggtggaaggcagggaagaagaaagaagctgtgaaccgcaggctcttgggtacagtctgaactctcctgtggctggaggggtgaggtttgacaaatgctgccaccatccttgggtcttggcaaagtggttttcagcagttgcaaataagaaatatttcccattctcctccccatctctagttactttataaaccaaactctgagtttgcaaacattaacagtggcttctcaatgtcaaagggatatttctttccttgtgttaatattgaaaattccctccagccataaaaatgaacaaaatcacatcctttgcagcagcatggatgcagctggaggcatcatcctaagcaaattaacacaggaacacaaaaccaaataccgtgtgttctcgtttataggggggagcttaacattgggtacacatgggcacaaacatggcagcagtagacacgtgggaatccaaaagtgcggagggagggcgtgtgacaaggggtgaagaactacctgttgggttccatgctcactacttgggtgggatcattagaagcccaaacctcagtgtcacacaatatacccatgtagcaaacctgcacatagactccctgaatctaaaataataaagaaaattttctgcttcggttgtcttctccctttaagttttgacaccgctattagtttcattcccatttgtttccttctcagttttctttttggcatacccttctctgctcacctcaacatgcttatttatctggacccccaaccttgagtgtgtttcttgcccacccttctccctgaactctagatgtgattattctgaccatcacttagatgtctccagctgcagaaaactcccacctgttcactctcaattactgcctgtatggtaaagggggatgtttcaggagatgtacttgattgtatgtgtgaaggtcggcagggttagtgggaggtagaagcaggaatgaggactgagaccagctgtctggtgggcactttggtgaatgctggtgtgcacatggacatgcctctcttccaggttgctggagacctcatcaggcgcttacacctcgaagcccacgcggacaaacctgtggccacctacagtgggggaaccaagcggaaactctctacagccctggccctggtggggaaacctgacattcttttattggtgagtagaagaatgtcaatatcttggagtaagatacatattgcatattgatttataaactgattttaagggtttttctgggaagtaacttcagaacttgcaaagctggttctacaaactagtaaactgttttgccataagccagcatttcccaaatgtcatttgtattttacagaaataaaacatttattttttgctagattcacttatatttgtcaagctgaaaattctataaaattttaacattaaaacagtgttttaaaagattattagaattcatctgtaatctgaaaaccaattatgttttcctctagaatattgcttttatgtctttttctgtgtgtagatgtatgtttatcacagcagtagtgacacctgtcatggtgaatcttaaagatgggtgttgagagtgaaggatggatatgatgttgagagtagggaagaaaactccagcaagagggtagagtatatgcaatggtcttgagacagggtggtctataatcaatctgggaactgcagttaatttgatttgaatgaatcaaagcattaattggaggcaacaattgtcaagaaatggagttaattatcttgcatttcataaaacagctataactgttaatacaagtaatgccattgaaagaataaataaaggctattgttacatgccataaattggattctaatcagtagagtgcatctttggacttcacaccagtagagagtctgaggggtgtcaaaaagtgtggaaaacaaaacagattcctttttttctatctttcttcatcaaatgaatacacccttttagtggggtagtaaatggggattgagaaggtctgtgtgggaaaatggtctcatcgtttgctggttgtctcctggaaactcacctgaatattctttttaggtaccataaatttgcttttgcaatgtccaaattcctagactattgtatagtttcatattccagaatctgataataaaaactaccatttgcacaatcctgaagtttacaaattacattttattttcaacatgaggcaggattatgttgagtagttaacaagacgtgggcattcattactttctgtggaatttccctttgcccagcctcttacaatgcatctccttagttgaatgaaggggcctctgctctgtagccatgacctgctcactgcagaccctgacatgcttttctttgatacatccttgctctcagctttccttggatgcccaaacctgtgacagagtggtcaaggtggggactctggagtctgactgacaagctttgaattttgcttctgcagctgcccaacacttggccttgtatgttctatgcctgtttccttctcatctgaaaattttcctgataatagtgtctgtctcatggagtcattgaaagcagtaaataaaataaactacattaagcatatagcccagtgtctagcagatggtaaaccacagtaaatattcgtgactatgatgatggttactgttcagagcaataggttaaagagatttgttgccaggcctttggagttctcaacagagagactagaagtgattctcagagctgacatcaaggagggaatcaggaaaacgtaaattacacatacaactctcataatgagcattgcatgatcacaccttttatttacttatttttataactaatacacatatattgcttgatttgcagaaaagactagatatttattttcctgttcagtgcttctccccctacacttactgcttcccatctgtttctttctttatggaagtttatgaacctaagctcttaagaaatatgtgtttagtactccctggctaataaaagcacagaaatacatcttacagtttggcgagatttctctagaagtggttcatataaggaatactttggtgtctattgaaggagaaagcttcaagttctaagaaatattaatttatttgatgttgctaaataaatgaagcctttttctgctatcatatgtcttcctaggggatatcattccgaaattttatggaggttgaaaattcattttagaaacatcagggttggcttacctagccagatcatggaggagaaccaacctgacatgaaaatatagcccaattcccctcctctcagttttatggaagtataattaactgataaaaatggtatctatttaatgaattcaacatgtgttttgatatacataaatattctgatgtgttgactacaatcaaactaataaacatattgatgacatcacataattgccattttttcccctgtatgtgatgagaacacttaatatctaccctcttagcaaatttcaaatatgtaatacagcatcgttatctacagtccctctcttagttcactgtgctgctataacagactggataatttataaagaacagagaacagaaattcaggttttggagtctgggaagtccaagatcaaggcactgccaggtccaggtgtctgctgagggtgccaaccctgcttcctgaaacctgtgccctccagaggggaggaataggtgtcatcacaaggcaaaagtcagaagggcaaaaagaggtgaatgtccttcatcaggtccttttataaggtcacttaatcttataaactcattcacctcccaaaggtcacacctctcaatactgtttcattagggattgagttttaacatgaattctgtaggggacaaaacatccaaactatagcagccctatatcctgtatattaggtctccagaacttgtttgtcctgtataactgaaattttctgccctttgacaagtatctccccatttccacagcctggcacctttctactctctcttcctatgtgttcaactttttaatatttcactaagaagtagtgtttttccatgcatggcttatttcactttatgcttggcataaagtcctccagattcacttatgttgttgaaaatggaaggatttccttatttttcaggcagaataatatttcattacacacacacacacacacacagtgagagagaggagagagagagagacaaggaaacagggagagagagagaaagagagagagagagacatacacattttcttttcccatttatacacttagggatgcttaggttgtttctatatcttggcttctgtaaataatgttgtcatgaatatagcactgcaaatatcccttccagatattgattttatttcctttggatacacacacagaagtgagattactggatcagtggcagtagtatttttaatttgtagaggaacctccacactgttttccataatatgtgtacatttacatttccaccaattgtgtataagggttcacttttctccgaatccttgccattgctggttatcttctgtccttttaacaatagccattctaacaagtataagatgatatctcattgtggttttcatttgcatttccctgattattaataatgtcgaacatcttttcatatacctattggccatttgcatgtcttcttttgagaaaagtctgttcaagttttttgtctatttttaattattattatttgctatttagttttacgactttcatatataggatgtaaccccttattggatatatggttgcaaatattttatcccccgctgtagtttgtctgctttgttgatattttcctttcttgtgcagaaactcttttcgtttgaaatagtcccactttatgtttgcttctattttatgtgcttttggtgtcatatccaaaaaagaaacaagcaaaacattgccaagaccaatgtcaaggagctcttctttttttttttctacaagtttcatggtttctcatcttatgtttaaatctttaatacatgttcagttgatttttgtgtatggtgtaagataaggaccgagttttaattttttgtatgtagatattcagttttcccaaagccatatattgaagagactgtccttttcccagttttaatttcagtgtatttgtcaaagattaattgactatatgtgtgtgggtttatttctgtactgtctattcttttctatgaatctatacatctgtttttatacaagtaccatactttttaaattataatagcatagtagtatattttgaaaataggaaatgtgaggcctccagcaccattcttcttgcttactttctttagctatttgtggtcttttgggttttttaaatataaatttcagtattttggttttctatttcagtgaaaaaatgacaatggaattgtaggaatagcactgagtctgtagatcgctttgggtaatatggacatttaaaaatattaattctttcaatccatgtacatggatagctctccatttatttgtcttcaatttctttaatcaaaatgttatagttttcagtatacagatctttcacttcctttgttaaaattatgcctaagtattttattcattttgatcttattgtaaatgaaattgtctaaaatttccttttctgataacccattgttattttatggaagcactattgatatttgtatgttgattttgtatcatatgactttattgcatttgtttattaattctaatggattctttggtggagtctatagtgttttctgtatgttagatcatgcttttgaaaagatgattttacttcttttttgatttggatgccttttctttgtcttgactaattgctctggttaggacttctagtattatgttgaatagaagtggctagagtgggcatccttgtcttgttcttcttagatttgaagtttttagcttttcactgttgaatatgatgttagttgtgggcttatgatatatggccttttattcttttctatttctgctaactttgggattagttcatttctttatccagtttcttcaattgcaaaggtaagatatttatttgaaatctttctttttttcttaatgttgatgacttcttcctcaaatctgcttttacttcatcccataagttttgttttgtttccattttcatttgtctcaagatacatgtattttttaaaattttctttttaatttcatttttgacccattggttgttcaggaacatattgttaatttacacatatttgtgaattttacagttttcctccttattaatttctagtatcataccatggtggtctgaaatgatactggatatgatttcaatttttttaaaattgtttagacttgttttgtggcctaatatatggtctctcctggagagtattttatgtgttctggagaagaatgtgtattctgctattgttggatggaatgttctgtgtatggctgttaggtccatttggtctaaagggtagttcaagtacattgtttccttattgattttctgactggttattcaatgtatcattgaaagtggagccttgaactcccctattattattgtacttatgtcttttactcctttcagttttgttaatatttgcattacatatatagtactctaatgtttagtgcatatctatttacaattactcttttatcattttatataaattgaccattttatcattgtatttttctctttttacagtttttgacttaaagcatattttgtgtgacataaatatagataaacatgccctctgggtcatcatttgcttggagtatctttacctattgtttcacactcagtctatgtgtatccaaaaaaactgtactaagtctcttgcaaacagcataagattggatcttggtttttatccattcattcactttatgccttttgattggcaaatgctgtctatttacatttaatgtaattattaataggtaggatcatattcttgacattttgttaattgttttctggctatttttaaagttatttattcttttttttcctctattactgcttttcttttaatttgataatttttttttgtgttggtatgttggtatgctttgattcatttctgtttttttttcttttgtgtgtgtgtgtgtgtgtatgtgtgtgtgtgtgcatcttctataggttttttatttgtggttaccaagaatctatataaaacatcttatagttacaaaagtctatttttaacctgatagtaactgaacttatatcacattaaaaaaaaactacacttttgcttccaaccatctcattttatgttttagatgtcacaatttgcagctctttatattgtatttccattaaaaaattattatagctatagttatttttaatactttgtgttttaatctgaatattaccattataagtgatttatacaccaacattaaagcattaaagtatgctgaatgtggctgtatacttaactttactgtgagttttataatttcatgttgctaattagaatccttttattttgttttgaagaacccctttagcattttttttttataagacaggtattgtgtcaatgaactctttcagcttttgtttgggagcatttttttttttataagacaggtattgtgtcaatgaactctttcagcttttgtttgggaaattctttatctcttttttatctctgaagggcagctttgctgggtaaagtaggtaaagtatttttatttggcaggttttttttctttcataggcccactctttcccagtcctgaagatttcttctgaaaaatccactgatagccttgtggatgtatgtcatgagccttttttttcctcttgttgctgtgaaaattctgtttttcatttttgacagtttgattattgcgtatctcagtgaataatttgttgggttgaagctatttgggaacttttaagcttcatatatcttgatgttcaaatgtctatctctttatccaaatttgggaatgtttcagccattatttatttaataagcattctgctgcccctttttctcaccttttttattttgtaaatctcatattgtaaaagttaggtctctggataatgtgccataaaccctgtcaggctttctttgttcttcttaattcttttttacttttttaaaattttccttgactggataatttcaaataatctgccctcaagttcacagattttttttatctgcttgatcaaatgtgcttttctctattatattttttatttcattttatttttctgcgccagtatttctatttggttctttttttttataattttgatctgttttttgaatttctctggatgaggtgagaaagaagtggggctcctgggtagcatgctgcatggctggaggagtcaggccctcactcattgctctctcacattcccctatcattctggctttgttgagcagagtgcaacaaagccaattggagaggtgtcttttagagccagagcagagatttttctttcacctggggtctggcctcccatgtcattgtgtatatttctatttgtgtttttcaaatgctgattactctgtgttgcctttccttcaggatgagcccagctctgggatggatccctgctctaagcggtacctgtggcaaacaataatgaaggaggttcgggaaggctgtgctgcggtgctgacctcccacaggtgagttccagtttctcttgtagccatttcctgataagactgagtaacaaaggttaagaagtgcatttaggtacctgcacagtgttacacatggacatttcttaatctttacaacacaataatggtgatattattgttagccctcattgtataaattgagactgaagccatgagggattacgttatataaccaagtttacatagcaaataggtggcagagctagaatttgaacctagtgttctgtgtccaaagatgatattcttgcctcatccattgctactgttcaaggatgagtgctagactaccattttcaggtcttcctgagggatctttcagatcctttccatccaaggcctattatttcagcaggtagaattagctgaactaaaatacttaacaggttactgaatctggtttaacattttctttatcacagaattaagtttgtaattagatttcaaaaccattggcttctttttaactttctaatacactgttctagcccacaaagaattacaaatatagatttcataaaacctacttatggggagtgagcaatatgatttaactaatacaaattctaatgatgtaataaagaccaggctttaatgtttagacttgttttgtctttatgtttaagtaaaatatactgtgaataagatgtcaagagctgccaaagatctcacattttgcccttttgcaagctaacaaatttagcttgatacagttttatggatgttgacagaagaaatgagacttctgggtcggagatgaaagactttattgctcacagcaagaacagtagccagagtgtcagcatggtttctcattggttccctaaaccccagtttctattggactaatggatgcctgcacacagaggagaggaatgccaaatctggtgaaattactaccttataacatctgataaggaagccagcccttcgtttgggaggaggtgtcgcttcttccatggttgtttgctactagcataactttgagaaatggcccagttaaagagcagttagggccttatattcttggaattcatggcaagacacgtaggaacacaagggacccatggaaacatgcttcccaacagtctaaatcattcagtctatgcttgagtaccccagctcttgttaccaggagtgaaatataaagctagccctatcatttgaaacgtgagatttctgagaggacctcaggagactttactgattactgcagcattattagtttacgtaaaaatactattaaatgctataactcagcatgcataatcctattacacataaatcttacagccatttcctgtaacaagtgttactggctgcaaagccaatgtattgtgaagaactcagccattcacacatttctcacattgcttcatgtcaaagtagacttttcttaattttctatctctgggctctttcttttttaaaaaaattcattcactgataggtttgtctatactgcttaacattccccaattttcactgccagactaaactttacactgttgtttttttaaatgccattttctgaagtataatttacatttgatataacttaaccactgtaagtatggaattctatgattctttagtaaatttatagacttgtgcaaatattaccataaataagccttagaatatttgggtcacctcccccaaattttctcatgcttactttcagttaaattagcatttgaggctaggtgccgtggctcatgcctgtaatcccagcacgttgggaggccaaggcgggcggatcacgaggtcaggagatcaagaccatggagaaaccacatctctactaaaaatacaaaaaattagccaggcgtggtggcgggcgcctgtagtcccagctactcaagaggctgaggcaggagaatgtcatgagaccgggaggtggagcttgcagtgagccaagatcgggccactgcactccagcctgggcgtcagagcaagactccgtctcaaaaacaacaaccacaacaaaaaaattagcattcaaaacctccacctaggaaaacattgatggctttctgcctctgtaaatttgctttatatggatatttcattaactgaatcatataatcagtagtctgctgcatctcttttttttatttatcataacactttttttttttgagacagagtcttgctcagtcacccaggctggagtgcagtggcacgatcttggctcactgcaagctccgcctcctgggttcacgccattctcctgcctcagcctcccgggtagctgggactacaggcacctgccaccaagcctggctaattttttgtattttagtagagacggggtttcaccgtgttagccaggatggtctcgatctcctgaccttgtgatccgcccgcctgggcctcccaaagtgctgggattacaggcgtgagccaccatgcccggcctatggcaacacttttaaaggctatccattgcgttttatgtcaataggttgctccttttcattccaaacggtatcccattttatagctataccacttttatttatccattcaccagttgataagcatttgggttgtttccagtgttttgctattatgaataatatgttatgaacagtcatataaatgtctttgtatgtatagacatgttttaatttttttagatttttctgagtcaagttgctagattgaatagtaagttgtatttgagactttaagaaactgcagagttatttcccaaattggccttatcagtatatgttcccagcaacaatgatgagtctcctttattccacatccttgtcactactgtctgtcttttttcattataggcatcctagtgaagtggggttttaattcacattttcctaaggactaacgctgttagaatcttttcatgtgcctattggttatttgtattacttctttagtgaaatttttattccaatatctcctccatcctccattttttaaaaatggcttgatactttagaatagttttaggttcactgaaaaattgagaggaaggtacagaaattttttaaatccctccttgccttcacacatgcatatccttccctattatcagcatacattaccagagtgatacatttattaaaattgatgagcctacattgacagcacattaccaccccaatccaatttacatagggttctctcttgatgttggacattttatgggtttggacaaatatctaataagaatccaccattatagtatcagatagaattgtttctctgccctaaaaattttctgtgttccacctattcatctctccctcctgcctaacccctggtaaccactcatctttttactgtctccatagttttaccttttccacaatgccatatagttggaatcatatagtatgtagtcttttcaggttgacttttttcatttagtttctcccatgtcttctcatggcttgatagctcatttcatttcagtcctgagtcatattccactatctggatgtactacagcttatttatccactcatccgctgaaccacatcttggttgcttccaagttttgacaattttgaataaagctgcttaaggatccgtgtgcagttttttgtgtgaacatattttcaactcctttgggtaaataccaaggaatgtgattgctggatcggatggtaagagtatgttaatttttgtaaggatcctttatatttgaattgttttttatctattatttttgaattgtaatagttctttttatgtagcagatattcctatattctgaatagaagtcccttgctggataaatgatttgcaaatatgtatttccagtctatggctgtctttccattttattaataatgtctttcgaagtgcaaacattttaaattttgattacattcagtttatcaatttatttttatatggtttgtgcttttggtgtctcatctaagaactatttgttcaaatgaagtcctaaagattttcttctatcttttttttctaaaaattttagaattttggctcttatatttaagtctttgatctatttcaagctaagttttgtgtatagtatgagaaaaggatataaattcacttttatgcatgttaatatccaattatttcagcactcttccttgaaaagattatcttttatcccactgaattgtcatagcacctttattatattatttattgtatgatttatttttggactctcaattattatccattgatatgtatgcttattttctcacccaataatatcatgttgattatggttgttttctattaagttttgaaaacagtaagtgttattccttcagctttttccttctattataaaatttttcattatcttgaaatatttttcaatttctcttgtgattacttctttgacccttagtttatttagaagtgtcattcaattttcagatactgggagatttttaagagatttttttttctgttattcatctctgatttaatttggttgtcattagataaaataagttgtatgatttccatcattttaaatttgttatgactttttaatggcctaccagaggggttacagttttttttttataaaacaccatattttaattgttttttatctattatttttgaattgtaatagttctttttatgtagcagatattcctatattctgaatagaagtcccttgctggataaatgatttgcaaatatgtatttccagtctatggctgtctttccattttattaataatgtctttggaagtgcaaatattttaaattttgattacattcagtttatcaatttagaactagaaataccatttgaccaagcaatcccattactgagtatttggttttgcaagtcgtatggtgtgtactgcagtatccaactccactgtgtagtgtgaaagcttccaccagtattaggtaaatgcataattgtggttgtattccaataaaattttatttgttcctctcccccatcccccacaaaatggtggcaggctggatttagccaatgggctgcagttttttactccaggcttaacatatggtctatcctagagaattgtctatgcaaaggaatatgtattctgtagtagttggatggaatattgtatatacagcaagtcagcaagttagcttgacagtgttgtttaagtattctgtattcttgggaattttttcctgggtattctatcaattactgaaaataagatattgaaatattcaagtataattgttacatttttcttttccttctttagattctgtcagtttttgcttcatatatttggagtctgtgtagttaggtgaatatgcattcttaattgctatcatactaatattttgactttcttatcattatgaaatgtctctgttttactctagcagtatgttttatcttaaatcctattttgtttcttaaaatagccattgcctctgtcttttggataatgtttgtgtggtatatcttttcatattcttttactttcaaataatttgtgtctttgaataggagtgtttcctatagattgtgtatagttggatattgtttttttttttcccaatctgacaatgtctgccttttgtgggaggtatttaaactgtcccacatttaatgtaattattgatatggctgaagtaacattgactgttttgctattttttacataatgtctcctgtgtttcttgtatctgtttctacttggcagccttatatattaaatgaataatttgaagtatactgtatttaatgttttatctattttttttagttatgttcttactggctagtctaaggatgatagtatacgtcttgatgctaacttaattctagaaaagtgttgtaatcttgccctaatatggctctatttcctccctttttctttgtgctattattaccatatatattgcattttatatgctataaatccaataaggcatattttaagtttcactttatacacttttaaatcttttaaagaagataagaaaatatatcaaaaagacatatccacagtcttaaatagtaatccatacaattgtcatttctgacgcatatctgtccatatgaaaaatgtgagaaaattttggccattatttactcaaatactttttctggtcctatctatctttccttttcttttggtcttccattacgtgtatgttgaaactctgatcttatcgcacaagtctgagttcttgctcattttttttagtcttgtttttttctatttttggattggataatctttattgatctatgtgttcactgactcctctgccattttgaatctggtgttgacccctctagtgaatttttccttaatttcttgtaatctttaactgatttattttttttataatttttatccccttcttcagaatccccacttactaatgtggttgtcagacttttctttaattctttttattttttattattatacttaaagttatggggtatgtgtgcagaacgtgcaggtttgttacataggtatacatgtgccatggtggtttgcagcacccatcaacctgtcatctacattaggtatttctcctaatgctatccgtcacccagcctcccacccccgcaacaggccccggtgtgtgatgctctctgtgtccatgtgtcctcattgttcaactcccacttatgagtgagaacatgtggtgtttggttttctgatttgtgttactttgctgagaatgatgatttccagcttcatccatgtccctgcaagggacatgaactaattcttttttatggctgcataatattccatgatgtatatgtaccacattttctttatccagtctatcattgatgggcatttgggttggttccaagtctttgcttttgtgaacagttcctcagtaaacatatgtgtgcatgtgtcatcatagtagaataatctgtaatcctttgggtatatacccagtaatgggattgctgggtcaaatggtatttctagttctagatccttgaggaattgccacactgtcttccacaattggtgaactaatttacactcccacccacagtgcaaaagtgttcctatttctccacatcctctccagcatctgttgttttctgactttttaatgatcaccattctaactggcctgagatggtatctcattgtggatttgatttgcatttctctaatgaccagtgatgatgagctttttttcatatgtttgttggctgcataaatgttttcttttgagaagtgtctgttcatatcctttgcccactttttgatggggttgtttctttttttcttgtaaatttgtttaagttctttgtagattctggatattagccctttgtcagatagaaagattgcaaaaattttctcccattctgtaggttgcctgttcactctgatggtagtttcgtttgctgtgcagaagctctttagtttaattagataccatttgtcaattttggattttgttgccattgcttttggtgttttagtcatgaagtctttgcccatgcctatgtcgtgaatggtattgcctaggttttcttctagggtttttatggttttaggtcttacatttaagtctttaatccatcttgagttaattttcctataaggtgtaaggaagtgatccagtttcagctttctgcatatagctacccagttttcccgacaccatttattaaatagggaattctttccccattgcttgtttttgccagttttgtcaaagatcagatggttgtagatgtgtggtgttatttctgaggcctctgttctgttcccttggtctatatatctgtattggtaccagtaccatgctgtttctgttaccatagctttgtagtatagtttgaagtcaggtagcgtgatgcccccagctttgttctttttgcttaggattgtcttggttacgcgggctcttttttggttccatatgaaatttaaagtggttttttttttccaattctgtgaagaaagtcagtggtagcttgatggggatagcattgaatctataaattattttggacagtatggccattttcatgatattgattcttcctatccatgagcatggaatgtttttttcacttgattgtgtcctcttttatttccttgagcagtggtttgtagttgtccttgaagaggtacttcacattccttgtaagttgtattcctatgaattttattctctttgtagcaattgtgaatgggagttcattcatgatttgactctctgtttgtctgttattggtatataggaatgtttgtaatttttgcgcattgattttgtatcctgagactttgcttgagttgcctctcagctttaggagatttagggttgagatgatggggtttgctaaatatatagtcatgtcaactgcaagcagaggcaatttgacttcctcttttcctaactgaatatgctttatttctttctcttgcctgatagccctggccagaactttcaacactatgttgaatagtagtggtgagagagggcatcctcatcttgtgctggttttcaaagagaatgcttctaggttttgcgcattcaatatgatagtgcctgtgggtttttcataaataatcttattattttgcagtatgttccatcaatacctagtttattgagagtttttagcatgaagggctgttgaattttgtcgaaggctttttctgcatctattgagataatcatgtggttttcgtcgttgattctgtttatgtgatggattatgtttattgatttgcatattttgaaccagccttgcatcccagggatgaagctgacttgattgtggtggataagctttttgatgtgctgctggattcagtttgtcagtattttattgaggattttcgcatcaatgtttatcagggatattggcctaaaattttctttttttgttctttttctgccaggttttggtatcaggatgatgctggcctcataaaatgagttacagaggattccctctttttctattgattggaatagtttcagaaggaatggtaccagctcctctttgtacctctagtagaatttggctgtgaattcgtctggtcctggactttttttggttggtaggctattaattactgcctcaatttcagaatttgttattggtctattcagggatttgacttctttctggtttagtctttggagggtgtatattatttcagtaatttatccatttctcctagattttctagtttagttgcatagaggtgtttatagtattctctgatggtagtttgtatttctgtgggatcagtggtggtatcccctttatcattttttattgcatctatttgattcttctctcttttcttctttattaatctggctagtagtctgtctattttgttgatcttttcaaaaagcagctcctggattcattgattttttgaaggatttgttgtgtctctatctccttcagttctgctgtgatcttagttatttattgtcttctgctcgcttttgaatttgtttgctcttgcttctctagttctttcaattgtgatgttagggtgtcaattttagatctttccagctttctcttgtgggcatttagtgctataaatttccctctacacacggctttaaatgtgtcccagagattctggtacactgtgcctttgttctcactggtttcaaagaacatctttatttctgccttcattttgttatttacccagtaatcattcaggagcaggttgttcagtttccatgtagttgtgcggttttgagtgagtttcttaatcctgagttctaatttgattgcactgtggtctgagagactgttatgatttccgttcttttgcagttgctgaggagtgttttacttccaattatgtggtcaattttagaataagcatgatgtggtactgagaagaatgtatattctgttgatttggggtggagagttctgtagatgtctgttaggtctgcttggtccagagctgagttcaagtcctggatatccttgttaattttctgtctcagtgatctgtctaatattgacagtagggtgttaaagtctactactattattgtgtgggagtataaatctctttgtaggtctctaagaatttgctttatgaatctgggtgctcctgtgttgggtgaataaatatttaggatagttagctcttcttgttgcattgatccctttaccattatgtaatggccttctttgtctcttttgatctttgttggtttaaagtctgttttatcagagactaggattgcaatctctgctttcttttgctttccatttgcttggtaaatattcctccatccctttattttgagcctattttgtgtctttgtacatgagatgggtctcctgaataaagcacacccatgggtcttgactctttatctaatttgccagtctgtgtcttttaattggggcacgtagcccatttacatttaaggttaatattgttatgtgtgaatttgatcctatcattatgatgctagctggttattttgcctgttagttgatgcagtttcttcatagcatcgatggtctttacaatttggtatgtttttgcagtggctgataccagttgttcctttacatgttcagtgcttccttcaggagctcttgtaaggcagccctggtggtgacaaaatctctcagcatttgcttgtctgtaaaggatttgcttgtctgtaaaggctggatatgaaattctaggttgaaaattctgtacattaagaatgctgaatattgtcccccattctcctctggcttgtagggtttctgcagagagatccactgttagtctgatgggcttccctttttgggtaacccgacttttctctctggctgcccttaacattttttccttcatttccaccttggtgaatctgatgattatgtgtcttggggttgctcttctcaaggaatatctttgtggtgttctctgtatttcctgtattggaatgttgaccttccttcctaggtttgtgaagttctcctggataatatcctgaagagtgttttccaacttggttccattctccccatcactttcaggtacaccaatcaaatgtagatttggtcttttcacatagtcccatatttcttggatgctttcttcatttcttttcactctttttctctaatcatgtcttcttgctttatttcattgaattgatcttcagtctctgatatcctttcttccacttgatcaattcagctagtgatacttgtgcatgcttcacgaagttctcttgctgtgtttttcagctccatcaggtcatttatattcttctctacactgattattttagttagcagttcatctaaccttttttcaaggttcttagcttccttgcattgggttagaacttgctcctttagctcggaggagtttgtgattacccaccttctgaagcctacttctgtccgttcgtcaaacttattctccatccagttttgttcccttgatggcgaggagttgtgatcctttggaggagaagaggtgttctggtttttggaattttcaagcctttttgctctggtttcaccccatcttcatggatttatctacctttggtctttgatgttggtggccttcagatgtggtctctgagtgggcgtcctttttgttgatgttgatactattcctttctgtttgttagtttttcttctaacagtcaggcccctctgctgcaggtctgctggagtttgctggagatccgctccagaccctgtttgggtgtcagtggtggaggctgcagaacagcaaagattgctgcctgttctttcctctggaagcttcatcccagagggtcacctaccaaataccagccagagctttcctgtattaggtgtctgtcagcccctaccgggagctatctcccagtcaggatacacaggggtcagagacccacttgaggaggcagtctgtcccttatcggagctcgaacactgtgctgggagaaccactgctgtcttcagagctgtcagacagggacgtttaagtctgctgaagctgcacccccaaccaccccttcccccaggtgctctgtctcagggagatgggggttttatctataagtccctgactggggctgctgccgtttttccagagatgccctgccgagagaggaggaatctagagagacacttagccttgctgagctgcagtgggctccacccagttcgaacttcctgagggctttgtttacactttgagggtgaaaccgcgtactgaagcctcagcaaggacggatgcccctctcccaaccaagcttgagcatcccaggtccacctcagactgctgtgctagcagcaagaatttcaagcccgtggatcttagtttgctgggctctgtgggggtgggacccgctgagccaggtgccaggcactggaggaaatctcttggcctgctggttgcaaagaccacaggaaaagcgcagtatctgggccggagtgcacgttcctaccagtacggtctctcacagattcctttggctaggaaagggaaatcccctgaccccttgcacttccacggttgaggcaatgccccaccctgcttcagctcaccctccatgggctgcacccactgtccaaccagtctcaatgagatgaaccgggtacctcagttggaaatgcagaatcacccaccttctgcgtcgatctctctgggtgctgcagactggagctgttcctattcggccatcttgccagctctctctttaattctttaaacttggttttcgttagttctttgatgatgtttataatagctgcatttaaattttttcttctaaatctagcatctgagaacacttatgaacaatttcttttgactgctttttcctccccagttatggggagaaactttcttgtttctttgcatgccttaaaaatttatattgagaactgcacattttagataattgtagcaggtctggattctgattctccctcccctgtggtggttattgttgccaatttgtaaaaagtttatttgtttattttgtgtttgtgtcttacttatttgcctgagataaatctgtgaaaactctcctttagtgagtagctacctactcctctactcattttcttattttttatttttatttttggaccgtctcattctgttgcccaggctggagtacagcaatgcaatctctgcttactgcaacgtctgccttgtgggttcaagtgattctcctgccttagcctcccaagtagctgggattacaggcgcctgccaccatgcccagctaaattttgtatttttagtagagacagggtttcaccatgttggtcaggctggtctggaactcctgacctcaggtgatccacccacctcggcttcccaaagtgctgggattacaggcataagccaccatgcccagccagtttgttttttaagactggctcataggagtcactctgtttatgcataggctagttgctagtgagtgactgggcacaagttgtgctcaaccacctgaggccaacaaggtttttgtctttgcaaatgtatctgtgtgtgggtagtgaagaaattagaagttcaggctattttcatgttagcctaactttactggctccttttgtgtctctcctatgtgcatgtggacagcctctgggttcacaaagaacatgtggctggcctgggccctctccaatctcagctgcacatacatgcagccgcagctatatgcatgctacatccacgtaattccagtctagtagaggccagatactggaggaattggctttttctgtttgtttggctcccaaataatcaggtatatcaacagtgtcactggacctgggcattacccaatggtccaaattgtttgcatcctcttcagctggggcagagaagctgctgatcctcatggtctgcccttcctgccagtagttgcatgttttcgaaactagggagagtggggagcagcctatggctggaatgccactgattatcagtcttcttatcctaagtttagcaatttgtcagctaaaagtgcttcttagattgtggtatgctttttgttcaattttcagaattttgaaatggctatttttgttaattttgtccagattcatcattgctttttgagaaaacaatttaccagtttcttcatttgaccctagttggaagtcctaccctgggatttgttgttgttgttgttgtttttcttgtattttacttcagaaaataaaattttacattgaaatgaattaaatttgataaaccttctactttatcataatgcatacatgtgtttacttaaaacgatcattttgctttgccagttctagaaactctctacattcttgtatttattttgctggagtttgctggcatgagaacatgagccttcatgttcatgcagaggttctaagattggataaactggtgtcatgacaaaaatttcatttatttctcatataattattagattgttctcagaaagactgcatatcattgcaatttctcttttaaatcctcctattcatttggtttcacattaaatatatatatattcatttccataaatctgtccatatccatgcagtacaaaggtcaaaattactcactgtcgatgaagagtggggaagcttatgatttatcctgtgattctaaaatggcagactttgttgaaaaaaagtctcgtattggacattttcccctgaattttgagtttatttatcattgcctcttctggttccttaccccagggaatcttggtaaagcatggagcaggaaactgaggataagaaccttgcgtactacttttcttactaagggagttgaaatcagtataatcaagaatgaccaacactacttttttctcacacatccaacatcatgaattccaatataactcctgaaatatctgcattgcctagccatatttctgtactaattagattatccagccatacaggaaattttgtgtttattttttgaagctagcacatcttacgtggccagagaaggagaaagagtgtcaaggggaaggtgctacacatttgttaacaaccagatctcatgagaactcactcactatcacaagaatagcaacagggaaacctgccccatgatcaaatcatctccggccaggcccttccaccaacattggggattacaatttgacatgatatttgggcagggacacaaatctaaatcatattatttcataactggcctctcccatatctcatgtttttctcacactgcaaaacacaatcatcccttctcaagattcccccatgtcttaactcatttcagcatgaactcaaaagtccacagtccagagtttcatctgagaaaagtcaaggcccttctgcatgagcctgtaaaataaaaaacaaattagttacttccaagatacaatgagagtacagacattgggcaaatacacctgaacaaaaaggaagaaatcagctaaaagaaagaggctacaggccctgagcaagcccaaaacccagcagagtagtcattaaattttaaagctccaaaataatctcctttgattccatgtcccacattcaggccacactgaagcaaggggtagattgcaaggccttgagcagctccgcccctgtggttctgtggggctcggctcccaaggctgctttcaagggctggcattgagtgcctgtggcttttccaggagcgcagtgcaagctgtcagtggatgtaccattctgtggtttggagggtggtagccctcttctcacagttctactaggcactgccccagtggggactctgtgtgggtgctcaaatcccacatttctcttctacactgccctagtagaggttttccacgagagccacgtccatgcagcagacttctgtttggacagccaggtgtttccatacatcctctgaaatctaggtggaggctcctaagcctcaactcttgccctctgtgcatccgcaggcttactgccatgtggaagccaccaaggcttactgcttgcactctctggaccagtagcctgggatttatctgggacaatttaaccatggctggagctggagcagctgcaacacagtgagcagtgtcctgaggttatgcagggcagtggggccctgggcctagcccacaaaatcattcttccctcctaggcttccaggcctatgatgcgaggggggctgcctagaaggtctctgaaatgcttttgaggcattttccccattgtcttggctattaacattcagctcttctttacttatgcaaatttcttcagccattcctcctcagaaaatgtgtttttcttttctaccatgatgtcaggctgcaaattttccaaacttctatgctctgtttcccttttaaataaaaattttaatttcagatcatgtcttcgctcatgcataacaaaactgaactatgctccagtttccaataagtttctcatctctatctgagatctcctcacccttgacttattgtctgtatcactatcagcattttggtcacagcaatttaacaagcctctaggaagttccaaactcccttattttcccatcttctcctgagccctccaaactgttccaacctctgcccattatccagttccaaagctgctttcacattttcaggtatctttattgcaatgcccctctgtctgtaccaattttctgtattagtttcttttcacactgccatagagaaaagaagtttaacaggctcacggttccacaggctgtacaggaagcatggctagggaggtttcaggaaacttacaatcatggcagaaggcaaaggggcagtgggcacgtcttacatggccagagcaggaggaagagagtgaaaggggaagtgctacacacttttaaacaaacagatctcacaagaactcactatcatgagaaaagcaagggggaaatcggtcaccatgatccagttacctcccaccaggcccctcctccaacacaggtgatcacaatttgatatgagattttggtggggacaccaacacaaaccatatcagacctccacttgtctgaactatgtttaagaaactaatatataagtgacttaacattctacctctttaattagagtacctacagtgcacccataagatgattacttttaaattgaaattaattaaagaaatatgtgtttgtacaggaaaatatataaagcatatttggaaaatttatgacatgtatctcttggacttcatgctaagcaactataacaaagaaacctcaacttacagtggcccagacaagacacattttttcctctcgctaaattcatgtcagtgggctgtgcatcatcaggccaaccaaggccttgggttctttccaccgtgccaccatcaccatcatcatggttgatgttgactcatcagcaccgtatctacatcctagctcaagggaagtggagaaaaacaaaatccaggtcaagtggcttgctgtatttcaacatgacccagaaattgtgcattccattgagctgagtttgttgcatgtccacattgaggtgcatggaaggctgagaaatatcttgatctgaatgcccattaacccacctaggagactgctttatgactgttctccaataatataaataacacatgcttcctgtagagcatttggttatgcaaaatggtaaaataagtaaagaaaatccatcattaatttcatttttgagatattgacagtcatacttttttgtgtgtttttcttactaggtagttttttaacatacctgtgcaattctctgaatacacattgtcattttaccattgctatactatgaacttttctccatgtgattaattgactttagtgaacctcattttaatagctaacacatggatgaactcttacttaaatgagtgatatattctcctactgtgaaacattaacctgtttccagatgcttactattataaataagttgttacatgcatttatattttcagtgttttctagggtaagttcttaggaaagtaattactgccaaattggtgttcaaaaagttatgccaatttttactcccaccagcaatatatgagatgacatattgagaattactgagaaaatggccttaactttctgggtatttttttttttatttgagaactcattgtttttgaagtgacgattggaaataaaaacccctcgtttttctctacaatacacaaaagtacacatgaacacttttccagcaagaaaatagttttaaaatcaatttgatttaatggtttatattttataatttgttggcatgtttattacccacgagcagttctttgaatggtctctacatgttatttacccttttttctctattatatttttattattttgttttaaactaacatatattagttctttatagtaagtatatcaacctctacccagtaggtctattggaatttttttctttcttttttttttgagatggagtcttactcttctcacccaggctggagtgcagtggcaaaatctcggctcactgcaacctccgcctcccgggttcaagtgattctcctgcctcagcctcttgagtagctgggattacaggtgccccccaccacacctggctaaatttttgtacttttagaagagacagggtttcatcatgttggctaggctggtctcgaactcctgacctcaggtgatccacccacctcggcctcccaaagtgctgggattacaggcatgagccaccacgcctggctggaattttttaatgctagtttgctgtgttaagacacaacgactacaaatcccttaatagcttcttccattgcttttctgcttagaaaatatcttcccatattcaaatcattatgtatataagatagtaacatcttgttccttgtaattctttagtgtattactgaattgcaattattttagttgtatagaaaatatttatgttttctggagcaagtcttctttcatgattcctctttcattttttttcttcctttcactaagtaattttaaaggtatactttataattattttaaaattttctcatgggagtgataaatgtaaaattttgattagatttactatatctgtattataatatattttcattattataataatataattatagattaccaattttgtaacatatttcaaattgaaatgtcaaaatataatttaaattataattacacattaaaatgttatttatggtattatattttatattatgcaccatattaaaatacaacttatttatattttacatataattaatttacttatgttttatgtttacacttaaggtaatatttaatatttatactaacatattaatattattttatattacactaattttcatattataacagtttttccattttcaaaatatccattcttttcttttcttccatgcctccttccattgattcaatatttcatttgtgcctattagtaaggcttccttgtttcttttcataaaacattcacattgctttgttaagattattcttattttgtatttttgtactattgctaaatgcttctctcctatatattttatagctggtcttcctggtataagaaaatactgatttttgttagaatggcaatcattaaaaagtcaggaaacaacaggtgctggagaggatgtggagaaataggaacacttttacactgttggtgggactgtaaactagttcaaccattgtggaagtcagtgtagcgattcttcagggatctagaactagaaataccatttgacccagccatcccattactgggtatatacccaaaggactataaatcatgctgctataaagacacatgcacacgtatgtttattgtggcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctgagtaaactatcgcaagaacaaaaaaccaaacaccgcatgttctcactcataggtgggaattgaacaatgagaacacatggacacaggaaagggaacatcacattctggggactgttgtggggtggggggaggggggagggataacattaggagatatacctaatgctaagtgacgagttaatgggtgcagcacaccagcatggcacatgtatacatatgtaacaaacctgcacattgtgcacatgtaccctaaaacttaaagtataataataataaaataaaaaaataaataaataaaaaagaaaatactgattttttgttaattgtaaaattggctgtctaaataaaaccttattgttttcaaaagcttttgatttggttaccatgagatttctgtgtaaaaaaattaagtaatttgccctaatggtatcttgtctcctttttgttttgaaaagtttgactcaaccctcccctcttcaggaaatggctcatttttgtctcttttccttctttacagcatggaggagtgtgaggctctttgcacaagactggccataatggttaacggcagcttcaaatgtcttggttctcctcagcacatcaaaaataggtgcgttgaagttctccttttgcttagatatttactatgaaatcaatagcatgatgcagggttatgactggagatgctttagaggcaagtatgttccaattacctgctggcataaaataggagatgaaggctctgaggggataaaatactgtggctagtaagtcaaacacatagcaactcccaaacacagtctagtgttctccctgtaagggagacattttgcttttctcttgccaggtagacattgctccctccttgtagtgacattggtaggggtgagaataagattgcagagtcaagatgatgacaggacacaaaatgtcctctttacacacaaaatgccttatgaaaaggctgtgctgatatgtccctcatctgcagtgaatcaaagttcccattttatcctaccaaacactatccttttgaaaaagaccatcaatttataagggtaggagagggttgttatggttgctttccatttggattatgaaagactaaagacttctttcctgtgctcattgatcctttatatttcttcctggttaattctcttcatgtattttctttatttcctttttggaatcttaataattttgttatcaatttgtgtgagcattgttacatcctggtataacattaaaaaaattaaagttgcctaaatacacgtccaattttcctttgatttgtttaacctgtcattctatgtagaataatttattcatttatgttgataaatctcttattttcatttattcagtgtttttaaggttaggattctcaagcagagatttggtaaatagtcatatgtaaattttaaatacttttaatttatggagaaaatagctgatgctcaggattgagatgacatagtagggagtgagtgtccatttttagagttaggcactgctgggatggtcagcctcacagttgcttgctgcttcgggtcaaccactggtcagatgcacctactggaaactattctcggtatgtactctgcccatctttaataagtatcatcaaaagaaaaataatatttcatggtctccaacctttatgaatgcctacataaagttttataacccattcttgattgttgggtgatttatgtctgatttatgtttacaaaagtttcccacaagagccagcaggacgaagcacatggggataggttttctctagctgttgcattctacatactggaaaatctgtgcctacttcggagtttgggttcccataatgtgatatatgggttgagcatgaattgttagtggatatgaactgtaggactatattaaacaagaaatggcttgtgggttattcactgaaacatcaaacttaataaaatttaaaaaataatttgtggccgggtatggtggctcacacctgtaattctaacactttgggaggatgaagtgggaggatcacttgaggcccagagtttgagaccagcctgagcaacatagtgagacctcattcctacaaaacattttttaaaaattaattttaaaaaattatatccaggtgtggtggggtgcatctgtagtgctagctacttaggaggtaggagaatcagttgtgtccaagagatcgaggctgcagtaagccatgattgtgccactacactccagcctgcgtgacagagtcagaaaacaattaaaaagtaaaataaaataatttgtaaaatgcttattctcctataactataaacctataataaacaaacacatgatgatgcctgtttctataatattgagataaagaataaaggattgatcatgacatagatggtaacaataactagatttttcataaacttcggcatccatacctgggagttagcaacatcagaacccatttctctgacgtggaggtgttgagatggatgagagaacttgtagtgggtctccttcctcctcctctccatccctttctttccatgaacatgaattgttaggaacgtgaataaggaagagtagggtctgggtgagggaagaggttctgaggagataactcaggagaaggcgagggttttggagggaagattatggctgaatttgggcagggatctgggtgtcaggatttccccgtggagaggcaggaggctggtgaggagggtcccaggcttgggctgggagacatctgcccagagggagaacggaagagaggagctacagaaatcccacagaggggggacccagagggcagggcttgggcttcagagaccagctccccttgggaggggcaggtgcaacaagagcctgcaatgagagcctagtggagtgaagccaggagagcacgagggtttagtcacctttagcttctgaattgcagtgctgaccttgacctcatgaacagtcgggaacccttcagtgcaggtctcagcaaattcgcccgtgacaggaagctgaggcttgcacctgctacgtcagttcactcggacaaagcagccatttttcagggtgaagtggggaaagtggaaaaggaatgtaaggatcagaaaaatgaggagccacagaaatatagagggaagaatgtccgtggcaagtagggacagatacataagaggaaaaaacaaaatagaaagtgaagtgaaatttcccaaaccaaagaacttttcctacctcactctctgccccaggcacagccctcagagaaatggggcctcagatgagaaacagctcttccatgggacttcagaccccacctgggctccctgagttcatcccaccttcctgagcctggggagtaagacccaagcacagggatcactttctaccccaatctgcaggtggcactgtctttccttcccaccctctgtcggttcagtcagccccgtaaacccatgcctgactctgctctgattctcttccttcctgctgtgctcatttgagttgctttcttgggtcttaagcaaaaccttggtacatgcacttcaccatctgagaagggtttccgcagaggacaccaaatcccattcccatgctcctaacagagcattaacaccccagcatcctgcttcattcctggactgacctcatccttagcccactgttttaaaatatagtgtgttaatagaaaaattgaagtacaataaggccaatagatcaggaaacgactgcctttgaaaataccatgtattacagtttccaataataggggcatggcacacagggtcccatgagggagcatcaggtcagccaggaggcagagggcagctggaaggaaacctgagcaagggattttattgtgatttctattggaaggaaggggtgaaatagggcaagcaggcctaggatctgctactttgaataactttagtgggctgtgcagcataggggttgtccctagttgtctagtacctgtgcctggggtgactgggggaggtggattgtggcttaacatgtgagagccccttagaggaggtgtttgagatgatgtgtgctctgggtcagctggtttgtatttgaaaaagtgaatttatttgcaagttgtttactatctttaggaattggctagctctgggaggggcagttcttccagagtcagcaagtccccactttttcaaagtattagaatacagaagataataggcatggttaatacacacactccaggactcactgaggctgagtggagccataagggcagggccaatcacattctgcctgcctggaggaagccaggcttgcccactttgcagaggaaggcagggagctctggctgtgccaagggttctgaagtcccccttctcttccttggtacagacttttgttcttcctgggaatctttaatagcttgtttcagagctattatctacatagtgaatttccaaacactttgagattatagagttgtattaaaaagcaagttccttggacccctgatctatggataacctaaagctctctgtgaccggtctgtaccaatcatccatggagaagggcctctgagaaaaaaaaatgcaataggccactatctagtgtgtatgtctatccattgatatcaagttgttatgttaactgtgatgttgtttcttacctgagtcacaatttaagaaaagtcaatcaatattagatcttttgctcgtaaaactgaggctgtttgcttctgacatttaatatttctttaacaaatgtttattgaaacccagcaagggcatgcagaggtaggtctgatgcagtttatgcctgctttggtactcacaagtgcagagagtgagtccggcacatgcccggtgacatcacaaggcctaacagggcaggcaacatagaaaaggtatcaactagagtgttccgtgaaagtgtcatatatgccaagtggcctccaaacccaggaaaagccgagaaatcaaagaaggaggaagacacatccagtttgttggtaaagggcgatttcctggggtcacttatgaatggaagtgtggtcttgggaagcagcaagacaggtagacctctgcaacattactccccagacccagggctcttatatcacagggaaagggcacctaccctagagagacaattgaagacacccctccataacaggcaagagtttttcatgcgttatgggctatcatttgtgcaataacttaagggttgccttgatctaaaggcaggagcacttgttcttacaggaaggacaggaagtgaagtaggaatcaggaggcatttgcgggcctaggctaaccagaagtcaatgtggtagattagcatccatgatgcagtcacttttgtctccacatggagctctgaggaggaggaggaggaggccttttttagtttgaggaaatagcgaaatatcttagacctggagtacaggtaaaatttggttaaaaggggatttaattctggattgtatttagtaacaaaaaatcactacagaattggaatttgagagcaagtaagagggacagataccagtcaaagcaaagtttagatttcaatatgaaaaataaagaaaatcctcaggctaagtaaaagcagcatgaccattttaaatgttccttgagcaaccctcggcttcatggtcttaacttcgtttctgcagctcagcactgtttcgttttgggttggataattcttggttgtgggaggttgtcctgggcatgtaagatgtttagcaccatccctggcctgtgcagcaccctcaccccaattgtgacaactaaaaatatctcttgacattggcaaatgtcttttgggcagcaaattgtcctgggtgagaaccactgtctcagctgttactttgttctatgtccccagagacatggaacacactaggaaacctagttacaataatagttagaccagattccaaaaacattaggcagtcaaccctgtctttcctatggccagatctgaaacgtgtcctgctcagtggctaagaggaggcaggtgtatgaagtaggaggatgtcagcaaatgggcacaaggatgggtagagggcgttgcacacagggcattgtcttaccagaggcaaacactctgggctgtggagtgatctcattttgcagaagtccaagatccatgagaaaggagtgccctcttctcctttcagtcttagtacagccctagtatgagatgtatgaagtcatagtggaaagccagaggtcctgagaggagctgcaactctgcaggccagcatcactcaggtgctttctcatgcttctctaaatacatccctaccccacctcagtgcctgttctcacttgaacaccttgcttggaccactccccatcactgattacacaatactcccacccacagacaccgaggatgattcttcctttttccttgagacttctctggctttttcattgcttggcattttcttccctttgcttgtgtttttttctttatagcaataatcttttcctcttctttggcataagtttgcatcctgcctgccaaaagatctgttcgtagagtgtttaatatccacaatcttacctcgttccaattcagtgttctgctcctagagagcacagactttgtcttttatcagtcctacttttgcgatatgctcaagtatccatgtgatttaggagataaaatatgagggcaatgacaaccagtccagtcctggaggtcttggtgtctgaaaacccaggggtaccacaataaagaggatatgtgtggtcctgaaatgtttaggttttagttcaccaggaggtttaatactgccaaattctacattcattatttactaagttggtgtcctatgctcttctcaagctctagatcttcttgttatagttccttaaattatttttttgatacttctaagtagttaaacaatgattttaactttagattggtattccaatgtatttctaaactgctgtatgtgttcataagttaagaactaaccaaattaaagtttaaagaatcatgtctatggtttatcacttcaacaaaataagccaacaatggatttctattagtgggatttagctaaaagcattttcctgatgctggtttgggacctcatcatgcttttcctggcttcagccaacaccaactgccccaatcctgagtctggtgcaggtggaaatatttgttcaaaattggtaattgatttcccagaaggacagacagcatctagagtatagaatttcggggacccaacctcatagggaaaagtgtatttgctccctccctggtcatcttgacctcattccagcgcttcccttcttctctcccacccttatgaccctctggcctatttcaactggagaaatcatcaagtccctccttgtcccctctccagcctgcaggactcttgctaagcctgcaaggttgtcacagagtgctcctcagatgcattcttcagctgtccttcctgtggcattaccaaaacacaccctcaaaggattattattatttgttctttctgccgaaccttctctctcctaatccattctctacttctcagtttctctagcctggacccagtttacacctgggctacacctgtgccattttcctcttggagcagaaggggttagaatgctgctggatgtcctccctttgggctcaataaactcctggaaaattctcttctccccttttactccctggcaaaggaaaatttaccccttataaaatctgtagagtgtgtcctaacgcgcaatactggaccatctcttagtgatgttatgtccccttgtcttgcatcactatattcccttcttcttgcctttctagcctatagatattccccctttcctaattgtcctcatcctcatcttttatctcttttgtcttcaccatttattatagtctgttacctactgctctgagcaagatatatagattatctagcaatctggataataatattgagaactaattcttatatagtgcttactgtatgccagctgtaagtgctttatacacatgaatcaatttattcctcatgacaatcctacaaagtagctgttattattacccttcatcttataggcataaaaaagtagtcatagaaaggttgagtgacttttccaggattaccatctagtaagtagagggactgacatttgaaccccagcattctggtgctactttgctctatgatgcatcatctcatgattgtccacatttaacaaatgaaagaagtgagcctcctacctgtggtggagctgcctttcaactgcagccagtctgactccaagcttgcaggcctggtcaccatttccgcttccttcctgctggagcacttcccagagccgtaagcatgaacatgcaaactctcgctgcatcttcaatggtgtctgcaccagcaactctctcttgttgacatgtcttttggcaaaattttaatatcttttccattcctattgagacctcatcatcctactcatttaacaagtaatttctaatttcctgagagacacctcttgtcagctagctttttgatgggctctcacaaagtttttatttcttcgttatccttttctttctttgtatctatgtctgagaaagaaatctgcttaattattgagtgtttttattctgtttgatgataacataatcgatttcccttgggatgccttctgtcagtggttttattctgctttacatccttgatcttttcacagtcaagagcagttaataacagaacatcaaccacattgacttaaccatattcatcgttatttgtagtaagaatccagaggtaactggttattggcattccttaagaggtcctaggcctgacagtgtgggtgttcccaaagtggctgctgtagctccacccaatatatatatgttctaggcaacaactaagaaaagcagagaaaagcaaaaagagcacatgccaactgtctgttccctcttaaagtagctttctgtcagagtcccacccagcaacttgtacttaggtttatttgtcacctggctacaaagaagtctaagaaatgtagactctagctgggcactttgctacttaaataaggttaggtttctgttcccaaggaagatagggatcatggttgtggagtgggaagcctgcagcctcacttattcacctgactggattcttttcctccattgagggtaggtcgttaggttgagcagctgagctgaacggactcttgggctttcaatttaagattgtcatatgctatgaaagagccctatatggtatagagattcatgagtttacgtgtgagcacatgatagagtgtgtgtgtgtgtgtgtgtgtgtgtgtgtgtgtgtgtgtggctcagttaataacagaggagagctggagtggagtggcactcacctaatagccacaggtggctaaaactatccttttgggcactgatgttttgtcccaggcaattagggatgcatcctcaaatcctctgcatgtcataaattgagcacataatggtgccctggtagctagctgcctttgtacttgcagacactgagcatattcccaacttacctggagggaaccattaacagctgcatgcggcatctatttgcttttctcctcccttgaacctgattgacataggaggcttaagtctgacttggtaaaaacactcctgtcatggaaaggaaataaaacatgcttctgaagcacagagtttacaatgtgaaatactccaggccaatttatgattttggggtgagggaggataaaggctgtgtattttgttgtcgttgttgttgttttcttttttctttttttttttttagacagagttttgctcttgttgcccaggctggtgtgcgagtgcaatgacacgatctcggctcactgcaacctctctgtcccaggttcaagcgattctcctgccttagcctcccaagtagctgggattacaggcatgcaccaccatgcccagctaattttgtatttttagtagagatgaggtttcaccatgttggtcaggcaggtcttgaactcctgacctcaggtgatctgcccgcctcagtctcccaaagtgctgggattacaggtgtgactcaaggcacccagcctgtttgtttgtttttctttctttctttcttttttattttttataaagaaaacacagcttcaaatgatttaaagaaaattgttaagattatgagaatttacatttccttgagttatcaactgtaaactttgagaaccaagaataaaagtagaataaagttcaaaggatcccatcatagatgtgttatatagccatctaagttaaaatataaagaatagtgtagaagggtttgtttgtggatttttttcctaaaaaaaatgaaaggaggcagaatcttgtttgagctctcaagctaccactgtctgagtagctgcaaattaatgtatcaccttatgtgacaccatatgctttagtgtggcaactttgacttaatatatctataaaccattactataatcataacatctcggattaagattgcatcaccacataatgaagtggatcatttaaaagtgaaatagataattcagtatgtttatgtcactttcacaaatggggaaggaagtttgcacatgagcacaaaaataatttctgccatgatgtggaactatggaatgatgtgctactgagttatatttttctatattttactttagtttaaagcatcatataattcacctgctgctactaaccactgaattaattctctttactagaaatgattttaagagagatagtgcacctccatatcctcagcgtgtttcacctcacctgctatgtgtaatttgtcatctcatttgttgtcacaacatcatgttgtatgaacacagcattgctctgacataattagctgggaagactttctgattctcatgccattctcatgctggacattttggttagctgcctctggtcttggaaattcaggtcatgaacagtatcacccagagctgtcactttatcaaaagtaaacattcggcattcattttttaatattttctgtaagaataaacagaatgcttttcactcacaatgaagatggaaaatagaagtgttggagatatttttagatgggtgaagttgttggggactcagactcacatcatgagtcctgttcattcatacacatttattgagtaaccacttaattagagatgatgaaaatgtgattcctaatctcaataaactcggcatagtgtacaggcagaaacataacaatgaatacaacacaatatgataattgttctaagagactggtgaacgaaatgctgtgttgtgcatctcagtttaaacctgcaaacattactgaatgtttacatagtgccagggtcttgggattgagtgggtaataaggcatgagccctgtaagaactgggctagacactcaaataaaaaaattatgtaagaaagaccattagcacgacaagaaggtttcaaagcccatgaggtaggagttaggaggaggaagaatgcacacacattgttttaggggaaggattggcacaggtagttttatgggtgaggaggaatttaaatcacgtgtatgcttagccagctaatcaactatgaatgcattagaggtagtggcacagagatgaacaatgtaaaccatgtttgaaatagcttgatggcaagtggaatacaggtggaatcatgcggcataaacttgaagggaatctttgggaccaaattatgggaaatattaattctaaggtaaaaaaaaggcaaaataatggaggaacaaagggaagcaaaaagaaacaggagaataactggcctattaaacagaaatttttgttctctagtaggaagttaaataagacaaactgaagtcaactggtgaccaagcacatggagaaggcagcatgggtgcaggagacgctgaagaacacgataatagaactttacagccggctgatctgagcttgagaaaaggaggtgcctttgggtttgggacatggaaagatagtgatgtctttagagaaacagaagttgggtgggctgtgagggtgaggaggattctgggtgttgagtatgttcctagggacactgatgggctgtttggagaattcctacgaggaagggctgttgatattcatgttctctttgctatggcaagaagcaggagagaaaacttaaagttgggggtgattattgcgtatggttgagacggaggaataagtagctgaactcatcacaactttgaagcaatatttataaactctgaagtagagtgagctgagctcagattcatgttgctgcatttattttaattattactaaatataggcaatttgccaaatgctttctgtgcatggtcttatttaatctttattacgtaatggctattattgtacccacttcacaataaagaaactgagacctaaagaatttaagcagttggccccaaaacagagtcagtattgagaaaagcagttttcaaactcaatttcttgactctaagtttcttattctttctataccacttcaatagtctcaaccaaccttatgtataactgactaaagaacaaagctttgcttcaagtacatgtcgtgggcacctgcgtgatgaaacctacacactttactctttgttgaatttacttcctgtgtatttaccgagaaaacagactatcttcttttaaaaagatgcacagactctgctttgaaagcctggtttgatgaaataaaagatatttagagtaagactcttactcacttactacgtatgtaacttggaaaaagttaacatctctggaggtagtctttttcttcagtggagataataatacgtattttatagtattttgaaaagaaatggaggaatataccaatcattttctcacctgcgttaatccatttgctgttactataacagaataccagagactgggtagtttataaaggaaagaggttcatttagtttagaattctggaggctaggaagtcctagatttggtggctgcctctggtcggcttctggtgagggcctagtgctgctggatagcctggcagaagcacagacatatgagtgcaagctaaaagagacaagcacaaggggtcaagcttgctatgtaacaacccactttaatgagaactagccaagttccctgagaactaacccagtctctaaagaatagcattaatccattcatgggggaagagtctccatgacccaaacacttcccacttagtcctatgtcccagtgctaccacattgaggaattgaggttctgatacctgaacttcggggggacacgctcaaaccgtagcaccacttgagcatgctatgctttctctttcccccgctgtaaagttctttcccaagaaaaacacatgactagttccttcagttctctgctctactgtcccctcttcagagaggtctccagcatcgattgtaattattcatagaagaagaagaacacctggatgttagctgacaacatgcctacataggaataagactgttttccagctttccctacagctacatgtggccgaagagttatagtaagaagagatgtccacaatgtcagggatatgaatttgcaaggagggacatccctgattcttccctttctttcttccttttactttatacagagctgatggctagagatggctagagatgaagcagccatcttgagccacgaggaaatcttagcaatggagacctgtgaagcggagcaataacacagaatgagccaaatgaatgctttttctactctggctgcctgacttcagactttaaacattaacatccttactatttggggctttctgtcactgtacatgaatctgaacagactaatattccctgtgacatattaaatatagcattaatttatgtacttagaggttattgtctatctctgcccagtagcatgtaaactttctgagggtaaaaccttttcttctgtttacttctgtatccttaccatttgaaatagtgccaggtacataaatgtgctcaacgtatttgttgaacaaatgaatgaatgtattaataatgaatgtaaaattcctagtacatggcagctttttgcttaacgggaattcctttcagaatgctgcaactagactgtaaaagacgaatcagatgaggccactcaagcattcagcttctgcctagcttaatgaacaacaaccactaacaagaacaataactgacccctttgatggagacttttactctgatgccatttatctttagacagggtgaagcctgctttctctcaaaacagtctgcattattcatgactagtttgctgcttttcgaaactggactctgtctgcctttggcatctccactaacagaaactatcaggtgtacgattcagtcctaattgctgccatggccttggcaatattgtgctgtcaccttctctgctggacagccagacttagtgctggtgtacaccggcttgccaagaattaatgtgcattgcagacagcaaaaatatgccattccagaatccaactgtacactatgggattatgatttcctattgtaaatatagcctaggcacaagaaaacatagcctaaccaaggaaatggatttctttattccaggtttaaaatgtatcaggattgggatttgggagaagcttttcttactctgagttcaaactatgagcataaaatgcgtgtgtgagtgtgtatttttaaatgcaccagcccacaacatttgtttcatagttatcttacaaattttattttttcattccatttttataaaagaacaaaaaaaattcctaaagcatcagttacattttggcaaaaaaaaaaaaaaaaaaaaaagctgcaaagtccaaaaaaactcagtggcttaaaaaatcatttgccctcaagagcctgcaggttttatggagatgggctggcctgggctggatttgtgcacctgtcccttgtcatcctgggattggtgtctggaatgttgaggcaccagaatggacaggccaaactgcacaaggatgaaccaagcctctggtcacatcaccactactaatgtccttttagccaaatcaagtcacgtggctagcccaaagtaaaagggtaggaaggtagtcccacccatagtggaagaacaccacgtatagctacatggcaaaggacacagatgtaggaatgagaagaattggggcaatatttacaatctgctacaacctccaaacattttcaccaatttttaaaattattattatctatttcttggtctattttgttctacttttccttttaggagagtttcctagatttaaaatttttatgtgttttgaaaatcttttttgtttttggattactactctaaatattttatataatatcctgtcagtatttcaaggataaaatgtcttttattaatttttaaaaaattttagttttaggggtataggtgtggatttcttatataggtaaatttcatgtcatgggggtttggtgtacacgttatttcatcacccaggcaatgcaaatagcatcctataggtagtttctcaatcctcactctcctcccatcctccaccctcaagtaggctccagtgtctattgttcctttctttgttttcatgcatactcgttgtttaactcccacatataagtgtgaacatgtggtatgtggttttctgtttctgcattagttcagttaggttaatgggccccagctccatccatgttgctgcagaagacacgatcttgttcttttttacgactgcacagtattccatggtatatatgtaccacattttctttatttagctgatggtcatttaggttgattccatgtctttgctaccatgaataccttctgcaaaaaacatatacatgcatgtgtctttatggtgaaatgatttgtattcctttgggtatatacccaataatgggattactaggttgaatggtagctctgttttaagtttttgagaagtcaccaaactgctttccacagtggctgaactaatttacattcccaccaacagtggataggcattcccatttctccacagccttgccagcatctgttttttttttttctttttaataatagccatcctgactcgtgtgaaatagtatttcactgtgggtttgatttgcacttctctgttgattagtgatgatgagtatttttttcatatgtttgttggctgcttatagatcttcttttgagaagtgtctcttcttgtcttttgcccatttttttaatggggttatttgttttttgcttgttaagttccttatagattctgtatattagacctttgttgggtgcatagtttggaaatattttctctcattctgtgggttgtctttttatttttaactctgttgatagtttcttttgctttgcaaaagcccttcagtttacttaggtctcacttgtcagtttttatttttgttggaattgcttttgaggacttagtcataaattctttgtcaaggctgatgtccagaatgatatttcctagattttcttctatgatttttttagtttgtagtgttatatttaagtctttaatccattttaatttttatacatggtgaaagatgggggtccagtttcattcttttgcatgtggctagcctcttatcccagcactatttattaaataggtagtcctttccccattgtttatttttgtcagctttgctaaagattagatagttgtaggtgtacaattttatttctggattctgtattcttttccattggtctatgtgtctgtttttgtaccagtaccatgatgttttggttattgtagccttatagcatagtttgaattcagataatgtaatggctccagctttgttcttttttattaagattgctttaactattggagctttttctttctttttgtttttttggttccatatgagttttagaatagtttttttttaattctatgaataatgatattggaattttgataggaattacattgaatctgtagattgcttttagaaatgtggtcatttttatggtgttgattcttctaatccataagcatgggatgtatttccatttatttgtgccatatatgatttctttcattagcatttgtaattttctttgtagagatccttcacttccctggctaagtatattcctaggtattttgtgtttttgcagctttgtgaagggaattgagttcttgatttgattctcagcttggttgttgttagtgtatagcagtgctactgatttgtgcacattgattttgtaaactgagactttactgaattcatttatcaagtccaggagtcttctggaggagtctttagtgttttctagttacacattcatatcattggcaaacagagatagatttacttcctcttttctgatttgaatgctctttacttttttctcttgcctgattgctttggctaggacttctggctgcctaagtctctgtaggtctagaagtacttgttttatgagtctgggtgctctttggccatttttatattggtttatttgtctttattattgagttgagatctatatctatatctatcttctggatgccaatttcttatcagttgaatttttcccattttatgggctgtcttttcacactttgggtattgcccttgaaagcacaaacatgtttaattttgatgatacttaattaatctttttttcttttgttgtttgtggttttcgtgtcatatccaaggattcattgccaaatccgaggtcatgaagatttacccccagatttttttctaaatgttttatagttttagcacttacatttaagtcttcgattcatctttagtaattcttttttgtattaactgtgtgtgaggtagggtcccaacttcatttatttgcatgtggtactcacaataggatatacctgtagatcagtgaaatagaattaagagtccaggagtaaaccctgggctttatggtcaactgatttttgcaagggtgctaagaacatttgatgttgaaaagactattcagacatttggtgtatgtgcttggctgaggagccaatggggtggataggattttcaaatcgtgttttcaataagtagtgctaggagaactggacagtcacatgcaaaagtatgaagctgggcccctacctctcacacagttaatacaaaaaaattactgaaggtgaatgaatgacttaaatgtaaatgctaaaactgtaaaactcttagaagaaaacatagggataaatcttcatgaccttgaaactgtcagtggattctcagatatgacaccaaaaacacaacaaacaacaaaagacaaaaagtaaattaattgtcatcaacattaaacatgtttatgctttaaatgacactatcaaaagtgtgaaaagataacagaataggaaaaatttacctgataagaaattggcatccagaagatagatagctgtagatatatatctcaactcaataataaaaagataaataaacaaatatggaatgaccaaaggcactcaaattcataaaacaagtacttctagaactatgaaaagacttaggcagccacataataatactgggggacttcaacaccccactgacagcattagacagataattgaggcagaaagctaacaaagaaattctagacttaactttgacacttgacaaattggacctaataggcatccacagactactttacccatcaaccacagaatgtacattattctcatctgctcatgaaacatactctcaaatcaaccacatgctcagccataaagccagtctcaataaattcaaaaaattgaaatcttgaaccacaatggaatataaaaaataaaaattaggctgggtgcggtagctcacccctgtaatcccagcattttcggaggccaaggtggatggatctcttgaggcaaggagtttgagaccagcctggccaacgtggtgaaactctttctctactaaaaaaaaaaaaaaaaatacaaaaattagctaggtgtggtggcacgcacctataatcccagctacttgggaggttgaggcaggagaatcaccttaacctgggagacagaaattgcagtgagccaagattgcactgctgcactccactctgggtgacagagtgagtgagacacttctctttcatagataggtagatagatacatagatagatagatacatagatagatagatagatagatagatagatagatagatagatagatagatgacagagagatgtaaataaaataaaaatcaataccaagatttctcaaaaccacacaattacatggaaattaaacaacttgctcctgaatgacttctgggtaaacaaaaaaattaatgacttttgaatgataaacaaactgcatttctagaataaatctcacttgatcatgatgtataatttttttcaatattattggatttaattttctagtattgtgttgaggatttttgtgttcatattcttaagagacattggtctgtaatgttcctttcttttgagattgcgtgtgtgtgatgtctttggttttggtattgtggtaacactggcctcaaagagtgaggtggaaagtgttcctccacttctattttttaaacacgtttgtgaaaaattggtattatttcttaaaacatttggtttaccagtaaaaccatcaaggatggcttgtttttgtaaggtcagcagtaatgctttctctttcatttctgatactagtaatttgaatcatctctctttttttcttggtcaattatgctaaatatttatcacatttgttgattttttttcatagccatattccatatggcattccaaacttccacaatcaactttagtttcatttttctctattgtttttatattcttgattttatcaatgtccactccaactttattatttcctgtcttcttgctttaggtttagtttgcttttctttttccagtttcttaaggtatacagttgagtattattttgtaatttttcttacatgttaatggaagtattattactataaatgtttctccaagcactgctttagctacgtctcataagctttggaatgttgtcccttcattttcattcatctcaaagtattttataaagtaacttgggattgcttctgcctcgttgttttacccacacgcagctggtaagattcactcattgctgtattgttttcaacaatatcatgggcataaattgttctacatataaatctcataaaatttaggctgtgttaaaggactccttcctgagatcagtgtttgagatttgttttaatcacaaatttgccactgggagggctccttccagtggtctccctggttctctctggtaaattagacagcctgtagtttagcctgtatctccgatgaatctatcaatctcccaattgcctttcaccacaggttccagttattaagaacacccttatggttgaacttctccacattttgttgccaaaaaaaaaaaaaaaaaacctaaaaactaaaacaacaaaacagtccctttggggatagattagcagttatctgtttatggcttgcttctttagaggcaaggaaacatatatgagccacatttctggagctagaaatgggagcaacatcatgtttctttctgaatgaccctcccactttaggagctgaacactcatgggagagggaggacagtgacctcagattctctcagcttgcttctcccatgtggaaaccccacaccatgatatgaggcaagaacaagggggaccccaatattctcggcaatgctgttcttaatttaaagcctctgtctaatgagcctttgtctaatgaggtagagctgggtaaaaaaagggcaccatcacctctcatctgtactcactggcagcttaacctcatgaacatgtagctggggccagaatgagaggggaagacagctcacttacagagagctaaggtgggagagagccctgtgttcttggatgcagcaggctggagtggagtttccatttccctgagctgggaggtagcagaagagtagatcttgttttaaatgccacagactattactgttcttactcagttttagtagactttcttgaataactatattttttatcttgctgtatacagaaaaatagcattttggagactttactgttttttaaaaaatagttttcagcagtcttactgggaaatgagtctgcagaactcctcatactgtcctgatggaagccttggctaaatgctttcaaagacatctatttatatctatttcatgctggtattgtacctgcacctaaagtgactgtgcccgtaaaatagggagtctagttctattgtttttgagtccaattttaacatccatattgactttttacagcccctgctttcttctcattattgtaaatatttatagtattaattttattgtgtacagaggcatatttgaatgattaaaaggcaagcaccagccttttgagaagactttatcaatcactctagcacaactgttcacaaagcaaggagtcagccgcctcccatataggcatcccccaaccataacgtggagaagcagatcccagttagtactttctatgttatagctcctctagtttgtaattagtgtttgaaaggatccagagtaacatggaaaagattcactgtcttgattcactttcataactcagctgtcacttgggtctttcctgcccatgggagatttaggaaaatgtgcctgatttcatgccagggagtccaggacccttgtctcaagggttctatgaactcctggtgagtcagaggcctgtgtgccctgccctgtttttgagcctgtgcagtcctgcctgggcatgtgctccagtgcctggggagccagccacattatcacccccgccaccatacacccaaatgtatcaataattccatgaatttagtaattttccaacatttttgaatgtgggcctgaagagagaagtaattgtgaatccctgggctgtccgtccacctggcccctccctgcatcctcagctgtttcccctcttgtgcccctggctgccagggtgctgtcattactcaggcatccagttggaaagttccaggcacatttcggcccagagtcacttacccagagcctggcttatcaaagccttttcttaacaatgggagggaggttgaatcttaaagcaattcttctctgttaaggcaattatgcattttttcttattattacattatttatttaagggctgtattacatgggatctgactggagacgatagaggttatttgcaaagcctttgaaaatgaactcagaagaagtttaatccactctcccaagggaaccatgtccctacaaaaacttaaaactgcagcaaaacagaatagagagggtttgcttgtgtgcctgcagcagagcacccccttccttatgtaaacacttacaaagctgccatctttgcacagatggtggctgagtggggtgctggctttgaaggctccctgttttaatactggtgttttcctcctcaggtctcacgcacgaagtactgtaagcttctctatgggcagcactcatcaagccagaaagtagcttgccatggcttcttctatggggtgttttctttattatgttcataaagcaaaaaaaaaaaaaaaaaaaaaaaaacagagagagaaagaaaagaaaatcagaagacaatgactactttagctctcttggcctctcaaggtgactggtgtgagaatagcttggtggctaaggacagaaaaaaaaatcttttgtttatctagactctagggtatttctgaaatgaagggaaatgttcagagaccattaaaaatgcaagaggccacataaggggctgagtcatatagctgtcacctcaccaccttggaaacaaaacgctctatcatgtttgtttagctggtgacaatgatataatgctggagatgaggctatgtatttttttttatcccactgacttggctattgttccttactttaaaatgatcccctttggttactctaaagaacaaaggaaaaaaacaatagatatgcattttgctgtttagttaagaaggaaatattgttttcattacaccaaagtctgacaaggaatttaattcactcattactccattaaatatgaactgggcatctgcaggggtgttagagtcagtggcagaagggtttatgtgtcctgtattcttggagctctactgtaacaactgatggcattgaaggatgcaccatacacctgcatgtacacaggaagggctttcacagccagaatagggccttgcacaagtgagcactgaattagtactgaatggatggaggaaaggagatctggttgtgggtagcatgaaggatactcttagatgcgaagtcagagaggaaggcactcgttacatcatggagagcctcatggacaagctgaagagtttgatattgagtcagagtctttcagacatgaagctgacatggcctccggagttctgagacagttctgttggcctttcctggaggtgacgttgacccaaccactttaatttggatctatgaatggtggagtcatttaagaaagtgacacatccagccacagagagcagtgtttatggagtgatgtgtattaacatgaatcaagcttcttttttattgtgaagctgtcatgtccctatacgatctcgtctttaaactcagaagtgtattgaggctgttttcaaagaggttttcttctccaggaggaatgtgagtgccagctgccaaacactgttttgttgttgttgttatttgtcaaaggctctctttatgttaataccttgggtctgtaatcctcacagccattctgatttgcatatgcaatgattggaaaatgatccaaatcaaacttaactgaagttgaaataataaaggtgcttgcagtgaagggacatggttgtgaggtaagccccatggtctcagctctgctagttaataagctgagtgacaaagaaaaaatctcctgatctctttgggcctcaaatttttgcattttatagagaggaattggtatccattctagtccatgtacaggtgtgataagagtaaaatgaaattattgatgtgaaagtattaatataaaggatataagagcattaacgattagatgagatcctgcttcaggctggagttttgaggttaattactcagctggaactgtaactccctccattcccttggagttgtgtgacccaaacaagttatgtagcttctctgagatccacctcgcttctgtaaatcagaggcagagatagcagcatcagtattttgtggggattaattgggataatgtgtttggtgcctcactcacagaggatacaggacagagctcatgtcctcagtcttctcttttggtttccttttctttccagtgggtaatcatgaggactgagattacaatgaggaagtttctattaataatacagagatgccagctacacatcaagtgctcacataaatgtttgcatcccgctgtttgctcagccacccttcctcagtgccatcctctcctcctcttcatgcatccaaaggaaacctattacaattcagtagctgaggacagatcactggaatttggtactttgttgaggcaccaacccatgaggagtggggtgtggtgtggtaaggcaggaagatgagaattagggaccaatgtagtctgaggcagcggggaccccatattccacagtcagtgctgtaacacttgtgctggatgagagcttaacgtgagaccacgggaggcctggtccccctccgctctctgctcttgccctgtggtggatgagggagaagtcatctttaaaggtatttcctactcagatatgtgtagggaatagcacatgtatggggttgtggatgtgagtgtgaatagactcctcgtggggcagatgatggaaatcagtgggcatatatctataaacacataatacaaatattacatattttacaaatcctgttattttctaaagtctaagattagtttctataccaagaagaattttatgcgtttaatttttagaggcaatgtgacaaaaagttcctaaataaatgatttttaaaatcagaaactgaaatacagtcgtagagtatgagacattagtatgttcctttaattctcttagaagccatgtatattttttctttctaatgataaagttttatgtgctcattattttagaattcaaaatagtataaagaataaaacctaatggttatgcgattatttcttgtccggataacattccagaatttatttcagtctgactgtaaatatgtgcaaacatacttacatcattaatgtaatactgagtctatgattttctattttgcacttaatattatataatagccattttctcttcattaaatattatttgtagagatttttaatagttgaggctgaaatcaatgtatttgttataaattatgacttttaatttggggggaaggacttttataaggggagccttaagctcaggaatgcaaagcttcataggcacttggtataacttgacaagtgatttttcagaaatgtctctgcaggtgcattgccacctcttttgttctgctcttgaagtgtctgactttcaaaatatatgtgtgtatgttttttcttcctctcatgtattattcctgcttctgttttagcattaattaatatattacatttaatgtttgtggttccaaaatgttgtacctcaaaaaattgtagaatatttcttgtaagcacctttacctacagataatgccatttatttatctctatttaatcaccgattatacaaataatgtggacataacgtattatctagaaatgttagatcaatgagtgaacatagaaataaatgactccttggctattttgcaacattttattctgtggaagtatgaaaatcaaataaatccttcagggaatttagattattgacataactgtgtatgttatagatagaaatgaaaaagtcaagctaatattaattagatatttacatcataatgaatttaataatcttcgaagagtgtctaaattgttgaaggtgccatgcttttataattttacgtttagaagtcttcttaactattaactgttctagagagatcctgagtaacctatttcaacctatctcctatctgtttcaggcatattttctctagagtgtttctattttggaagactggtagaatttactttttgtttaatttctgtgtaatttttcttttttcgtaattcatgttcttcacagtaaagttggaattcttttagttcaaacgaaattttaatttgaaagaattttaattattaatgtgcatatgtgcttatagagaatttattagataattactggaatttagcatgaatttttcaaaagtcattagcaaaatatacttaaagggctgcagtttctactaatggtaaaaatggatcctaatatgcataagaacatacagccatctctgtgccactgtctcctcataccattgtatttttatataatgcttcctattcatgtttgaattgttttatctgcttttatctaagttctccaaataaatagtggccttcttcactccaagaagaacattcttctgttctggtcatattctgaatagatcctaaatttcactgcttatttatctacttagttacacagtgccagacattgttccaagtaatttgcaaggattaattcagtcagtcctctcacaaccttattaggcagatactataattaatctatttgctagatgaggcaactgaggttagaaaatttaccagactttccagggtcaaacaactggtacgtggaggagctggattcagtagtgcaaacactacattttgtcatgccatcagaatcattaataaacatgagaccagaaacacatctccatgcaacacatcccctctgccctggaacataatgttatgcccagacacagctgagagctctcccaggagcatttacaaagctccagtgacatggtgcttcaccttgggaagccccttcaaccacctaggcctcaatcccttcttttcatgaaacgtggacatatagacccactttgggggatttggtgaagacacaatgggttgatcgtgttattcagcagcatagcttgtaacatactgctgagaagggggatggccacagaatatatacctcttgtaccaacccaatgtgttggcctttaacaattctgagagatagccaaatagaaatgttagagaggtgcatgtccgtatgcttttatgtatattttgtcagtgtcctcaccaacctctcagccatgtgaagattagaaaccattaactcgaatgatgggaggctactgtggccatgcacagacctcagagggaagtgacatctgacagcctgaaattaagacaagaggacagaaaaacagaacaccagggcaaagagctccatgggtgctcacaagggtgatctatgtcactgaaacaaggtcacattgtcttgggtcccctgtctttaccagacagacttgaaaaataatttgaccataaatctgttagggatcagcctcatttaggggaaatttacttaagtgtaacacattttcccccagcaatgctttgtaaatgagatgagtatgattgctaagactgggcatgccatttcattcattaaactaatatttaccagtgctaggtactaggtactcatactgtgcttggtacttagaaaagatgcttcagtgaacaaaatggacagagattttagtcatcagagtatattcatgtatttctgattttttttgggatgctatgatgtgcccaacaccacctgagataagggagtagaataattcatatagtttttggaggacccctacattcctggagattgctatttgaggttaccttagggtatgagtatgagctcatgtcttgctgatgggacaccagtggaactactgtctataactctacaatgtgaggaacagagccccttaggcaggagacttcctttgcagtcatagggcctgtccacctaggctgggttgaagtacaattgggataacttttttatataacaaacaaacaagtgcctggtaattacatatgcaatccctttcatcttttcccagccaaattttaatcagtacagaccttgaagcaataaggccagcaatcatgcttcccagggccagtttccagcccagcttcccacttccactagctcaggactttgctttcaccgtttgcattttcaccttccctcttttattgactgggtgttgattctgggacttgctgataatttttttaaggtaattcagtgtctgtgtcaatataaatggaaaacaactaactgtataattgacttacaattaatttctgtgtcttatattgagaatccaaactcccaacaatttggagtaattacttcctttttctccctctgtgtgaaaatggacttagaatttactcatcttaggtcaatatgataataatcatgtttctattttatttaactctcaggtttggtgatggttatacagtcaaagtttggctctgtaaggaagcaaatcaacattgcactgtttctgaccacttgaagctttattttccaggaattcagttcaaggtagtgctaatatcttgtattatttctttgttttcagctaaaaaaaaataataaatgtacctgtctttttttgtttttattctatgctgttataagatactacttgttaccttagccacattgcaaagtataggccctgcctccctaccaaaaatagcatggatagctgatattgcttgaccactctgaagagtgacaagcctgcttaattgcttcctggattggccagagcagcctgtgattacatatcacgcctcttatctgtgggcacaggtccattgcataactcatcttgttcagcatagaagattgcaaaagctaatctcttccatatatttgctgtagggtttataggcttgatggtttcagcattgcttcacagaaatagccctatgcttgagatcacaatcctctataaacttgctgtcatcaagtatggtcactgaaccagcagcatcttcattgcctgggacctgttagacatgcagaatcacaggccccaacctattgaatgggaatctgcattttaacaaggtgacccggagattcctatgaacactgaagtttgagaagcactgtctaaaaatctcttggataactgtgggatgctagtttattataacttctaggaggctgtagtccataaagtagttatgttctatttatttcaacaactgtcatttagtgaaatcctactatgcaagaagcatgctgtgtgagactgtcattcatgctcaattatgactctgagtcaccctataaaacagacataattatctccattggcatacatgaagacaaggatcagaggtttaaatatcttcccaagtgttgctcagctaatgatgagaatagtgagagataagcccaagtcccagtgtaaaactcagggcccttccatccgtctctgttaggccatgttaaattcctacatttcaaatatctttgggcatcttatgattccttaaacagggcttccccatgctgttgcaaggttagagcatatcagggggcagaacagcaatgccactcagttgaacgttgtttgtcaaatataccccatgaaaaattgtcatcaataagcattcattggagactcacaaaattaagtgtaggttgagaaaacgtaactgaatttttttgccaattaaatgtagtatgatcaattttgtttaataatgctagttatatgatactttttttttttttttttttgcttttagggacagcacctgaatttattagaatatcatgtgccaaaaagatggggatgcctagctgacttgttcaaagttatagagaacaataaaaccttcttgaatattaagcattattccattaaccaaaccactttggagcaggtatagtatcttgaatgattcaggaggttgaattttggtctgttcatcagacctaatgtagccaattttaaaattaatcgaattgcttcaattcaccactttattcaattcatcttgttaaattttataaaattatgataaggatggtgagtgtcagaaagtttgtttactgtatacccttctacttaagatagatattcagtagagtttcaatttgttcatattattttgggcatttaactaattaaatcatgtcacgttaaccttcctatctccaccttactcagccccacaagacttttcgggggggcttcactgtaatcaaatgatagctaacttctggggaaacaaaaagcgtttcatttactaagagtaccaggaatataaaaatacatcacgacatatttctaaaaccaggcttaaggtattgagaacttctaggtgatttattattataattgtctagaaatatgaatgttcttagagttgtgtcctcaatggatttatatatttatgtgatttgggagggaatggtatgaattaatgatctgtggtttttagggcaagttggccagtgttctgagacaatgtctcctttctaataagtgagaccaaagggttgtattcttataagtaaacaacatttttatggtttttttcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccgatttttggaatgtaattgtgcttttgccaatatattttcttgtatctttatttgtgtctttagggatccaatttaatttaagtaagcaggaaatgaagctactccaaatcttttaaagtttgaaaggttaaaatttaattgagttttgctctgctgtattctgctcttaggggttcttttctggtttttgaactgctgtattcttgaagtttatgcttcaaggtatgcctttgaacaataaacagaaagaaagagaaacccaacatgctaaaacaccacatcccagaagactggatacaaaaggtcaaatcttatgttaatgttgaaaatgtcattgcatttataagtcatgcaggtatttaacgcctttggagttaaacatttgtcttaagacctttgggcttaaggtcacacaactgagacttttaaacagactaccttcttttgaaatcattctgagtagagtactttatgaaacagaaataatagtgattatcccagttctagtaatctagcatttactatatagattatctttactcagatatttaaacagttgatgtatgaaaactttcatgcaaaatcaagatagtaaaaagcaaacagaaagtgtattttagcatagtaaagactaggtggcttaaggtcataggtagtttatttaataagcattgaattgaaaaatagctcaacatgacatcttacaaaacatcttagaaaatacacagccacatacataccccacaacctccccccataggcacactattagtgttaatgagaatgacatgaatattagcataatcacaaatgtttctgcctaagtaggagttacagacactttaaattttcaaactgggttaactatgtttctcctttggcttttgctttggcctgctgcattatttcagctcagtggatttttttgatgacttgttacaactcaatttcacacacttgaataattcaaagccctttcacacatacacacagacatacatatgcacacatgcacatacaagcatacatactcacacatgcacatgtatgcacactcaaacacacattcattccttcaactaacacctttgatctcattccatgcacataagtaggtagtgggtactataaacatggggtggtggactaatcaatagcagagccacaatcattgtccttgaggagcacttaagcaggtggagatggcaagatgagatctacaagcaaggagtactccctgacatggggtcggaatgattcactctcatggaggatgtgggaacaaatctcgtgagatagttaccacctgcttgggcctttgcagattgagaatgggggaaatgacatctgaggctatgaatatcagagcaaatggaaaatatttaatgagcaatggatgcttgcttattatgttggagaacgatagctaatatagtggtttctgtagacatcaagaacccaggtgtctcatttttagaatttctcttacattccagaatggccgctagatctctagctatcacaatattcaaagatgaaataaaagaaaaattggactaaggggataatagcacatctatttgaagagcttccctggcaacctcacctgcatacttaggcttatattacatcacctggaagtattcacatgacgctaactagctacaagagtgtttggtcaatgcagtctttatccaggcttctgaccaccctaaaataaaatgaaggttttgattctatgtgagaagaactaaacagatactggatagataaccagcagtcactactaaagaaacagagaagttttgtggccattttgcttgggaaaagaatgcattcaattttggacatgttgaatgaaccaggtagtgttaaattatgtggctattttgggcaatctaggttctaagagtgttactattttcaagattaaagatgtatgctaagatctgtggagcggatatcatttatatttataaacattactgtcaaattgaatgtggtagataaagagaagaaaattttatggatatttcccatttgggttaaataaatagcattgtcattttctcacagtgagaattcctcttgagaactttaataaataaatgtctcttgctggaaagggttgcaaattacagaaagaagtcagaagcatttttcttaattatttgctattgcttgccatcacaagagacatttcattgtctttcactgtaagtgaatctatcacattttttctcttttgttaaagtgttttaaagaaacactctacattaaaatgttttaaagaaaaattaggtccactgagttaaaggtacatcttaaacctagcaaaactcaatggttaaaaagcacatctagaaattttatgagcatattcttctttccaatacaaggcaacattctgaaccccatattggccttcacatttatgttccatgggtgtggcttggtattgatggatgacaactgttgttggtggggttctgtttgttccttggttttgttcatgaaacactgaggactctttgcggggttcaatgcagggtgaggagtcattgcttccaatctgtttacacttgcacttagtgtcacattgcagctttttctacccgcacataaccaagtaaaaactttgtttgcctcagcataagtttaagtgaattagggtagtacgctagggcaaggcagcaagtccaagggggagttcataggctgggcatcaggagacctggctctactgccaatcagagtgggatctccaagcccttttgctgttgtgcccttccattttcctcacatttacaatcatgacaagatctttgagaagactaatgaaatcagcaaatttccacagacggtgcacaaatatacaattttagaaaagaaaagggagcatatctaaagatagaaatgaagagtaataagagaataatatgaaaaactttatgcaaaatattcaaaaacaaataatatttttagtaaacagttaggaatcaagattgtctcaagaaaacaatagccactccagaaaatgaatcaaccatgaaatatcatcacaagtatatccctaccagtgtcccatcccaatacagcagacccagatggttttacaaatgtgtcattctaaaagagataaattctctattttacacaagctacttcagaaaatgaacaaattctatctcattttagacaccagtataacattggcacacaaacttgtccaagaataaaagaaaagacaaatatggagaaattaatgtatgaacatggattcagacagaactaatgataaatagaatcagtagtatatttctcataatacaatgtgatttatctagaaaatgcggttgtgatgtaaactcagaaactattaatgtaatccattccattcaaaggtaataaatgctctcaaatgcagaaaaaatatttcataaaatatgataatctatattagaaagttaaacttacaagtaagttttcacaatctgatatgatacagctaataatatttatgaagttttaaaagctgaattgtgctacactgtcaaaatatagcgtgcccttctcaggaaacgttatttattatttctcttctgtcttgtatattttatctctcttagagctaggttctttctagcaacacttaagatgtttcagtctctcccattgtataaaatactgtatcaatgccacatcagtgtccactcaataatccatccctccagcgtctgttccatcatcacctccgactgccttctctgcctgttctactctggctgctgctccctctatgccaccaaaacagtcccagctaagatcactgagggtctccattttcctaagtccaacagataattcaaaattcacaccttctcacctgtctgttaaaataccttttattccttggatctcatgactctatacttttctgtttttttttccccctctccttagtatcatttttaggcaaatgctccttcacatggcaataaactttgcttctgaatcattcttctcaaatctcaacttttatttttgcttcactctaccattgccctctggatttttgtagattccttttttattatttatttatttatttatttatttcagatggagtctcgctctttcgccaaggctggagtgcaatggcatggtctcagctcactgcaacctccacctcctgggttcaagcaattcttctacctcagcctcatgagtagctgggactacaggctcatgccaccatgcccagctatgttttgtattttagtagagacagggtttcactatgttggccaggctggtctcgaattcctgacctcaggcgatcctcccatctcagcctcccaaagtgctgggattacaggcataagccaccatgcccggcctagattcctcttttaatttttacaatttacccctttatcttccttctagtcttaggactcatattgtaattcaagagtgcaatgaacattgtctttggcactctcattactcttacataaatagcaactactccttttgttcttatgttattctgctctcttctgactgaaacacagtgacctaaattaagctaattatcagttaggtatgtgcagccctactttgtccagcaacagccagaacctgacttctgtttggtcttccaagttgctcttggtaattgggaaattttttgatgaaaaaaaaaatgcttttaccagtcagtaatagctgtgtgtccccactcaaaatttatgtattgaagtcctaacccacaaggtaataattttaggaagtgggggtgaagccctcatgaatggagttagggcccttgataaaaaggccccagagagacccctcagcctttccaccacatgaggacacagagagaaggcactgcctatggggaagcaggccctcaccagccgctgaacctgctggtgctttggtcttggacttcccagcctccaaaactgtgaggaaataaatatctgtggtttgtaagccacctggtttatggtattttctcatagcagcctaaattgcctaagacagtgtccatgcaaactaatttacacaacacaaaaaataatccaaatattgtgttcagaagtggaatggtctgtgtaatataaaaatcagattttgaggttagactgggtcttatatcttggtcctagagtttccgtaacaaagtaccacagcctggtggcttaataaaatcagaaactaattctcccacagctctagagggtagaagtccaaaattaaggtgttagcagggccatgctccctccaagacgctaggtggaatctttttttgcctcttcttgcttctgatggtggccatgcttgttttgcattccttgaccagaagacgcatcacttgagtctcgggctctgctgtcacatggtgctctccctgtatacatctatcttcacatcatgttctccttttcttaccaagatacaagtgatgctagattggggtccactgtgatggccttttcttaattaactctgcaaagactttccaaataagatcacatccactgcgactgagggttaggacttcaacatctatctttctggagaacacacttcaatccataatacactttgtcacttaagcatcttgaatttcaattttattaagctggggataataatgctgacttcacaatgtttctgtgaaatgaaatgggacagcaaatgtaaatgactgccatggtgactgactaatattaacattctgtttatcccctcacctccaagaaaaggtgtattcatgccttttccagttcctcccttttctctaccttcttcgctgctgcatgaggcatagatgacagttcaatagcccatatctcagatttgttttgtggccaaactgctgtttagttctaggtctgtttttctaaatatccactcggaatctccctttgaatgaccttaaggcctttaaactcattatccaaaatctaatcaatgcactttcttgccaaaccttaatccctttcgagcataactatcacactcataggactcagattgtaattcaacagtgcaatgaacattgtctttggtattttcattactcttctcacatccagtccactatgaagtcctgttaactttggctcgtatatctctctcaaacctttccctttatgtccatctccactgcaaacattctggttcaagtagactttacttcccacctggttgctgcctcctaggttttcgacctatgtacctgtagtggacaaaataatgacctcctgactgacaatccctagagcctgtgaatatggtaccttacataacaaaagggactttatagatgagattaagttaattgagatgggacaatagccacattatccaggtggcctcaaggtaatcacatgagttcttatctgggaaagagggaagctgtagaggcacagagaagagaggtgatgatggaagcagaggttggagtgatgagctttttagatggaggtaggggcaaggcaccaaggaatgctggtgcctttagaagctggaagggatgagaaagcccattatcctctggagcttccagaaggaggattcaggccaatatcttgatttaagcccagagaaatccatttccaacttctggcttccagactataggatcataaatgtctgtggctttaatccaccatgtccatggtaaattcttacagcagcaacgggaaactaatatgctactgtttgcctcttcctgtaccttctctatgcagacaaaataatgccatcttcgagagtcagatcttcttgaaaccaaaattagataatcttcctgacacattcttacatccctggtccacactcgtctgatccttgtgtagtaggatcaagccttccttacccttcacgttctctgcaccaaggtctcccatttcctggatctcactggctccttcctgctacaggaattttctcatgttgttccctgtcctcagaacagctgagcagccccatcatcacttcttataatactctcttaatatcatttatcttctctttttaacccttgtcatcattgccactgacattttacagttcttgttttttattttgtgtctctttttctacctgactttatgtttactcctccacagagtcggggacagggcctcgtttcctccctcttcctttacatcattgtgtccccatcctccagctcagtgcacttgtcactgtgggtactgaaacttatgagtttaggcaaggaatgcacagaagaaccccagcaatatccaggctagagcatgtttgtattgctgcctggactgttaatagcatctgtagctttgtaatgtatctacttgaataattctacattgacaatgtttctacccatctgaaataaataaattaacttgcatcatcttttcataagttcaggaaaggcatttcttatggagttatcatcatttgcatgtcagaataattttgaggcactgaagtcattgacaattcaatgtcggaagtgatagtgtttcaagcttttaaaaaatctgtaacggtacatatccaatgtgttctaaatctttatgtctcagaacagtaaattaatacagataaataaagctaaaaaaggaacagaattaagttccaatctgatgtggataaaagcataagataatgtttaattctctaccacattcagttataagccaaatagagtatcaacaatctggaaaagattaaataaaaggtttaaagcacatttttcagttcaaaaataggttattattttcaatgctcatggcacttacaattccttagaaatattctgtccctttttatgttacaagtgtgtgggagatggctgtttcacataagaataagcctggttcaggccctgttatgaagtgtttctcagtcagagaacccaaatccacaaaatcccactaatcctaatcacccagctaatccctttgagaagagagtggagacagggtggaaggtgaaggtgctgctcagggtatcagttacactttctgtgtttccagaaatgtggcctcctccaggagaaagaatttactgggcctctgggtgtggaagggaaactgggtgggatagggtggggcaaagcaatgggtgctcaacccaaacccttgtagaatctattccaaaatcttcaaattaaagaggaccaaagagaaaggctgtcatgattgacatgaagtcatctgagaagagtgcctattcagggcagcaagacggaggggcaggggcttgggttgtgttggagggagtagagggtttgctgctttgtgagcttgacctcaggcagaggacaattgctacatccatatgttcaggcatactatggtcccaccagtatctgcaggggttcttttaattcagtatgttgtgatgctaacaaaagggctagttaggaagggcctgcccagtgggatgaaggatgttgtctaggtggttgctacagttactggagcacaggttgagacaggcgtggtgagagttggagctgggcaggctggtaaggcatgatcaggaagggcctccagggccatgttttggagttgagacttcagtccaacaatgaattctatgggaccttcttccaggaggtttttttcctatggttcttgagcaaatgccttgtgcacaatctctcccaatacacattctagcttacaccctgttggtcaataggaaactgttgaggaaggttaacaatggagtaaaaatgtcctattttggacagacaaacctggtgttccacgagggtccagttggaattaaagagaaggggaaagacccagcatcctccaggtggctttggccatcatctgagtgacaatactggaggaccttagctagcacgggtgaatggggagagatttagaaagcaaaattggtagaggttcagcagagaaataaatatgtacatgtagcagagagatatggactgggagaagacatctggcaaatatagaaagctgtaacatcaaaactgtgaaaagactgacattcattaaacatgaagtgtggagaaagaagaaaacacacaaatgctaaggagaataaaatgccaaagaacaaagggagatgagcccttgttgaaaagtgagaatgaagcagaggtagaggaaagtcagagaaggataaagaatcaggagaaatgggaggaaagggtttcaccaagggagatggcaaaatgtcactataagcagcctgctagagcaagcctctcttccagaccacagttatccttccttacaacttctcccttttcaagccgctggctgagagttttggttacttctgtggatttcttctatcagatatgctgcctcctggcctgcatcacctcggtccttatcaatgggattggtaatgtattgttcctctcatctcttgttttgggtggacatctctattccacttcctagatatggccagtatcctttctccttcccacacccatcactttgcagtcaatatctaagatggataaggcccattattctgagaacatctatcatttgtttaatgagccttgtctgagccatttactctctgggtctaaaaaatatgttggaaaggaggaaaatgcagccactactgctcagaggtgacttcactaccacccaatggactgcttaggagtaggttggcaggtaccagaggcactggccctacactctgctctggaagattgaagccagagagcagaatctcccaggttcacttttggcagcaagtaaacggtgtcatgtgacaggttttccaggaagtttgcatgggtcactttacattgttgtctcctagcaatagattgatggtggtcacactttctgtgtatctagattatgccctcttgggtgtgatgtgtgtctcctggcagtgacatacagaggagttttcccacttctccaaggaatagagagtcactgagaccatttgacatctggagtggagcaaaggaactttgcaagcctcgttcaagagaagggtgagggagcttgtatgtccaacctttttatcctctctggaccacttctttgcatctgtgctgcattttctgatccagcaatgttctctttgaagatgagataggagtagggacccatgctccttgctgccagcacttgacccagctggcacaggtagagcaggactagtctcaagtaggaaagctggttccatattgtggtgagactaggggagtggcagaaagtgctttagcctcacatctaccctagctaagctctggaatgctctccacttttaagcgatgcaagggacaaaagacgtttctcttaggatggctatctcctctggccagctccgaatgcctatccctcatgatggttacatccaggtaaggtatggagaggaaaacacagtctcagagtttaaagtgaggtttcattattggtaatgatttcaggactctcagtaggaagaggaaagtgaaacatgtggttctagatttcaaacttccaactaactatcagggtttgtgaagtttctgggatttttattctaattgcaacctgatatattaacctgttattgcttcacgaatgctggcagaagacatgatagtcctgtgtcagaaacaaaggactttatcactcatggcgaagcaagcagcattagcttcactctggtttgcactggtttctctttctctccaagttttatgggccgacacatgtgggtctacatgatgcctgtctatgaagtgggttgggtgacagcaacaggacctggagcctggagaacttattgcatttgcatagagcaacaagcaagcatgatctgtgtctgggggatgggggttggtggcactgttacatcatccttcattgatgctggacaaacacagtcctgagaaaggggccaggattcttggcacaccaagcaaaaacaggcaggaatgctaaggcaccatggtaggttgcctttgtgacaatgactctctgaaaaggatgctgttagcttgctttttaaagaaatcatgttattttttcaattaaacatttaatatctataacaatgttatagcattggttgagggtagtaaatcaggaaagatctatttttagttgagatgtgtaacgtattagtgtatgtgacatgaagttatatggattatatggagacagtttactctgcaggtgttctaatgcttatgcaaaatcctgaatgtggcatcttgggggatttccagtggtcctgtatctgacatgttattctccaatatactgcagttgtaacatttgttcttaatgcacagatagattaatctccctgcttccactcttcatttgctcatgaagtatagctctagtcaccttcatccactccctttccttggacacagcaacacgtgtatgatcaaagatcttttcacaaatacagtatccctcttctgtgatggtttacaataatcaatagcatagatattttctaggtctgtgcataagtggatatgcctgccactgtatatataggacctagaggatacaacctgatagaacataaaagaatctaattcttagcatgataactgtattcttactgctcctacaaatggactaactgagtcattctcttaccattgtggagtttgcctacaacaattcaccacccttcttgaggtaaaacacactgtacctttgcaactatggcttctctgtcactggctcctttcactgctgactgcgtccaccatcctcgcttccagcagtagcaggaggagttgtggactttccaagaggatctgtgatatatttttggccatgccaataggctgagcaagttttgatgaccaaggcttggttccagtgaaagctagggcagccctattagttaatactacaataataatgaaggaccaataaaaatagaatcatgaaaatctacccatagtcaccataagagtgctccggaatgttccagaatggccttccagcaggtgatcccaagaggtctccaggtgagacccttggattttctggtccttacactggcaggtcatgcagcactgggctaaaaatgcagtaaagcaaactgtgcacaggacaagaggtaaggccaagtgaccatttcacacctctcctctcctccttactccttccccttttaatgttcttcacttgcttactgtcacaccccgggtttccagaacactaactcttctcccacttcactttccctcataggtttatccattctctggattccctgtaggattgtttgctcagtggctgtcatctctgccttcaaccctcactgctcacctggttcttctatatctcggtatgtaaccatggtgggtggggaagcagttttgttaattagagaagtagagatactctcctctgggtttcaggaagtaggagaaattgcttccaggtagaggtcagggaaatacttgtgcaggagaaagcatctgcctggaatcttgcagacagtgtgcatttccaactaggaagacatcaagaggggctgtgcaacaacagaaagacccacaggcagttcactgagggcatcctgagcaagggtgagaagctgagtttaaacgaaacagaacacacatatgtgctagtgattgctgaattctcagatgttgcttttctgataattgtacatataatttcccctctttctttttcactttccaagtgtttttttttcttttcaaagctgcaatgttggttgccactctgaaaactcagtgttatctggagaagcatatgcattttatagtccccatcccttgactcttccttaacaatctcatctttgtggtttctccagtaaatttatctgaacagcagcacattattttctatttatcctggatcatttaaaaattttctcaaagggatttcttcaaagtttactagtttctttctcttgctgtttgcccatattcttggaagcatcacagcattaatgattctgtgattgctggaccgtagaaacttggcccttgcatatttgctttcatcattctttgtttattaggaggaaatccaggaaataaatcaagaaattagagcattctctggagttttactgcggctcagcactccttaaaaaatatgtcctgctgttcatttattccaaagtgtacttgatgattctctgggaattcgctgtccatcacatgttagaacattgcaccattcaaaaattcatcgcttagggacataaactcattggggagagtttcttcagctgtttttctcattagtctttaactttccagaaactgcctcagagaaagctttaaatgctcgctatttaaactacaaatatacagcagtgatcttcccattttgtcaaaaacttccaatggctgctgatggaattgggtctgcaataagaagaagagtgaaagagatggatcagaaaacattagactgcagaatttaaagcatatatttgaacatactgtctgaatgaaaagggattaagccataaagttgaaaacatttatgttgtatagcaagcagcccttctttccaagcagagacttggtcatgccattagtttttccatcaaaatttcttgaattaaatatctaagaaacatcaattgagtggctacagtgtgccaagtatctaaaacacaaacaatgtaagcagagtctctggctccaagcatattacaaattgtactgtaatagcgagatttagcaaatgattttgataatgagccaaataaagatatatgcccagatgtttccaccagtggaggacctctccatgcctaggcacaggctacgattaacatgcttatcgcagtggggttgattccaggaagcagcacccagatgggaaaatgtagccaagagcaatcagggtcaatgaaaggatggtgagtggccaagagattggagaaagtgtgagctatcatcaaagtggcacagaacagcccttgcgaagatacaacaggaggaattcaggttctcatagcatctttttctgtgttgggccacctttcattatatgtgctgggggcagttagaaagtaaattgcaaaatggagttgggtaagatgttcagctctgtctagggaagcagtgaaggcaccataggatgaattgaattctgaaggatgagtcatagaccaatgctgttttattttgtttgaaatgaagctgtcatcaaaatatgtattagataatcaaaatatgtcttagagattttccttctaagaatttttatgtgcatgtgtgtgtgtatatgtttgtgtgtgtgtatatataaatatatatttacatatacatgtgtctataaaagggaatatatatataagagaaaaaatatatttctcattttctgaaaaataagtctatattgaaatgtttttcgtttatatagttaaactatatttatatcaaatatacaatgaattaaagaaaatttgtgttttggttaatctaattggttgagaacattgctctgtttctgattgtattattctgttttctacagaaaaaaataattcttttgggttcaaataaagggactttaagaaagagaacagttacagaggtgaggtctttgttaaaaacaagggtactcagagatgagccacagcagctggagaaaactggtatgacttgtaatgcctgcgagatgttgggggaggggataggagatgctttttgagaacagtgatcaggtagagagatggaggaaaagataactgagaaggtgtggtgccaaaccagaataccagaatatacctctgaacaaaatatatttgtattagtgatatggtttggctgtgtccccacccaaatctcatcttgaatggtaactcccataattatctcctgttgtgggagagacccagtgggagataactgaatcacggggcggtttaccccatactattctcatggtagcaaataagtctcatgagagctgatggttttataaggggaaacccctttcgcttggctctcactcttctcttgtctgcttccacgtgagatgtgcctttcactttctgccaagattttgaggcctccccagccacgcagaactgtgaagctattaaacctctttctttgtaaattgcccagtttcaggcatgtctttataagcaatgtgaaaacagactaatacaattgggttatctgtaatttgttagcctgggtacaattctacaagagtaaaaaaagccattccattcagagaagaagcctgtatgaaggcaagaagacaagaaaatgcacggtgacctggagaccacctcagtggacttcaggtgatggagggaaaaagaagctgagtctgcaggggaagattttgggagaatgcaggctttgtgccacggttaatgagacctacaattagcattaatcttcactagcctacatcttagaaaatatcttccaaattgtgtgtgagactctgtcaaagacaattaaattggacttaacttgttaactagttaatgggacaagttctagttacttcagattctgtctcaggaaatagaaatggaattgaaactttgtgaatgacttttatatcaccatctctctggcatgttttgaaaattgtttgaataattcagaaagaattttctgaatcttactatatgctaggctctgtgatacatgatatacatctgatttcacattttaaccttaggcataagatggatacaaatgctaggaactgaactagaacagtgaaaaaatgaatagagtccctaccttcatggagtttataattcagaaagaaccactgagaatttgaagtgtttatgagcacatgacatttttgaaggacacctggcaggtgttatatgtgaagcagattcatggtgcgccagttaccagtcctaggggagggctcccactgcgtggaaaacagcagaaatcattatgaagtcaatcatgaggaacaggagtccaaacgctttcatccactgcattttgagctgcaatttctacaacttgcacaagtctggtgagagagaatttatacaagtgaagcaactttattgctcacagacatgctgcaagagacagtagaagccatggtgagccaatctctcaaagctcaggaaagcctcgtaggatagatggagtctcacctgcatgttccctacattataccatagctgaggaatccaaaaagcattctgcactggggtttataccccaggaaaaactgggatcgctgggctaaagcattgtgggacattctattctaggagatataggaacagagctcaggctattccagccagttcctccttatctcagaatgttgcattctcagcatgtcccacagttattctgacatttacaagggaaaactgaggaagagctgggtcagccaaggctatcttgggatgtcctgcactatgagaaaaagtggagcttcatctataggtgataattcaaggctccccggagggagaattataaaagctgagacttgaatgtggaagattcagccatgaaagaaagtgctgaaggtgggcatgtcagtgcagagagccccatttcaagcagggaaacagcgagagagtggggcccattcgagacacttaagatcattatgtttaaagtagtggctgcaagagagaaagctaggttgccttgtgcaggatctaaccataaatgtggtttgcaacacactgaccctgaaagataaagttatgtgtaatgctaagttagttgacacaaacccagaaacgcattccacccctggtgctatgagagacatccagtagttagaagctgaatgaggacactgtcattactttgtaaaggctattatttctggtgtacctatccaggctgtcaacgtaaaattctatatattcaaagttaatacatatccgtctctcttcacttggatgtgaaactgctggtggagctagcaaagaatttgcaagtttagtcaagtctgactgacactcccaagggcaatgaggcatttgcccctgatttaggtgaccaggctggtactcctatccagggtcccttcatttctcaacagatatttattgggcacttgccatgtgcggggtcttgtactcagaactggattgattaagttatagctctcaaggcagccacagtctattaggaaagcagagaagattatacatcagagataataccacatgataatgcttcacaaaaggaaagtacaatatcctaagggaaaagaggctacctgaggaatctgagttaattcatttgagtcaccttcaaggaataaacaggagatttataaaagcaaactgccatggctgaaatttcaattcacttggcaatttggaatttatgttagactcaaaggtgtttagtgcctcccgccacccccacaaaaaagtgtccaaatatattccaaaaacttactagaatatttgcattgaaaataatgtttatggttggatataaggatgttaaccaaatacacttacagcactgattttttagacaagtgtcagactttaagcaagaagtattaggatatctacagaaatagctgaaagggagttcttaattaagcccatcatttttgactgtattaactgtagggagacaaacagaagggttgtccagtggttctccacttattgaaatctctctggaactttcatcaaagagaagtattaaatgcattcagatgtttgaaatgggatttttttcaacagctcaatggattctgatattttctcagatagattgagccagttgaagactaagctggagaagccttcagccagtgagattctgctccttcccccccatatgaaaaaagggttattacggcttcagaggattgaattctagatattttggtaattgctaagaagcgtagaagtaagctctcctgtcataaaaatattaaaaaccaatgcagtttaaattgtcaaaacaaaacaatccctttatgtataggtaccacagatggatggatgatgcaatgtgaatgataaatgaccgtaagctctttaagcaaatgctaacctctagctgggatgttataggagtcccattcagaaacggactttgcattgagctagccatgaaaccttacacttgatttagtctgtgatactgccacagtttgatctttgccttcaatgactgattccttgtaagaaataaagctgcagaaccaaatgcacactctctctatagccacttgagacagcaacatttgcagcctacttggtataattgcagatttaaaattacattagaatattttctcttttctgttccctttttttctgaacaattcagatcaaaagttgctaggtgggtctgagcaaggttattttctgccgtgggtggcagggtcctggcttaggttatcagagacccagctgtgtggagactgtcagtgggttggggaaggaggtgacagctcagcatgggttattggagctctactggaataaatagaatgtctgaggggcatgagtgataacaagaaattggttccatacaaaggaatccattaaacaggtaatgatatgaggatattgagagacagactctcactgtcagagaagaaagttaagtatcctaaaagggagaaaattagaatgaaccttattgcatttggatataactgtataaactaatttccaaatatctataaataaaaataaatatgtctatatttaaaagtaaatatagacgtaaatgtgcatataaaaacatatatgcatgtacattccctagtgaaattcactgaaaaaggctgctgaacatcaacacacacattttggattttaaagatcatttcacatctctaacaggcaccagggctcttggaagaaatagctgattccagggcaggggcagagaaagtacaagataagcctggaacttctttgttttcacaaaaatgtaaagaaaagcacaaaaaatgataatgattgataaattaggctcctctggccaaatatgagacaatttaagcaccgtattagtgatcgtaatctattataatttgttgaataaaatgatgagccatgagtcgatattaacataattttttcaaatgagtgaataaatgaaaaatttgatgaggaaaaggatattcaaatagtttcaaagttcttcccaataaaaaaataagttataaaggagaaaatagtaacattacagtggagaagactgacagacaccatcttaatcaagcaatcaaaatgaatatcatcaagaaaggggtgaatcaacatcatatgttaccttataggatataatgagaaaaagtagcattgtttttgtgatattccttatgaatctaataataaggaaatgtccaaattgaaagacattttacaaataacttgccttcatctttcaaaaggctcaaaagcatgaaagatatgaaacatctgaggagctgtaactaatggaagcatagtaaagatatgcaataagtgattaagtattggatctcttgcttgctatatattggacaattggtgaaatttgagtgaggtctaaggtgtagatggtagttatgtgtcaatgtaatttcctgatattgatgtctgtactgtgtatacataggaacatgtctttgtaggacatacaggacatacacactaggagttatactccaatggcttataaaaaaagaattgtactgtttttgcaattttttatggaactttgaggttgttttatatgtatatacataaataaatttatatatataaataatatataaaaatcaatttatatatatacaactatagtagagaaagattaagtttaatgagtgcaagacagccaagtgggagaactggtgttatcacttaaactggtctcactgaaggcttgaaggttagagtttttcaagtatagtttggtggccaggggattagaggataggtgctgctgattgtttgggatgaaatcataggggtgtggaaagcagtcttcttacattgagtccactcctggattggggaccacaggactggttgagtcatgagtcacaagttcagatggggtcagtgtgaaaaccatctcaaaagaccaatcttagcttccacaatagtgatgttttcagcaggagcaattgaggaagtcacaaatgttgtgacctcttcccacgtgactcctgagcagtaagagattacagaaactatgcctactttttagcagaatgtaggcctctccaataattctaatcttgtggcctttcattagtctaacaatggcagtttcagccccccaacaaagagggaatccattttagggagagaccattatccttgcttctaaattaaactataatttcctcccatggttagcttggcctatgctcaggaatgagtgaggagagccagcctgtgaggctagaagcaagggggagtcagtcatgttagacttctctcactgtcataatatttgcaaagctggtttcagtctctgccttaggcttcagtatacctaaattctgaggtgtgagctgcagagatgagaaacagccagtgaccaatctaacttcttcctactgaaagaggacagggtttgggtaggggtcacccacagtataagaggaatgaaacaattttgcagttgtctgtatgtatttatgggtgcctggtttgggtctcaaggtctgtataacaaaaacattagtattcatatttacagttttagtacagcacttaagagaacagcagactaaaaaacaaataatgagccctaacaaagagagtgagggtctttgcttcaggagtccctgcagaactgacctgaaaatttgagtgatgccgctgaatgaccttgaaaacaaatcagatttgaggtcaccagtagagactcaaaaacaatagaccgagttggaatccaacaacaggtataatatagttttttacttgagacataatttttctctctccagttccctatttttaccaaagacaaatcacagcagcaccaatttatttgcaaaacaagtttcagttccattatatttgtcctaattatttgcataaaatgaattattttcataaggaatttgagatttaaccttttaaaagcctcttgagcccagccaaggatttatctgtgcctacagatacctgtacaaattgggtgaattcctgtcttcttgaagtctcaaaatagcttagggtttctgggcttgtcagaaagtgacattctttacttgccacagatcaggaaccctgcacaggacaagatatgaggccagtttctccaaggggcttttattggctctataaatcaacctccgttccacaaagcagtctgaaaacatgtcattccagtaaaaatcttggtaaaaataaccagtgtctctaattgtgttctgctataaaagctaatacctatattgccataaattaagaatattcaccaatagtaaagtatactcctgtgagcaaaatttggagcacatttctctctacctgatttctccagaatttggaaactattggttgtaagaatcaaaaccaaagtaatcagcaacattttgagtaaaaactcatgctattaactcctgctctacttgatattgggccagcaatccttacaaacacatcagctctccatgagagtcctcaaagttattgttctctatttcaatgacacaatttttaaagttatcaggagcccatcagagcacccaacagagtctgatagctagttataaaaccaacttttgaaaagaattaaagtaaaacaaaaaatacatttttaaaattaaaaattagatgacacctttgtataaatacttaaacgttctgaaaattttcatgtattcaaagataaggaaatagggaatatcaaactttttgtaacataaaagattggaaatatcattaccatactggacaataaaatcagtgtaactatggcactgtgaaacaaagaattacttactttctgactcatgaatctcagagaaaacttaggcactgctgtgttcctcagagctcggaagaagtgttgcatcacaaaggatgggcacgatactctgatggtcctcacgtgtgctccaaaaaggggcctggtaatgtagtgaggctctaatgagacaaataggctgcttataaggttctggagtgaactcatattatagtaagcaagattttggagaaaggttggatgataatcctatgtgaggtagaataaagagaaccagtcctatgagagcctgtatctatgttgtttctaattttggtgaaaaggagaaaaaccatcttcagattggaaaagacagatcaaacatgagcaggaaggagtaggtgagttacttaggagacacagtgggtatttgtagaggcaaagacacaaatattggctctcaaaactggcccaagtgtttttttctccaggcagaaatagggtccttgtaaaactctctggcattctgagggatcaggaaatcttgcatcagtgtgaacagaggttcacaagatgggtaggaactgtttcaatctttagaaaggaaggagtaggccatgggttactcctcatattgtaagtttgtacttcaagacagcatactatgcagtatgcctgtggatatgctggagaaatggacaaatgtgagctgattaacactaaatggttgaagccttataacacagatgataatgcactgaattactgactttagtttattgatctgggtgatccagtaacaaaactgtaaaggagaaataaggctttgtgcttgagctagtcctcttcaagatgttttcaaaacatgtaagattcctctgctctgcgtgtaagactccacagtgtgtcaaacaaattggccctgtgtgaagactccatggcttgcagcctgctcacccttacagactccattttccacacttgctccctgagtgtccccaagtaatccctcctatgatgaactttgccctttcatacatctgaatattttctctgtatctcctctgtttgaatgctttttttcttctttacctcctgaatgaaatgctataaatgtttgggaagcagtagcaagataggttttaaaattagaaagaccaattttcaaatcttgcctcttttgcctgaaaatagcaggacaactggagctgttacttaaactctcttgaccttagatttcttctccgtacaatggatatggaggatgtctctaattgagacagttgtttttcaggatcaaattaggtaattaatataatacttttatcacaagtgctcatgtagtaaagattaataaatattagctgccatattgtcattgctatcattagacccgaggctggatcagggtatcattaatagtctgggctttggctagatgtaccagctgtgtgactgtggtgactttatttaaactctcaacgattcagttcttttatctggaatgtcaggacagtaagggttgttttgggaattaaatgagataatgcacataaaactggcatgtgtcaagcacttaataaatgttaactattttcattactagttgcattagtcaggctgccataacaaataccatagacagggggcccacacatcagaaatttatttctcacaattctggagactggaaagtccaagttcaaggtgctggcaaggtaggttccattctgtatgtgcttcttcttgcttatatgttgttcccatcctgctgcatgttcacatgacctcttctttgtgaacaccagggagaaggaagaagttctctgctgtctattcttataagggcactaatcccatcagaccaattccttaccatatggcctcattcaacctttacttacataaagagccctctccaaatataggcacattgggggttagggcttcaacatacaaattttggggaggacatcagaattcatcctgtaacagtattactattgttgctattattttttaaggtctaacataaatatcaccttatattttaagccttctcttactttctcagaattctttcctctttgtatttatgtctttatgtatagagatgtatttcatcttaaaaaaggtttaagttactggcttcacatacaactggctcacaagaaacttcagtagaactttactgaaaaaataatagaacaaacacattcatagggaattgatatcatacttattatatgtgactgtagacagctggagtagttacagtgggtggaagttatgtggattctgggttaaatactgaggaaactttcttacaattaatgttgactgaaattgaaatagtttgcctctgtggtagcattaccaatttattcagctaccttgttctaaatagacttgccctagtgacatgtttgtggctgaaaactacctgagttacctggggcaatgcacttcctctttatgggcctcatgtgtaaaatgagaaagttggtatagatctttctctaaattgtttttcatttcttctttattgccatggagatgatttttttttttggttgtcacgttctagagttttattttttttcctaagaagtcaaacatgtaggtgagtattcaccttaatcttgagccccaagttatctgcttcttttactcacaacacatttagttaaaagagcagaaactcacttgagctagcttaagtaaagggaggtttattgtaaggacatagcaggcaacctcatgagcatccaataataaaaaataaaagaattggacctgaaaagtcagattccaaggctatgacttcttccctgcctaatgacagcattacatttaaactccatttctctccccttgcctgttccatcatctctcttttgaattactaaccttctctgtttcttcatgagtgtgcccaaccaatggtgataactgcccactcaactcaatcaataatgacacaacaaaaacaaattaagccagactttagtctctataccccttaattcagttggttgaaatgagaaaactgattttttcagaactagccttggatggtggcccttgggttgggcctcccttgtaccaagtagttgtggttggtggtaagtggaaataggatcacaacttccaggaactacaagtaggaaaataaaactgactgataaaatagccacagagatggtctataaatatgcaaagaatcctataataaactgctgaatttcaaagaccttcagggaatgaaatatgaaacatggtctagggaaaacagcaagattctcaagatgctagcaggataatgtggacccacagagtgaagccatgttggttcccagtaaggctgacttgagaaagtgtgcttctgttgatatggcttttccttttatttgttaagatataacatatatatattatatataacatatataatataacatatatatattatatataacatatataatataacatatatatattatatataacatatataatataacatatatatattatatataacatatataatataacatatatgttatatatatttaatatatataaagcaaaaaaagcaggggttgcaatccggtgtctgataaaacagaatttaaaccaacaaagatcaaaagagacaataatggtaaagggatcaaggcaacaagaagaggtaactatcctaaatatatatgcacccaatacaggagcacccagattcataaagcaagtccttacagacctacaaagagacttagactcccacacaataataatgggagattttaacaccccactgtcaatattggacagatcaatgagacagaaggttaacaaggatatccaggacttaaattcagctctgcaccaagcagacctaatagacatctacagaactctctaccccaaatcaacagaatatatattcttctcagcaccacaccacacctattccaaaattgaccacgtaattggaagtaaagcactcctcagcaaatgtaaaagaacagaaatcacaacagactatctctcagaccacagtgcaatccagttagaactcaagattaagaaactcactcaaaactgcacaactacatggaaactgaacaacctgctcctgaatgactactgggtaaataatgaaatgaaggcagaaataaagatattctttgaaacaaatgagaacaaagacacaacataccagaatctctgggacacatttaaagcagtgtgaagagggaaatttatagcactaaatgcccacaatagaaaccaggaaagatctaaaactgacaccctaacattacaattaaaagaactagagaagcaagagcaaacacattcaaaagctagcagaaggcaagaaataactacaagcagagcagaactgaaggagaaagagacacgagaaacccatcaaaaaatcaatgaatccaggagctgattttttgaaaagatcaacaaaattgatagaccgctagcaagactaataaagaagaaaagagagaagaatcaaatagatgcaataaaaaatgatacaggggatatcatcactgattccacagaaatgcaaactaccatcagagaatactacaaacacctctacgcaaataaactagaaaatctagaagaaatggataaattcctggacgcatacaccctcccaaaactaaaccaggaagaagttgaatctctgaatagaccagtaacagcttctgaaattgtggtaataattaatagcctaccaaccccagaatgtccaggaccagagagtttaacagccgaaatctaccagaggtacaaagaggagctggtaccattccttctgaaactattccaatcaatagaaaaagagcaactcctccctaactcattttatgaggccagcatcatcctgatatcaaagcatgacagagacacaacaaaaagagataattttagaccaatatccctgatgaacatcgatgcaaaaatcctcaataaaatactggcaaaccgaatccagcagcacatcaacaggcttatccaccatggttaagtcagcttcatccctgggatgcaaggctggttcaacatatgcaaatcaataaacataacccatcacataaacagaaccaaagagaaaagccacatgattatctccatagatgcagaaaaggtctttgacaaaattcaacagtcctacatgctaaaaactctcaataaactaggtattaatggaacacacctcaaaataataagagctatttatgacaaacccacagccaatatcatactgaatgggcaaaaactggaagcattctctttgaaaactggcacaagacaaggataccttcactcaccactcctattcaacatagtgttggaagttctggccagggcaatcaggaaagaggaagaaataaagggtattcaattaggaagtgaggaagtcaagttgtccctgattgcagatgacatgattgtatatttagaaaactccagcatcttagcccaaaatctccttaagctgataagcaacatcagcaaagtctcaggatacaaaaatcaatgtgcaaaaattataagcattcctatacaccattaacagacaaacagagagccaaatcacgagtgaactcccattcacaattgctacaaagagtacaaaatacccaggaatccaacttacaagggatgtgaaggaccttttcaaggagaactacaaaccactgctcaacaaaataaaagaggatacaaacaaatggaagaacattccttgctcatggataggaagaaccaatattgggaaaatggccatactgcccaagataatttatggattcaatgcgatccccatcaagctatcaatgactttctttacagaattggaaaaaactacttcaaagttcatatggaaccaaaaaagagcctgcattgccaagacaatcctaagcagaaagaacaaagctgggagcatcacgctacctgacttcaaactatactacaaggctacaataaccaaaacagcacggtactggtaccaaaacagatatatagaccaatggaacagaacagaggcctcagaaataacaccaaacatctacaaccatctaatctttgacaaacctgacaaaaacaagaaatggggaaaggattccctatttaataaatggttctggaaaaactgcctagccatatgtagaaagctgaaactggatcccttccttacaccttatagaaaaattatttcaagatggattaaagacttaagtgttagacctaaaaccataaaaagcctagaagaaaacctgagcaataccattcacgacataggcatgggcaaggacttcatgaataaaacaccaaaaggcaacaaaagccaaaatagacaaatgggatctaattaaactaaagatcttctgcatggcaaaagaaactaccatcagagtgaacaggcaacctacagaatgggagaaaaattttgcaacctacccatttgacaaaaggctaatatctagaatctacagagaatttacaaggaaaaaacaaccccatcaaaaagtgggcaaaggatatgaacagacaattctcaaaagaagacatttatgaagccaacagacacatgaaaaaatgctcatcatcactagtcatcagagaaatgcaaatcaaaaccacaatgagataccatctcacactggttagcatggcgatcattaaaaagtcaggaaacaacaggtgctggagaggatgtggagaaataggaatgcttttaccctgttggtgggagtgtaaagtagttcaaccattatggaagacagtgtggtgattcctcaaggatctagactagaaataccatttgatccagcgatcccattactgggtatatacccaaatgattataaatcatgctactataaagacacatgcacatgcatgtttattgcagtactactcacaatagcaaagacttggaactaacccaaatgtccatcaatgatagacttgattaagaaaatgtggcacatatacaccatgaaatactacgcagccataaaaaaggatgagttcatgtcctttgcagggacatggatgaagctggaaaccatcattctcagcaaactatcacaaagacagaaaaccaaacaccgcatgttctcactcataggtgagaattgaacaatgggaacacttggacacagagaggggaccatcacacactggggcctgtcaggggttgggggactagaggaggaacaacattaggagaaatacctattgtaaatgacgagtggataggtgcagtaaaccaacatggcacatgtatacctacgtaacaaacctgcacgttgtgcacacataccctagaacttaaagtacaataaaaaataaaataagtttccattcaacccaagtaagtgccttagaaataaaatttatggaacatacgatatttctttaactttataataaattcctaaattgttttgcaaagtgcttgcaacattttacattccacaaacaatatatgagaatccctgttcctctgtatcctctggatgtgtcagttatttttattttttagcagtttaaatagatgtgtagtgctatctcattgtggttttaatttgcatttttctaatgactaatgattttgaacatctttttgtgtatttatttgccatctgtatattgtctttgataaattgagtctttcaccaatttatattaggttgaatgttttcttatttttgaattttcatagtttttaatgtatttcacacatgcatatacacactcacttgcttaatcaaatgttattaacagattttcctccctgtgtaaagcttatacatatatatatttaaaaaacaacattttcaactaattttagacttacagaaatacagaaacagtttcctttttttcttcaccctactttgtctatgttaccatctcacgtgctcccttaatagcattgtttgaagagcagaagtccttaattttggtcaagtccaacttatcatttctttttcctttgtaaaacatgtttttggtttcctgtctaagaaggctttacctaactcaaagttgcgaaggttttctctgttttcttctggaatatttagggttttaggacatatgtttatagtacccattttgagtaaattctgtatacagagtgaagtgtggattaaactttatcttagcttatttttttgcaaataaatatccaagtattctagtaatgtttttttttttttaaaaaaaaactatcctgttttcactaaattttgtttgcaattgtgttgaaaatctcttgaccatgggagattatttctgtattgtatcctactgcattaatctatattctttcaccaacaatatattgctttgattactgaatgctataaatcttaaaatcagataacatgacttctccaaatttgttctttctaaagttgtttcaactctactctttttgcattttcacataaatcatggaatcactaagtctatttctacaattccctgctgtgatttggattggaattctgttgaacctatagaatcactttggggacaattaacatgttaacaaatagtttctaaaataagaattttgggctattgatatgtgacctttttcttttctaatatacagttatgtactacataatgatgttttggtcaatgatggactctgtatatgatggtggttccataagtgtacaatattatattttttccatgtttatgtatgtttagaaacacaaatacttaccattgtttataattgcctatggcattcggtacagtggcatactgtacaggttagcagcctaggagcaataggctataccatgcagcttaggtgtgtagtaggctctaccatcaggatttgtgtaagtctactctatgatggtctcacaatgactaaaacacctaacaacacctttctcacaacatgaccctgttgttaaatgatgcatgactgtacatgtatactgctataaatttacctctatttgcatccaaaatttgatatgctataatttttatttcattcaactcagagtattcactaataacttgtttaattttttttaacttaaaccacatagtaattagaagtttgctgtatggtttcaaataattgttttgttttcactgagacctttgtgtttttgaattttaatttgatttttctttacacgacatagttcataggattccaatcttttaaaagttatttagaattgtttgataaccccaaatatgttccatcttggaaaatattcacatacactcgaaaaaaaatggattttatttggctgtgggacagaatatttgataaatatcagagttcttttaaaattaagcttataaaataaatagctattatttcttcaaaatttcttcttccctcaatttttttcattgattccaattatgcatatattggcccaaatgaagttgtcctatagtcactcattagtactcttcttctgcccaaatattctgttttgttttagatattttaacggctgtatcttcaatttactaatgtattcctctgctgtgttgaatctgctgttcctttcatttagttattgttcatctcagatgttgtagttttcatttccagaaactcaatttggattttattttttgtatctttgtttctcatgattatgctcttttctactttcttaaatatataaataagttataaatatataaatatataaaaaagcatattaatgtcttgtaaacttatttaatgtctggacatttttatctagatgctcaattttgtgattttatgttaattgggtctgtatccttttcctctttagttgtaagttatatctatcttacattgtctttctaagtattctcctattattattagacaattattagttctctttcaagttacctttaaacagcttcctatttttgaagcttgattttaaggcttgttagattgaaccagaccagcatttagtgcaggacctattttccccacttttgaatcaaaacccttgggttaattctttccaattccttatgtattatttatttatttgtttgttcattttacttggaacggtgcaaacagtagctcttcctggccttattttagctttgtagattctttcacctgctcctttcatgtgcttgtcttccaagcttcgggtgttttctgcacttgcatgcactaagcagtgctgtgttatacacttgagggagaccttttgcaaactctggagctaacctaccatgcggttctcttctctaggataccttgtcctaaaatctctaactatttttgttctatccaaactctgctcttcatctgctaacatccaggcattcactgggctctgtctttatttttccttttcgctaggacccagaatctctctccaggcagcaagcatgggcaactgcagtactcttaccatttgctttcccactcatagggattttcagtgtctccaaaaatgttgtttcatatatttttccatcatttttagttgtttaaggtgaggggacacatctggtttttgttacttcatcttgtaagaaacaaaagtgcctctgtaaatgtaattctcattgagaaaaataaaaaccaaataataacaaaagggctttccaaaaaacaaggtgtgatggatctcatagtactgatacaatagaatatttcagaagcagagcaaacaagaccatatggagagaatacacaactatttgaattacatgtaaattaagtagtaaaacatatgtcaaaatgtctatcacggggtttgactcagattagaaactttaatattaggaatgggggatggtgatgttctgcaattctgttcattttctaccattaaattccttttttttttttttcctgaatcaacagtggttcaggaattatcaatcaggcagttagagagatgacttacaaatcataatacaacttacagagtgtattgtgacttacagaggctgcgaaataagttattttgaatattgaattgcctgtttttcttagtctaggggaagtattcttgaaattggaattctgtttttaagtagaaagcagacatgtttagttccaatatagtgtttatttctctgaaattaatatcaaaattcagactatttagtgtttaggcctttccaaaatatattttcaaggtctaaaaagagttaagcttcattttgtatgaatattctcagaagaatactcctcaagtaaattcctaccacatcctcatatttacactgcttttaaataatgaagcaatgcaaattgtttttcatgcatatggattagaacattcaattggttttcaattatgtacctgactgcttttaagaaattccaagtttgtattatgatagcaccagctccttctttttctttctaaccttaagcaattttaagaaatcatctggcaatattaatggcatctcatgaactgaggaagaaagagttcatgaagcttcaaaataaaagaagtatagcagtgctcaaacattatagcacaggtttcctgtcttgtctactggattcaattcaattaatggcattatttgcagaggagcataaagaacacttcaaggtgtttacaaactagaagagccggacaacagggaccagaagacacaccctgaggttcattatctacttactcattcctctctttaataattcacaggatttgtactttgctgatacttactaaacaaagagctggagactgtcaggagagcagtatgaggacacgtcagacaagaatgcagcctctaatgagtctactgagctgtctacactgatcataatcaaccagtcatgataagcattcccttttgttagatgcttgctctgtaactggcacttttatatggtttaactagttgactcttctcagtagcactgtccagaaggtgttattcttccaattttatagatgaggtaataggaaaaatagcattcactaaattactcaggaaatagtggagttgccgttcaaaccaagatctatttgagtctaaaattttttttccactatgaggcatgattccattttcctcaagatttctctcataaattaatatcttaggccaggcgccgtggctcacgcctgtaatcccagcactttgggaggccgaggcgggtggatcatgaggtcaggagatcgagaccatcctggctaacacggtgaaaccccgtctctactaaaaaatacaaaaaattagccggacgtgatggcgggcgcctgtaatcccagctactagggagactgaggcaggagaatggcgtgaacccgggaggcggagcttgcaatgagccgagattgtgccactgcactccagcctgggcgacagagcaagactccatctcaaaaaaaaaaaaaaaaaaaaaaattagtatcttagagataaacttggaaaagaaagaataggacaaaaatagaaaagagtaaaattgaccatatgtgctggcctcatcctctctctgtatagggcagaccatgctgggcctcaacctaaggacatgaactgctctgctcaccagcttccctgcactggcttagctgctcacactggcctccttgattactccaggcacattctcatcttaggacccttgcctttattgtcctctttgccttggagctctttccccagagattcttatagccaccacacttaactgccacatgtctgtttaaatgccacattctgaataaactctttcatgaccacactatggaaaattgtaaccatctcagcagcatttttcatcattcttcctggcttaatttttccattgcatgtgttagcttttaatatatacattttgcatataaatgtcttccttattttgtttatcgtgtcttacccagttagaaaataaatttcatgaggccaggtattttgtttagtggtgtaatctcagctcttaaaacagtggatggtgcttaatagatgtcatttatcagggttggtataacaaattaccacacactgggtggcttgacatagcagctttttaaaaaaaatttcatatataagtgagatcatacacaaagatagagcatgaaacagaagttatgggtggtagggtgagaagaaatggggagatgtaggtaaaaggatacaaagtagcagatatgtaagatgaacaagtctagagatctaatgtgtaacacgactaataaaattgtattgtattaggaatttttgtaaaataagtagattttacctgctcatgtcacaaaaatgagatcatatgttaatctgcttcatcattatagtacttatttgtatctacatatatatcccatagtatcatgttgtaaaccttaaatatacacaatataatttattttaaaatagaaataaaaaaaacacacaacaggtttttattctctcccagctctttaggataacgatttgaaatgaaagtgtcagttggcagctccatgctgtttctgaagggttttgaaagaaagcccttccttgtctttccctggcttctgctgattcctggcaatccttggtgttctgtggcttgcagctgaatcctttcagtctttgtctccattgttatacagtgttttccctgtgtgtgtgtgtgtgtgtgtgtgtgtgtgtgtgtgtatgtgtgtgtgtgtgtcttgtgccatgccttcttcctataaggcaccaatcattcaatttaggacccaaactaatccagtatgacctcatcttaactaatcacagctacgataattctatttccaaacaaagtacattttgaggttccaggtagacataaattcttgaggggaggaggcatttattcaaaccacagcacttggtatacaatgcatgcttgttgagtgatagactatataaatgtccttcacctgccctaccctgggttcctcgctcaaacgtattgtagcccaggagactcttagtctatggccaactgattaaagaaatgggcccaattcattcatacttgactgtgtccatgcctttgaatctcaatttagccattcagctggcattagccaataagacattgcaaacatgatgcagagattggaggtatttggtgttaaggcttgtttgctatcttaggaaccctgagcccttcatgtgaacatgacttgtgtagaaagagggatcatatggaggtctcccattattctaactggcccacttgagaccatcaaaaacctgccagctctagacaacctaccagctgaccacagatgcatgagaaagcttagttgagtgcaccagagcctgatactgaatagagaaactgcttagctgaaccgtgcctaaatgaccaagctgcagacttatgaactaaatttttggttgattttttaatgcattgagtttaggggtgttattattcagaaattattacctcataccttgaccttcattggctctctattctacttaattaggaataacacacacacacacacacacacaaaacccacaaccctatatctacctacatatatatacaacctactaattcagaattttaatattgttttaattttattgaagacttccaagtataggcagataattaaagaaatattgccaatctaaattttaattattcttaaatttagataccctgcacacaagttctaagacaagagatttacatagaattaacgttttgagatacatttactttgaataattttggaatgcattcacttccgtgccaaagagattatcatatacaaagagaaaatttacactgctgtcatcagatcacatgtaattctgtgtctttgtgcatttgttcagttatggaaggaagagctctataagttctcttccaataatctcaaacataattactttttataaaaatcacatattatacaatgaatagaaaatatattttgatttctttttcacatacaactttcaatttagtcttgaggttgtagaatttccctaagggaaaaaatcctagcagataaaaattgtgtctgcaaaagtctaatacatttggtaaagttagaaaatgcatcatgttcacaaagtatttgtagctagtgcaattttggtgaaatgaatttttagaggttcagtcctttctctgggcctctttggagacagtcaaaatgtctcattgaaacatggattctgcttaattactgattagtgcattctttttaaatgtaactgtgtttcagctttatcaaattattagagtgaaaaaatgccagaaaaaatttacaaaaaaaatttcttggacaggaaaattgactcatgaaatcaagagaggagtctggactttctgagaagattagaatttttaaaaaatgttcccaactccagaaggcccaccaggcacactatccttggagaggttttagggtgagaaaagcattgtaaagggccagcttaacttgactgttttatggaggctacttttgaatagagggccttcacaatgagcccatagcttataagaagcatttgggggggtagagccaagaagaccatataggaacagctccagtctacagctcccagtgtgagcgatgcagaagatgggtgatttctgcatttccaactgaggtactgggttcatctcactggggattgtcagacagtgggtgcaggacagtgggtgcagtgcaccaagtgtgagctgaagcagggtgaggcattgcctcacccgggaagcacaaggggtcagggaattccatttcctagccaaggaaaggggtgacagatggcacctggaaaattgggtcactcccaccctaataccgtgcttttccaatggtcttagcaaatggcacaccaggagattatatcctgcgcctggctcggagggtcctacgcccatggagcctcactcattgctagcacagcagtctgagatcaaactgcaaggtggcagtgaggatgggggaggggagcctgccattgccgaggcttgagtaggtaaacaaagcagctgggaagctcgaactgggtggagcccaccacagctcaaggaggcctgcctgcctctgtagactccacctcggggggcagggcatagccaaacaaaaggcagcagaaacctctgcagacttaaatgtccctgtctgacagctttgaagagagtagtggttctcccagcacatagcgtgagatctgagaacagacagcctgccttctcaagtgggtccctgaccccgagtagcctaactgggaggcaccccccagtaggggcagactgacacctcacacggccgggtactcctctgagataaaacttccagaagaacgatcaggcagcaacatttgctgttcaccaatatccgctgttctgcagcctccactaccgatacccaggcaaacagggtctggagtggacctccagcaaactccagcagatctgcagctgagggtcctgactgttagaaggaaaactaacaaacaggaaggacatccacaccaaaaccccatctgtacatcaccatcatcaaagaccaaaggtagataaaaccacaaagatggggaaaaacagagcagaaaaaccggaaactctacaaatcagagcgcctctcctcctccagaggaacgcagctcctcaccagcaatggaacaaagctggacggagaatgactttgatgagttgagagaagaagacttcagacgatcaaactactccgagctaaaggaggaagtttgaacccattgcaaagaagttaaaaaccttgaaaaaagattagacgaatggctaactcgaataaccaatgcagagaagtccttaaaggacctgatggagcttaaaaccatggcacgagaactacatgatgaatgcacaagcctcagtagctgattcgatcaactagaagaaagggtatcagtgatggaagatcaaattaatgaaatgaagtgagaagagaagtttagagaaaaaagaataaaaagaaatgaacaaatcctccaagaaatatgggactatgtgaaaagaccaaatctgcgtctgattggtgtacctgaaagtgacggggagaatggaaccaagctggaaaacactctgcaggatattatccaggagaacgtccccaatctagcaaggcaggccaacattcaaattcaggaaatacagagaacaccacaaagatactcctcaagaagagcagctccaagacacataattgtcagattcaccaaagttgaaatgaaggaaaaaatgttaagggcagccagagagaaaggtcaggctacccacaaagggaagcccatcagactaacagctgatctctcggcagaaactctgcaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccagacctgccctaaaagagctcctgaaggaagcactaaacatggaaaggaacaaccagtaccagccacggcaaaaacatgccaaattgtaaagaacatcgaggctaggaagaaactgcatcaactaatgagcaaaataaccagctaacatcataatgacagggtcaaattcacacataacaatattaaccttaaatgtaaataggctaaatgctccaattaaaaggcacagactggcaaattggataaagagtcaagacccatcagtgtgctgtattcaggaaacccatctcacatgcagagacacacataggctcaaaataaagggatggaggaagatctaccaagcaaaaggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagtgacttagactcccatacaataataatgggagattttaacaccccactgtcaacattatacagatcaacgagacaggaggttaacaaggatatccaggaattgaactcagctcttcaccaagcgacctaataggcttctacagaactctccaccacaaatcaacagaatatatattcttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaagctgaacaacctgctcctgaatgactactaggtacataacaaaatgaaggcagaaataaagatgttctttggaaccaatgagaacaaagacacaacataccagaatctctgggacacattcaaagcagtgtgtagagggaaatttatagcaataaatgcccacaagagaaagcaggaaagatccaaaactgacaccctaacatcacaattaaaagaactagagaagcaagagcaaacacattcaacagctagcagaaggcaagaaataactaagatcagagcagaactaaaggaaatagagacacaaataacccttcaaaaaatcaatgaatccaggagctgctttttgaaaagatcaacaaaattgatagaccactagcaagactaataaggaagaaaagagagaagaatcaaatagatacaataaaaaatgataaaggggatatcaccaccgatcccacagacatacaaactaccatcagagaatactataaacacctctgtgcaaataaactagaaaatctagaagaaattgataaattcctcaacacatacaccctcccaagactaaacccggaagaagttgaatctctgaatagaccaataacaggctccgaaattgaggcaataattaatagcttaccaacaaaaaaaagtccaggaccagatggattcacagctgaattctaccagaggtacaaagaggagctggtaccattccttctgaaactattccaatcaaaagaaaaagagggaatcctccgtaactcattttataaggccagcatcatcctgataccaaagcctggcagagacacaacaaaaaaagagaattttagactaatatccctgatggacattgatgcaaaaatcctcaataaaatactggcaaacagaatccagcagcacatcaaaaagcttatccaccatgatcaagtgggcttcaaccctaggatgcaaggctggttcaacatacaaaaatcaataaatgtaatccagcatataaacagaaccaatgacaaaaaccacatgattatctccatagatgcagaaaaggcctttgacaaaattcaacagcacttcaggctaaaaactctcaataaattaggtattgatgggacgtatctcaaaataataagagctatctatgacaaacccacagccaatatcatactgaatgggcaaaactggaagcattccctctgaaaactggcacaagacagggatgccctctctcaccactcctattcaaccttgtgttggaagttctggccagggcaatcaggcaggagaaggaaataaagggtattcaattaggaaaagaggaagtcaaattgtccctgtttgcagatgacatgattgtatatctagaaaacctcatcatctcagcccaaagtctcttaagctgataagcaacttcagcaaagtctcaggatacaaaatcaatgtgcaaaaatcacaagcattcttatacaccaataacagacaaacacagagccaaatcatgagtgaactcccattcacaattgcttcaaagagaataaaatacctaggaatccaacttacaagggacatgaaggacctcttcaaggagaactagaaactactgttcagtgaaataaaagaggatacagacaaatggaagaacattccatgctcatgggtaggaagaatcaatattgtgaaaatggccatactgcccaaggtaatttatagattcaatgccatccccatcaaggtacccatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaccacagcatggtactgataccaaaacagacatatagaccaatggaacagaacagagccctcagaaataatgccacatatctacaaccatctgatctttgagaaacctgacaaaaaccagaaatggggaaaggattccctatttaataaatggtgctgggaaaactgggtagccataagtagaaagctgaaactggatcccttccttacaccttatacaaaaattcattcaaaatggattaaagacttaaatggtagacctaaaaccataaaaagcctagaagaaaacctagccaatacaattcaggacataggcatgggcaaggacttcatgtgtaaaacaccaaaagcaatggcaacaaaagccaaaattgacaaaagggatctaatgaaactaaagagcttctgcacagcaaaagaaactaccatcagagtgaacaggcaacccacaaaatgggagaaaatttttgcaatctactcatctgacaaaggcctaatatccagaatctacaattaactgaaaaagatttacaagaaataaacaaacaaccccatcaacaagtgggcaaatggtatgaacagacacttctcaaaagaagacatttatgcagccaaaagacacatgaaaaaatgctcatcatcactggccatcagagaaatgcaaatcaaaaccacaatgagataccatctcacaccggttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctataaagacacatgcaaacgtatgtttattgcggcactattcaaaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactattgcaaggacaaaaaaaccaaacactgcatgttctcactcataggtgggaattgaacaatgagaacacatggacacaggaaggggaacatcacacactggggcctgttgtgggatgggggggaggggagagggatagcattaggagatatacctaatgttaaatgatgagttaatgggtgcagcacaccaacatggcacatgtagacatatgtaacaaacctgcatgttgtgcacatgtaccctaaaacttcaagtattaaaaaaaaaaagaagcatttgaagcagaccttgaatacattttattgtaattaacaggttgtcagctttcacacatgtagaagtttttctaagggagatttttacatagttttatcagaaaatgataatttatgcctaacatccacccaaagttatttttctatcaatcttgttcacctttttatgtggaagcagcaggaaagaacatgttgggattcttttttatgccgtgttttgatcagcttagctctgtctgaatgtttgttgtaagggcttgtggctgcttctagcaggcaccattgttacgcaggaatatagacactttccgatttaaagaacgctgtctctttacgaagataattttttccctaaagttttggctgagagaggagttgaggccaaacctgagaaaatgcttacattgtactgttttcctgaattcagaactatctttaggtggtgtgggggcctcttcacagccccgtgctgctccatgcttttgtgctccatcacagttgggttcttatcaggagatgaggaaatggaggctgtgaacagaaagttcattggtctaacatgattcgactttgggcaagtattcaaccagtgcttacaaaggcaggattgggcatgcagtgagcatcctaaacctttgagaaattcagccccttactcctgtatataatctttatataaaaatatttattaaagccagtgtgcaaaagttgaaataaggatgtctgctttggaaagagatttatttctctggagcaataatgataacaaaatattgtaaaacagtattttatcataattacaatcatccagtgaacacttgctatgagccagctctctgaggttctgctcacatcacatgttattttttcacttctgctttacaacagcccttttgggtagatacaaatgtgccctttttactgttgagaaatccgaggctcagagaggaagagttctgagcagagttagggagttgcacagcctaactttaaacatgccaatgtgtctcttaacctcattctataaccactatgctattgcatattacattttaaatgtgcatttcagtgtcctttttatgtttaatggctatatttaaattttgtgattttttttctcttaatgatttaatgcaataatagacagaagccagaaaatggtgacaggaaaactgggcttcagagatgttagtaaattgctgaaggcaatgcaggtaactggaaagatagaattggacctgagctctctctgaccacaaacctcgtctaatatattatgatgtttttgaggcagcctggaccagaactaaattatgccactactattttaggaataccagtccttatatgaagatatctaagtgatactgcctggttttgttctgcttttcccttaagataattcaataagggaagcttcatgtggtgtgtggaataaaggggaataggcaaagtgttggatgcaataaagttttgacatttttgaagagtaacttattacttgggaccttaactaagtttatttcagttctcagatcccaggtccatgtccatcaaccttcaccccacaatccctttagaacaagagcaatgagtaagacttcagcagccagatgatctttaaggaagcctaacattccatgataatacatttcatttgaggaagttgaacttattatatgtaacatgaatcaaagaaaacttttatttttgaccattatgttactgataaaataggaaaaagggcaaaaaatttctcatattaaaaaaccataactttacaataaaagaaatctattgcattcatatgtagtaaatagttataagtctatttgttgttttgcttatttcttgtttatgtttctttcctactaattcaaaaacacctaaagaatcatgcattaatacagtatttgtacgttagggaaaaagtccagaacagcaactaaaaagatgaaaaataacagatcacattttattgaaaaaagcataatgcctgatttcatagtctaaaaacatgatagaatttgatgaatgtcaacatacaccatcagaaatgattttgtcttgcattgcagaatgacttcttttacgctttgtatcatcttgggaatcacaacagcaaatatgtatttagaagcaaacatcaccatcatttactacctctgtaccctcatacattccaggtgtcatgtagcaccacaaagacacacgttctgacttcgaatttctaaaggttacccattaaatttaatgggaaggtgttgtacaatgagcatattttgttgaggtctacaaaatatcactacacatgtgttgtaacagtgacattttaatcacttatttagttgtccaccatgaatatattcagctcataaaaaagaatatagatttgtctctaaaaatttcccaggagcaaaaacactattcaaagtacctaattttgagcctttgtttttaatttacacccagggatggtgtgataaaactgctttcatttaacacatttctagtctgtttttgaaactatctagatatattgtggtctattgagcatctgtcttaatcagattaaaaatgttctctaggtcaaaaattttcttcaaaaatgtcatccattcaacaaaaaaatacactggactcctactacattccagtcagagtagtgattagacagttgggatgcctgctttaagggtgcgtgaattccaagaacgaggatagacacccagcaacaaactttatgaaagggaagcccagtttacctgaaatatgtgaatatgggacctaactttatgtagtaatatattcattcctacagtgtcctgtgtctacttagccacagcacaaacatccttgcattttaattgtgtgtttatacttttgatatgagggacaaaaaattagatgttttattcatctagtttccagcagtgtctaacacatggtaggtggtcaatatattttcttgaacagaagttaataacggacatggatacttgcagagtatacagtggacttcactatcaatcatctcataagcaggtgggcaaggctaggtaaacaatttagcctagattctcttctactttattcagggtatattttaatctcaatcgcagtgttttctttaattgtgcagagaaatccatggcctaacattagagcatgtcacaatatctaaagatttagaaattcttacgctagataaataaaactaaagaaattggttgtggggggtctgcttcaaatgaacaataacttagaccttgccatatttgaacaattagaaataaagaaaattgtttacacagttggtctagaattctttgtatttttttttttttgtagcaaatcctaagtagaagagtcatcaaatttacctagttctggatatataaacttacttaaggaaatcaggactctttctaccatatgctgatgagaaatgctacttagagaggagtagaggcaccacaagacgctatgctatggcgcacctgctcctgtcaagtaccacatgggaagtcttagctcagggtttatgagaagcagaccctgagtcaagcggtattgaggcaagcatttgtatggaaggaattcatttggtcagtgatcctaggaagcagtgtgagggaatggggaagggagatcagggagggagggatatcaacaaggagtgcagtaagtggcaggagatctctgtggacatctagagctcaatccccttggggtctccctaagagattgtgtggagctgtctcacagagagaaaggggactggggcttttgcacccatgcttatcccttcttggttgaggttgatcctggggtgttacctgcagcctgtccccgtgtgtgcctggcactctcccaggggcagagaggaccctcaggtagaaagatgctggatgcaagccaggcgcggtggctcacccctgtaatcctggcactttgggaggccggaacgggtggatcacatgaggtcaggagttcgagaccagcctgaccaacatggagaaaccccgtctctactaaaatacaaaaaattagccaggcatggtggcacatgcctgtaatcccagctactcgggaggctgaggcaggagaatcacttgaacctaggaggcagaggttgtggtgagccgaaattgcaccactgcactccagtctgggcaagaagagtgaaattccatcaaaaaaagaaggaagggaaaggaagggaagaggggagggaggaaggaaggaaggaaggaaaaaggaagaaaggaagagagagagaaggaaggaagaaagaaaagaaggaaagaaagagagagaaagaaggaaagaaagaaaaaagaaagaaagaaaaaaaagaaagagaaaagatggaaaggatagatgctggatgccgttggcagggctggaaattgttcaaggtcacctcctgagtaggttgaaaagacatggacagggaccaatagcatcagcttcatgtatcttatgtcaactcttttaatgagctggtgaggttggctacattgctccattgttataactgagaaaaagccagagaggttagtaacttaccctgctttatcagtataataaatgatagagcaaaaactcaaacccacctatacagaaatccaggactttttgccttcccattatactatgcctaatatataggaattaaacaaaggaaatgttataatcttttatcaaagcaaactgcatcaaaaaaagccgaactcaaaacctgaaacattagatacctcaaacatgttatactctgctatcatagcacaatgacagcacctaaatccaatggctgctgtctctataagacaattatttataatttactgcttaatatttttgagaagaagaatttgatttagatattaacagatctttttgaaagaaaaacaaatgagggaacattaatttcaagaatctgggtttgtacaaaaaaagcttaaaaatgcctatgtttgttcatcatacgcactgaaatgatttttattatttattattcatttttaaagaaattcggcactctctaaatggcttactatatgatccttcccaaagtatttgaaattttatggtataagttaagggacctttactttctttctgaatccctgttatacctccttgttactatggcaatccatcccaacaactgtctttcttaagctatgtaatttttcctcattaaattattgcacaccctgcaaaaaatcaacacggaaacattaacaatgaccaagacacagccattgatcaatattgatgcccagaacccaggcagacatgatggagtgagaggttgtaccttaataaatggccactttgccttttctgagcagttgtcataaaaacacaccttagaggggtaatttctctttccaccagaactttttattgcttgtaatttagagccacagtaattgagatgttgagtggggaattggtgacagaaaggtgagagcttggggaaaggaagttttgacccacatgttaataacgcatgatcacagcttgagaaaatggtagatcctgtttttaatagcagaaaaaaagaggcttgtctttgttggagagtaaaatagcagccctggaaactggaggggaaggaatggattaaaatgaagacactgggactgtatttgttaagaaagttgtattggaacttggtaacaataaaatctatgcacttgttttaacctgatacagggtctttgaattttatttgacatttcttctcttttctccagctgctaaaaagccagacctgtatttgtcttccaaagttaacaaatgcgtaagacattatggtatgcatttcatgattaatctctcccttggatgaaaattaatttcctacttttcttccttcatcctttaaattttgtttggtattgtgcatacttctggtctcaaagccttcacagaccacacaggatataaatcaatctgtcaattacattttaatgaacatgacaggctaataaagtgaactagaccatcaaccatatcataaatatattgcattatttttgactctttttatttacaagaagaggaggtcagaaacgcatttttccttttaatgttcacctttgtttagttacccttttcttatatttacgtataaaaaagtgaggtttcattcagcttagaaaatatctggctttaggcaaacaactagtgttccccatcccataaactgtcaagaaagggtgtgagaaaatatattttacttcatgattactgatttgaaattgtgaagacatagttccaggtttcaccccagatgaagctctcagcaaatgtaattctgacccatttcagacagtcataagaggatgtgtgtcatgtacctgttctgtagacatggtgagcgctggctgcttgcagggcccatgcaacactgagctccgacccctctcaaagctgggccacagttttgatggtgtttctctcagcacttcagagtcctcctgactccgcgggattttactctatgttttattcatccatatggtcacaagacttgaggacagtagagcctcaagaaacagctgataaaggagtgtggggtttgcccccccaaaaacagctcctcttttattcctgtgactgattccacattctttcattttcccaggccagacatcttttgctttcattgaccctctatctcatttggaagaggaaaaatcatgaagacctctggattcttccttagaaatatattccacagcaaatctctccagactttatttcatttaacattatctttatctgtggcctcatcatactgggtgccatatactgacataactttgggactgtcttagctatctccaactgtccctttctttatgctatttgaatatacctaaaatacgtttttttgttatgtcttttcccttatgaataatttctgccatttaacatttagtatgtccttttcgggcattcagctgtctctacaatctggcttcacctctcacccacattcttttcaccagactccctatccattgttggccttcagaaaatctgttattatagtgcagattctgattttacacctcttgtttctcctttgcagaggcatgtaagaatcagtctttaatgtcaacatctgcaccaccaagagcctaaagttcttcattgctcacatccatttaggtttttcatcatgacacctgagactctaaaataaatagtgaaggaaagatggaaggatactggcaagacattttattttacacatgcaataaaataaggatgtgccagattaaaacataaagattaggatggacacaccaagctcaaaactgacattttcaccctattacaccatgacttaaataaatattagaattttcctgggttctatctcatactgcatttcttctctcgctggaccacaccacacatttcttagtttcacatatcactaatatgccagtgacacccagggctgtgcctcttgtgtctatctctctgccgtttgttgtcctaactctacctagatgccttcaaacaagctcaaatgttttaattcattgtaattttcaccaaacgggtttatcctccagaaatttctgttgaatgttcaccttgaagtctaccttctgtagaagacttacaaaaaagaggaagaatcagtggagagtagagactccgagcagaagtatgagaacaggaataccccaggcaagggggagggcccattgtggtgcttgggaaggacgagatggtagctttaagtggtaaataagcatgctacaaggcacaagagtaatgcacaatagaattgaagtccaatggataagtttgaaaatattctaaaacaaggtggaaacaaatattcatatttagactacctccccctcaaaagagtggaggaaaggcaagaatagaggcgagggataggaaaagaaggacagaagcaaaatgtattgttgaaaatttaaaaggtgatgtataccaatgatcaacaaataatggcctagaatcacctattgaaataaaatgagcaaaacaactgtcctccagaaattcccagttataatttatgtgaaagtaacagacctaccactgaaggacggttgaaagtaaggggttaaacttagaaaatactaaccacaagaaagttatgaaatataacaattttagacaaaacaaactttaataataaaagcatttttagacatttgaaggataaaatgtgtgataaaaggttcaatttagcaggaaaatgtaacagttatcatcttaaatgcatggaataaattaatatcaaataagataaaggaaaataattgtatcattacaaggaaaaatataaactacactatcaaatatgggggttgtaatacaactctcttggcagtcaagcatttaagcaacatacatacaactaaataagccatctgtatagcataaactacatgctttttattttttttacacctacaagagaactcacgttctcaagaacatacacaattttcagttcgccatggtctttgcattacattttttcagaaatagaatttgagataaatatgttagtaccagtactttacttatgaggggaaggaaacactgataaagaaatggaaagtgagataggaaaaggaaaactaaagcactgagttttaaagcagttatcagcaagagtaaatggagcttgttcttgctgagaaatggacagcataaaacatgcatctgagttcttccacacagggacgatggagctggaaaattgatagactaactcccatcagtcattggttgagtgctgttccttgggggctgcaaattctggaacacctcttgttccagctcagccattgcacaggtcattgcagaggccatggccatcgaaagaagtttacaggcaagcaggtgctggcagttggaaatcaagaaaactgaagtggagaggaagacgcaataaggctaaactatcagcaacgtttgctacaaccccattctagtcaatataacaaatataggcacatttaaggaatctgttccatattgtttaaagtctcgggtacagagcaactaaaaagtataatagtaaagatattttaaatccacatacatttgaattttttaaaaaaagttctaaataaatacacatcaaaaataaactcccaataaaaatttaaagaaatacccagaattgagagataataaaattatgtatagaaacttaggagatgcagttatagaaagatttaaaagaacatttacaaaaaatagctgaaagttaataagctaagcaactacattataaagtagaaggagtacagcaaaataaccaaaaaaaatcgaaggaagaaaataataaccaagatgacagtagaaattaacaaaagagaaaataccacaaaaagggtcaagagagccaaatgttgatagaaaaacaaaaactagtggaacagataaatacctgggaagattgaagaaaaataaaataaaataaattataaataactatattagaacattaattatacatataatatatagagagcctatataattatatatataatgatgtgtatatataatgtttatgtctctaacatagttccatatatgtggaaattattcaatacattttaaaatttatattaaatatttgaatttcttttagtttaacatttgaagtgcccctcaagttataaactagtttttggccacaggtttgtacacataacaaaataaaacattgcctttgagattaaacattcctctggagacactgatggcattttacatgacgctacaaaatcaaatggaacactgacattggtattacacttttagctggattacagacgttggtcagttctatctttacatgcaaacttgtatgtattatgctgtgtccagttctatagaaagaaatcatttttagaaaatttaaaattaagtaaaattatgctctatatataaattttaaagatgcttatgcatatcataagtatgtatcatagaatacgtatttaaaaacagatgacaacataggtgaggagatatgcagtgataacgaaaggtcattttaatgtttcagtttttagatgggtggtgagttcacgcatttcattttcaatttatctttctaatttacgtacatgaaatataaatatatcaattgttgtggaataaaatatttcattgcttgtagaaatttggaggctgttgttgatctccctaggactgttgcagaaggcatttccaaatgctgacacagagatgatagagtaagcattgctctattgagtggatgggaggggaagagagaaaatgtaggcctgagtgggcatagcaagcaaagtggcttttgtacgagtttatgcttcagcctgggagctgtgcacagtggatgacacttgaatgactaaagatggaagagacattcaatgcagccacagggaagggagggagtccatgggcgtctgattgatcactatcaaagaagattaaggaagtttgacctccaaatcttggttggacatttttgtgcttgggggagagttaagagaaaagatctgaaacattttctcttagatgcatttatgtttttactggtgccctccaaaggtcaagggttgagagaacaagagaggctaggccggatgtggagagcagacacgagtgcaaaatagctacagggaagaaggagaataaaagtcatctgagagcgaataaagattgactgaaagcccagctgggatcagattacacaagtgtgccggggaggtttattatattctttgaggggagcctgacaagaattgggtattaattagtcactgatctgtattaaatgatatatatatttttccaggctgtggtgatttggagtgcatgtagattggtaggaacaagcatcctaccaggtcagttgacggaggactttaccttccatgggcatcatatgatatggattatgaggacacactcaacacaccctcaatttcagggatattgaaatgcaaatattttgattgagataagaagattcttggaggagcccacttatatactaccctgactgctctccatgctgtgaagagggttttttaaaaagaacatcatgatctggagaaaggcaaggattaggtttgctgagctctacattgagaagatgaaggagagtgagagattgggtgctcccagacaatagttagtaaaggaattaaaaacagaagccaagaaactacgaagaaagaaactttgaaatattcctttgattgaatgcccattaaaaaatatgctctatgcaaatttacatctatatctgtttctaaatctatgtatgtatgtgtgtatgtatgtatgtatgtatgtatgtatgtatgtatctatctatctatctatctatctatctatctatatctatcttatatgttttaaatgaatgctggcgagcaagtttgatgtagaggctatccctgattttaaaaggtgcttacagcccacagtgggtgggggtgggggtggtgacagataggtaaaggaacaatttaatgctatcaaaaaggagggacgtattgctgggtatgggttgtggataaatgtggcaaacctcaagttcataaaacataataaaatcaacaataatcacaacgggtactatttctgagcacctaacttaaattaggtgctttacagtatcatttcaaccacaatgttcttatctcattttgttgaaagctgcaaactctttaagggcaggaactaggtatgttctgtttatcagtctacactggagacctactgtagtgcccagctcactgtaaaaataaataaataaatagatagataataataataaataagggaactgaatctgtccaccacatcatgctgcactgctggtggggagaactatgttaaatcctagtcagccctcaccagccatcccagcctggagcaactgagtctagtaggctgtattaagtcctgtcccacaggttctgtccatggcttctcctctttggctggatacttgagagtacctaatattcagcacctgtccaagcaggcagacattcagaagccagctttcccatcagcagtagcatttgtgctccaacctgggagccgtgcacggtggatggcatttgaatgaccaaggatggaagagacacctgcaaacccatttgtggtgcatatgtccttctttgaaagcaaacatggtaatttgtgcattttaaagtatataatatatttggaggcttcaaaggaaagggggcaacttggaacaccaagtaaatgacaaatgtatagaatcattttaaaggaaatgcatgaataaccgatttttgaaaaatcagtaaatagctctttccccttctaattttaaaagttgggttattcattttccccaagactttcattagccttagcaaatgcgtgctgttcaagcctcaattcttgccataagtgctattcagagaacatctgcgtgtagcagctctttctctgtttccaagcagagctgcgacacttgctgaaagggagctgccacactgttgtgtcatcgataggcccaatcaggctgcctctttcagatgttgaaatagcatgttttctgtacaaagcagatgcttccatcatatgggactaaattatcctaagaggttgagggaagggtcttaggatgagccaaaacaggaagctctgcagtaggcttcaaatgctgctaaattctggcgtttgtttatgttgaaaaggaaacaatgagagaatgggacagatgatcagtggcataaaatcccaaccaaagctgagaaaaagaaaatgagctcatagttaggttttctgtaaaatggccctgtgtggtttagttagcagagactctgggctgaagctgtggtccatgctctaaggggtccccaaaaatggatcttggcaggtagatactccctgagtttttaacttaagtcaaaatgacttcgctacgaaaagggtctacttcagtgaagaaaattggggtctggaaatgaagcttggcataagccagttgtggttagggaatctgctctggccgcagggttggactctggtaatggtacttcctgtccagattagggtgtcagaatgggcatcgtggactcagtgggctgatggatcctgtcctgtgggggagtcttccagcagctgggtttttgactctgagattcttctaatcttggaaatgctatcattcttgaccctctatcagccttaaagaaagacctcagcaggcaattgtggctacagaaggcatactcagcttccatggagacaggacaagtggccagggaaccagcaatgtgtactgacgtgcagaggctcaacaatgtggtaaacaagatctagcaaaacgaaaaggccagaagcacatttgtagagcactataatgaagtcctaggctacctcattcaattcctaaaatcttctgaaaggtaactattactgtgctagattatatagaaaatatagaagcttatagtggtgaagtaacttgcccaaagtcatgtgcctagtaaatggttaaggcagaagggagtttcaggtgtggattatatagcttccatctttaagctacatcaaacaaccaaggtgggggtagggttatcaggtaagccttcagtattgtagggccctcaaaacagacaatctgtatatcatggacacagcagcacatcttggaatccaaaaaccttgtgagcctggttcagatagactgcgaaacctgaagttcagcctgtgagatccaacagtgatggaagcggaaaggagtcactggcttggtttggatgcacatgagcccatatacagaaaggcatttttacccacctgtaataccaggtgaagtccctgattagcctggtcctatgccctaggcagagtcgagagctcagtgctgcactttctccagcgggatccagaatgggccctgcctgatgacccggaattttatccagcccctttcactacagcactcagaattcagccaggttagctaatgttcactcacactcctctcagattgtccttcagttataaaaatcagcatttgtcagatgaatttattaatgtcttccccaagttcagaagctaatttctaaatgaattccatgacttttgccctgcagaacagggagtgcttacatgccagctctctcagaaggtgatcaggaagtttggggtgagaagacaatccaggtaggatgattcctgcaaaatagagctgccgtgttcctgcatgttgtgcctccagcctgtttaatgcacagctatgtgtgaagaaggaagttaataactctcattttggtatgttgggacatcatcaacatgcctgtagggttctaggtatataagagaactccaacatttaattaaactgcctgcaaacattgattcatctgttaccacctgaatggattggtcagtgaatgtctggtgctccttcggagaactctggaaaatggataactcaggggcagaaatctggtgttaaagggccacagggagaatgggaattaattcttccagaaatgccttagggaggagccaacctacaaatctttcataagtatgcaaacttgggccaggatagtgatataagatctagtaggaggcaaggggagtgtgagaactgttggatactaaatgtgcctttgattcttagaaacagctgttttatgcagagattacttgaatttctctcctaaatgtttgaaagaaaaactactggttaattaggattatgctgactttgagttaattttctgaataagtgttcatccaaaaaatttgttgagaacatgtagtagatgttcaaaaatggaaacaaaaccactggctagggaaatagctataggagatcttgctctttagttttcatgcttttataattaggatattgactacagtaatcatcaatgttccaaacagactcaacttaagtatccatcattatatgaattagtttattaaactcggacattgaaaaagaaagatcaaaatttagttgagaatgcctgaatgcatcctctgaaatgagggtggtatttttcagtagcataactttgtgaatacttatttatgacaaactcagtgtcatgcacttaattttctcatcagcttttgtttttgcacactcatttttggtatgactctttaaccagtgcaatcaggggagtagaccccatcttggtttatcctgaacgagtggttctcaacttgaggaactttgactctctactgaaaggaccatttggcaatgtctgcagacatttttgattgtcacaactgtggagagaggatgctagtggactctagtgagtggagcagagacgctgctaaacatcctctaatgcacaggacaatcccccacaacaaagaattatacaatccaaaatgttcattgtgccaacattgagaaaccctatcctgaccgaggtctccacctttagcaaataaaaagacaggacacttagttaaatttgaatttgagataaacaacaaataatatgtatgtattatgtaacatataaataatacattagtatatatatgttcaattgactataaaaatgtggtgcttaatatgtcccaagtttttatgaggtatattttttctaaaaaaaaaatagttcatttgaaattcaaatttatttaggcatcctgcattttacctggcaaccctagatctatctcttgtacaagaatgtgacctattccatgaattctaagcttttctgcaacagaaggaaattttattttgtatgcagcttattgtgccattgcataggctttgtaataaagcatgtctcaatgcagattccatttctgacctactgtacaatcatggagaggttatttaatttctttaagccttagttacttcatatatgttatgggaataattatgacaacctcataggtttattgcaaaaaggaaataaaataatgtatgtaaaatgactagtattcataaaggataattatgatttttattattgatttattattttcctcagtaataccttgaagttctctgtcagcccaggttttatcaagattttttttctttgtaatatattcagtggatttatagcagcttgctttactagataacccaagaatgggttgagttttatcttttcttgtaatgtttgttgaagtaaaacacaatgatcaagggagcgaatcttgattatactcttcatcatttttctttacatagtgaacatactcatgggtatcatccagctcaaaacgcagaacgttgtcagcccccagagactctaccatgaccttttctattcattacacctctaaaaataatgaatatctttatgtccatcactatacattaggattttttttaatttatgatgaatggaattatgtgttaagtacccttttgtgtctggattttcttttcttttttaaaaaatatgttttcttcacattatgtctgtgaaatttgtcatgctgcatatagcagtagtttaatctttttgtttactgtatgacattccgtcatgtaaatatgcaaggctttattcacctattcaactgctgatgagcgtttgggcagtttccatagttttactattggaaatggtgcttttattaatattttgtatgagttttgatgcacatacaaatgcatttacattgggcagaacagttgtgatacaaggcatgcacaattttagggttaagtagatagctatacaattttgcatacagaatgcgctaatttatgttcctactaagagtatcagaaaatttcattgtcccacattgtctctacagttgagattgccactttttataaatgttaattcttatggtgggtaggtaatattatcacattgtggtttgaataacatttttctgacaataatgttgagcaccatttcaaatgcttattggccatagtaatatagcgttttttattattattatgccagcaaagcaggttcgccatgcaatggttatcatttcattccaaagcatcatgggctgcaatttctactccttgcacaagttcaggatacttacaaacacaggttacatgcagtagatttattacctatagacaactagaaagagacaacagaggcctaagattcatgacagcctgatcccagaggctcaggaaagctgccaggacatagtctcgtttgcgcatgccgcacttgcactgtagctcaggaaccttggaaacagttctcctgtttgtcaaacatcgccagacatccaattctaggagagattggaacagaacttgggctgctctggagagcccctctttatctcagaatgttgcattgttagcacattctatagttattcttgagaactatagacaagaaatgagagagaactgggatagtctaaggccacatggagatctgtcttgcactatgttgacttagtttagaggccccggctggagaggagtcaggcccttttcttgtggggtcaattaagtccgatcctcaattacctccttgtttgtctctcagacccttggccgctattcagtcgccatatgtgcctcggagccaggtaccagacaaccaggaacaagcccactgaaattatttcaagtcatcaagcctaagcctgtttgccctgcctaaccctttcattcctgcagaaaccacaaaaaaaggttttcgcctactgctgccctttatccctctggctcaactctgacgctggtgctcccacgagtggccccctgtggcatggcacgctgtgttctccccagggaactgtgagtataacaaaactgtaaaactctttcaagcttctcttttgatcttcctctggcttcaccatacctcatccacattaatatggttaaatcagccatctgatgtcttgtcaaatgacaatgttttcctcccatatttttttggcaggcctttgttttccttgttgaattgtagaaattttgttttataaaggatataaatcctttgtaagatgcatgcatttccaattttttttttctacttcgtggcttgcgtattcactgtcttacagtatcttctgatgaagagtaattaatgatttagcaaattccagtgtatcaatattttgctttatgattggtgctttttgtgtgcaatttaagaaaaccttgccaactacaagacaatgtagacattttcctatgataccatccagaacctgtattgttttaattttcacgtttacttagtggtacatcagagttgtttttctgtgtgtgtgtgtgtgtgtgtgtgtgtgtgtgtgtgtgtgacgtgaaaagtatggcatacgtgaatggtgaagtagatgtgaaagattcattttgttcttcaggaatatctggctgacccagcactgttcctggagtatgcctcctggcattacaatgtcaccttttcataaatcagatgatcacataaattcatttgttgaacttaaatttttgatttttattctttcttttcttaaaataatatatccactgaagtctatcagctttttaaaagcagggctttagaaccattctataatttttgacatgccaaattctaaattttcattgaaattaaaacaaattcttttattttgatttcttttttgaaccatggaatatttaatactttattgcttaatttccaaagatttgaatttctttaagttattattttgtgaatcattctcatcttaatcgttttaaacatttctagtgttatttggtttgacaatattttaagttaatttccatatgatcagattaacatatcttattttttaagacttctgttatagcttagaatttaatcaattttagtacacattcacatggaaaaaaattgtcttctcttgatctgcgttcaagttttatatgtgtgtgggctgagtgcggtggctcacatttgtaatcccaacaatttctcccaaattgaggcagcaggattgcttgagcctaggagtttgagaccagcctggggaacacggcaagactgcatctctacaaaaataccaaaattaatcagccatggtggcactcacctgggtccccaccagctactgggaaggctgaggcaagaggattgcttgagcccaggaggtcaaggctgcagtgagccatgttcacaccactgtatcctaacctgggtgacagagtgagactctctctaaaaaaaaataataataataaaataaaaggtttcgtgtgtgctaattatattaatttattaattatattgttctaatattttatattctttctgatttacttactgtcacttactgtcatttaccgagaatgttacttaaacatgaaattagaaatttgtctactcttttaaagtttttttcatcattttttttccaagtttaccttagttttagtagtaagtaggaaaagttttaagtctcagaaattatgtaattggagacaaatgtattttcggggacctttttttctatttctctacaaaagttaataatagtatccattcctgtcttcctatggtacataacgttcataacattgttaattataaacaagtctgtggagccctgataaactaccaacaggttttctaggactgcccttgacataatttttgacacttaacaaatatgactaagttagtaggtatataatttttgtctccccttaaatagaaccaaaaaaggaagaaacatttgaatgtttaagcagataaatacaattactacaatctttattatatcaacctgttagaacatatttcaattataaatgcaacagaggggtttcaaagtcaaaatgttcaattaaggcacctggtttctattagattaacatttgtgtaatctatttttgtcttttattttactttcaagctacttatgttattgaatttaaggtgaatttcttataaatagcatatcattgaattctgtttgtttacacactctgaaaatcttgttacccattgtaatgcctctgtgacctagctgaatttctacctgatcttaactctgcttagctttaggagacaggatgtctgaggtcagaagttccccctggtgaccaaaccagttaagactgatgagattcaagatccagctcacttcgcctttgaagaacctccaacttcattataatttattttccatactaaatgacactcccaccagtgccatgacagtttataatcaccatgacaatgaccagaagaaattatgaaaggacaaaaaggaagaccacaactccggttctgaggaattctccacccattcccagaaaagacaagaatactcctccccttgtttttaatgcccaaacccttcattaaagatgtcccatatctgtgacttcctgtctctcattaattgagaagttaatctgtgagtcaagctcccacttcttaagtccatggccattgaataaagcctgcactgcttgatgctcacttttggtttcatgcattgtcttctcatcactgcatagaaaaagaacccattttaaaatcagtaacactttgatttctaacggattaaatttgccattttattgttttctgtttgtttgatttgcattttgttcttctgtttcaagtgggttacttgaacagttttaagaattctgtctttatttacagtgtttcagagttcaactctttgtacagtttaatgttgttgtaggtttcacagtatacctaacatgtgacttgtcatagtctattggtatcaatggtgagtcctgtgaaagtttatttccacttaggtctctttaccgtcctcatttttcaatatcattatctggagtacaagataatgtaataatttttatttcactaataaaatatggtttatagaattcataaagaaaataatatattattatgtatctatattccatgtccagttttttatttctttctgatctctaagatctttttcctttattatttcctttctgttttaagaccttcctttagccaggctttaagagtaggtctactagtgacatatcctacatatccttttagttttcttatgtccaagatggtctctatttcatcttcttaccttaaggataatttcaccagttatagaatctgtggttcagttttttttccttaaatatcatttgaaagttttgtgtcattttcttttggtttccaaggttttggatgaaaaactcactgccatttgaattggggttctcttgtagataacatagtttctccagctacattcaagccttttctttgtcattaattttcagaagattaattatgatgtttcttgatacagatttctttggatttattctatttgggattcatttagatatttaaatttgtaaagtttatatattttgctaactttaagaagtttttatccattatttctttaagtagaaatgttgaatattttacttttctgtatccctaaggctctgatcaattttttgggggggcgcggggcggggggttctgtttgctatctgttattcagactgggtaaattttagtgattagtcctcaggtccatggattctattctctgtcatctctgttctactaggaagcccatctggcaagtttttttaatttttattatattattcatacctgggtaaatttgatttggtcttctttgagtaacttctatttttctgctgagatttgctagtatttgtttcaagagagtttataattgcttattaattcaattttatgatagctgctttaaagtcctcatcagatatttccaacatctgtatcatttcagtgttggcttcagttgattgtgtttctcaggttgtgattttcttggttcttggtaagataggtgattttcaattgtattctgtgcatgcctgttatatctattatgagattctggatcctgtttaaatttcctgtttcagcaggtatgctttctgtttagatttagcatgcaaataaatcttagatgagcctttgtagtagtattttgttctacttggtttatatggtgtgtctggggctcctgttggaccttgctggcatcccgagggggcagaaagttctttctcaggacggggcatatggtctctccaggtggcggaagtgattctccaccatggagggacaacaagtcttcccaagccaggtggcttgttgaggcaggatcccatttgcctgtactttctgaccacccagtgtccctcaagtgacagaagagattttcatgccttgtggggatagaaattgcttaccagagtgcttgttatggagggatccccttgccctttccaatactgtctggctgcctgctgtctcctgagggcaaggggagtttcagacctgtgagaccaaagttgtctccaagattggacaccccaccatgtcttgttctttcagtcctcagtccctaacaaactcacctttgtcctcccatctttcagaatacgccttttgttgcatcttgcactatttccaggatttatagttagacctagaggggagaagcagggaaagccaagtctataccatgttgtccagaccacatgcctccttcaactcccgctaaattcgaagaagtaacacatttagaaatgttatatttcttgttgaattgatctatttatcattttaaaatatgtttcaatctttactaatgattcttgccttatactttttatattcttggagcactagcattcactggttagtgtttgcctcgtatatgtttttccagtgtactttaaaacttcctatctctttataatgaatttgtttctcttgtaggcagcttgaagtttggttgtatatttcaccaaattgacattatttgtcttttgattagagtttttagtctatttatattatttgacttaatataaatctaagtacagttaagtctaaatcaccaatcttgccatgctttctatttgtcatcttttatttgatcaatccttttcttgcatgtttgtatgaagtaaatatattttattccttcatattttttcaatctgttagcctgttaatcattattattaattcttatttttattagtacttaccttcacaattactatttgcatccctgatatagttgagtgctattgtgcaacctggcagccactggctacatgtgattttggagcacttgaaatgtgctagattgaattgtgctgcagatgtaaaatacacactggatttcaagtatttaacactgacaaaataatacataatatccagtattaatttttgtatctattaaaataacattcgagatagagaattaaataaaatatgttattaaaattaatttcattctctaaatttttcattctctaaaaaatttttagtgtagctattaaaatttctgacttcacatgtatgatttacatcgtatttctattggaaagtgttccattgtattctaccttaaatcagtgtctttactgctctgtgaatcataaaaagactttaaaacattttaactgcattgagactccttttctctcatattgcttcagtaaaatattttaattttacatattttaaatccaccagataatattaatactgttttaaacagccaagcgttatgtacatttactcacatattcaccctttttactactactgcttattctattttactgggaaaataatttcctgggaaaataatcatggatcatttttctgcaagagcttcctttagtaatttctttagtgtcatttttatcataatgaattttttagtgattgcctgaaaacatctctttttttccccttcacttttggaggagattttcactggatgaaaatttctacatggtcagctatcctttcctcattaaaaataaatgtcattatattgcctcattttttccatcacatcttttgaaatgttagcttgtcagttttactgttgcctttttgaaggtgtacacattgttcaatgattacttcgacaattttatctttgtctctattttttagtagtttgcatatggtatgtgatggtgtcagaaattttttcatttgtcttgtgtgaggtttgcagaacaatctgtttattattttttatcatttttagaaaatcctttgctaaacatctcttcaaatattgctccttccccattctctttactctctgatttcagatgctaattacacatatattagaccttttctctgtgcttcatatgtgtctactctttttgttattttcctctttgtctttctttggttcaatatggatgttttatgcttaatcatcttcagttcatgaatcttctttcctgctgcatctaatgtgtattcacctatctatattgaaactttttgtcattaatccttactatcacttatattgcttttaatatctagaatttctgttttattattttatatattttaattctctggtgaaattttcattttttcatccctttaattgaatatataataataatttaagtattcatagactccgatatatagatcacctattggtctgcttctgatgtcttatagtctctcgggttttagttatttgttcttacttcttggcatacttggtaaatctcaatatagtacaggatgatttgtagaaattctgaattaaatttctttgctctatagaaaagaatttaatttatacttttagtcatatagagtataatcagatatttactttcagttcacctttactgctatagtatatcctttccagagtcccatgaaaaagcctgagttatgtctcagggcctctcctctttggcaagcccagaactgtattttttatcttcccagaatcaccaaagttctgaaatatctgcttagctttttactctgttgaagccacttgatgcttaattttgcagattcttgccctgttgtgtgtgcaatttaggaatcagtattgaggggaattgcgtgcaaagtgttgacagctcgtctccatgaaatttccatttcattttgatcccaagcccttaagtcctggatgctgtggtaacattcaacatcagtttaagtgtgtgtgggccagagagactgccagatgctgtcattcacgtttttttgttcagattctctcctgatctgaaagtctacaagtgtcctcagagaaaaaacctggtgttagtctaatatttatctcatgtctttctcttttttctgggactttggtcctttgatgtatatctgtgttagtttttttctgatgcttttaaacaactattcctgcaattgtttcagctttcttgttattatagatgggcaggttagtcaaacagcaatgactttgttactgctggtagcagaattcagccctgaattctcatcactgaagtttggttctgggatagtggagaaacttaatatgctctatatagttggtttggaatctccctagaatttttgagaaattagcaccttttattctctgttttagggcctcagatgaagttttaatactatataaaatatcttattcgaaatgttctaagcactgtgaagagcacagatgcacttggtaaaagagatgagccaaaatggaaccttagggagcttaactcgcatctaagaaagttaataataattatatgagagtagtaataattattatggctggtttttattgaatacttacaatattatagtaatattccaagctttatcctaggtacattttatatgcttatgcactgaactcacaacaacgctttatgttactcactgttatttgtcctctcttataggtgaccaaggccagggtggttaagtaggttacccaaggtctcacagagagtaagtggcaaagccagtggaagatatcagagcagagattgttgttgtgaaattgaaaatgcaatgtattttaaatttcacaacagatctccatctactaaagttaaggcagtcattgcttcacaacaaggatacaatctataagaaaaaagccagatagttttggcagaagtcagttacatgaaccaaatgtcagacagatttggtaaaagtcagactcttgccctgtctactggagcatcatctggagaaggtgcatgttctcagaagtctcattttcagaagagtcatgatttttcataagggtgtgggagtaggagggatggctgaagaaggtgtctagatatgtatatctgaagaagaaagttcttaggacctaatagacttcactataaatactatactatactatactatactatactatactatactatactgtactataaagcaagacaagatgctgacttttcccaaaaggacattccaagggcttagtggtacttccagaagctgagccaggcccaagctgccctttgagcaatgttaatccatcactgtgtggttcgctattgtcattcttctggaactgtgcaccagttgctatggctctgtttatgcctctagtcttcctctcctttagtgggagagactgcaaagttacatgtcaaagggtacaaaatacatagaggagcgaagactttagaaaataatatattctatcacagtgagcaccccggagcttagctttggagatcatggaaaaggatgaggggtaaaagatactcaaagactatctgtgccaaaaggaccactttgagataaaatgtggctgtgataataatgtttgaatttaacaggaaattcaaagaattgaactagaaatataaagataccttatgtaatatatatatatttgaatatgggggcacttgtaggatggatgagtggttaccaatttctgcattacagagtatcaaacagaatggagaggaggagacagacaaaaaaaagatgacctcagggttgtagatgtagggggtttgaacaaggcgcagctgaagatgatgctatttttcagttgagtgctgggattctaggaatgagattaacaaaatcaagagaagaaagaataattttggagagaattatcagctcactagggctctatcacaattgtgtttctactaatttcccatatgtttccaatctctttttggaaatgacattttttctaggctgttccatgctccaaacatatttgaccgaacctgtcctcctggctttgtcctaaccatgcaccaaacctcaacttaaacatcactttctctgggatatgtgtgttgactccatatataggatggaatatcttggtttcacccagccctcctctttcatgacatttttccttttttttttttggtaacaatttttttttaaaatagctgttttcgccacttaaatgtaatatgaataatattttatccacttgtcttttgattgtaaaatgagcctatatgtaattcctgacttttgagtgttcaaaagttcacaagaaaacagcattgtgtaaagaaaagtagataaacctcaaacttaagacagaatccattctgctgcccccatgctagccattgctggccaacaacagccttttccattggagcaaagactgttaattttttaaatgttctctatataaaaattgataattgactgaactatcagtgtgccataattaaaaagaaaaagcaatgaagaaatctatatagtaagtatatagtaagtatatacttactatatagtaagtatatagtaagtatatagtaagtatatacttactatatagtaagtatatagtaatatattagggttctccagataaatggaaacaataggatatgtaaatatatatatatcataaaaatgatacagacatttgagagaggacttgttaggagagatgactcacatgattatggaggctgagaagtttcacaataggtcatctgcaaactggagaatgaggaaagccagtagcacactgagtccatgtctgaaggcctgagaagaagccgggaagctggggagcctctggtacaagtcccagggtccaaaggctgttgaacctggagttctgatgcccaaggatagaagctgggtgtcccagtttcaggagagagggagagaattcaccttctttgtgcctttctgttccatctgggcttgcagccaattggatgatgcctgcccacattggataaaggcaggtctttctcagtcactctgtttgtttaaatgacaatctattctggaaacagtcacagacacacccagaagtaatgctttctaagctatctggatatcccttaattcagttaagtcgatacctaaaataaaccatcacagggagtaatctttgaaatcaattatttgcctaattttgaaaaaaaaagagatacactcaaagaatcaaccataatctaatacaaatggttatctcataggcaaggagaattggataaaaaaatacagggatgaaagcaacattttactgaatatacttttttatatagtttggacttctgtaaatattttccatgttcaaaaagcaaaatttagttaaaaagcacacctcgaaattgaaaacagaaacaaatgaacctacatattaatatggtgaaatgaatatataatattttaagtagtaagtttaaatatagtgacctgaccatatacactttttcagtgtttatatcctatagaaaaattaaaaaactacaaaaaagttttaaaatttacttatattattgtaagtagtaatattgacatgataatttttaaaactttgaagttaagttcatgttttagagaataattttagatcataaatgtagaagaaaaaatcagaaataccatcattttttaatattcataaaatattaaattaagtcagaaagtacccatggttactaattcataaaagtttctggtgaatagaattcttttagtgtaaaaagcaaataaaatgtgtgcaaatagcttgatcattgcaaaaaagaaaaaaatatattttaattgagagattaatgttactactagtgctatatctgaataatagttgcttctgcatatgatacagtaggaaggataacttcacttggaaattactcttgcaacaaatgttttaactaaattgaatcaaatttttagacctaaatttcattcaggaaatacatgggctagagcagtattgctcaaccttggttgcctatagagatcacccttcagctttaaaaactactgatgcctggattctatcctgaggattctgtagaattggacaaatttgaatgtggactgagtatttagagaattattctttaatgagctgtgatcatgatatcatgattctatttaaatgagaaatctgttccgaacaccaaaaacattgaggttagtggcagctttttagtccatattttatatcaatttgagataatatttttgaacattgtttcaaaacactaggtttaattaagaaataattaaagacttttctgattcctttaaagtcatcagtttcttttttcataataatgaccactatctgtgggtatgtaattcattttacttatatatgtagtggcttccacttgcctctaaccacaaaatagtaaatgaaaaccaatatcacattcctggagggattgcagagattagtgtcactgtctaggtcttgaaagatgcagagacagtgatttctaccacatcccaattcaacttgcaggtgaatcttgggaaatgattgaagaaaatagcagttgctattccagatgtggttttgctgtgttagaaaagtaatgcagcctctggtatctgacacactgttctgtatcctgtgatttttttttctctatatatctgctgagaaacatcaccagaagaaattttcttttcagctagccatgtcttcatgggcctatctgaggagtagatcaactcttctgccttattcataatttagttgccttttcttcgataagacataatgttggtccattacattgataacattatgatgataagacatgctggattagtttaagttacaaaagaagaaatgcttccattaggggacacaacaacgattccattaaactagcagttaagaccgacacctggccgcttaggtttctcctgcttgtgaatcaacagacaaaggaggaggtactgggctgactagggtgattgacactaggtatcaaggagaaattaggtttctgctacactgctgaggtgagaaagaatatgtccaaaataaaggtgatcccctaggtcacttcttagtattcctatgtgctataattaacatgagtgaaaaaaatggagcatctttcagacaaaacatctaatagcccagatccttcaaatgtgaaaaattgggtgaccgcatcagacaagaaatgatgaccagccaaggtgtttgctttgggaaaaggaaatatgaatggtgagctgaagaatatagttatacatattagctatgacctcgtgactggatgccgaaatgagaactgtaacagttgtaagtatatcctcttgatctcaatagaaaaacgtttataataacataaaaataagctagtatattaaatcctaaatcttgagaaagtgtacctgtaatgacaaattgagccagatcaagcacttatgtcatcctccatccagttaccccagggttattcccacacatggcccacaggctcttgtcaatcttttcttatgggactttgtatttttctcctgaaagaatgttgttgtctaattctcattataagttggaagctatacgaaatggaagggttaactgtggcatgtgtatgaggcttttcttgcattgctataagaaatacctgggactggtaaatttgttttaaaaagaggtttaattggtttacagttctgcagtctttacaggaaacatgagactggcatctgctcagcttctaaggagaggcctctggaagcttacagtcattagctggtacctcacatggcaaaaacaggaacaagtcagcaggtgggtggggggggtgccacacacttttaaaagaccagatctctcgtgaggactcattattatgaagacagcactaagccatgaaggatccacccccatgatccaaacactttccaccaggcctcacttggaattacaattcaacatgagatttggacagggtttaatatccaaactgtaacattccacccctgccccctcccaaatcccacgtccttctcacattgcaaaatatagtcatgccttccccactgaccctcatagtcttaactcattaatggaaagcgttaactgaaaagtccaaagtctcatctgagacaaagcaaatccctttcacctatgagcctgtaaaataaaaaacaagttagttacttccaaggtacaatgcgcatataggaattgggtaaacatttttatttcaaaaaggagacataagccaaaagaaaggtgctacaggccccatgcaagttcaaaacccagcagggcagttactaaatcttaaagtttcaaaataatctacttttttcatatcccatatccagggcacactggagcaaggtgggggtgggggggctcccaaggccttgggtagccccgcttctgtggctttgcaaggtgcagcccccatggttgcttttacaggttgttgggtgccttgtgacttttccaggcacggggtgcaagctgccagggctctaccactctgaaatctggagaatggtgacccctttcttatagctccactatgcagtgcccctcaaggattctatgtgggggctctgactccacaatttccctctgcactgtcctaatagaggttctctgtgggggctcacctcatagcaggcttctgcctgggcacccatagttttccatacatcctctgaaatctaggtggagggtgtcaagcctcattcattcttgcactctttgcacccttaggcttaacaccacatggaaaccactaaggctcatagtttttgccctctggagtggcagcccaagctgtagctgtacctgggcacctttgagccaagactggagctgacacagcgaggaagtggggagtattatttcaaggctttgcagggcagtggtgccctgggcctgtcccactaaactatcattttctcctaggcctatgggcctgtcatgagagggctgcctagaaggtctatgaaatgccttccaggccttttcctcattgtcttggatattagcatttgactccattttagttatggaaatatctccagcaagaggttgctccacagcttgcttgaattcctctcccaaaagagctttttctttctctgccccatgaccaggctgcaaatttaccaaacttttacactctgcttcttttctaaaataaattgcagctttaggtcacttatttgctcctgcatctgagggtaggttgttggaagcgtccagaccacatcttgaatgctttgctgcttagaaatttctttcagcccctaggttatcactcttcagttcaaacttccacagattcctagggcatgaacacaatgtagccaagctctttgctaaggcttaacacatgtgacctttgctccaggtccctatgagtttctcatttccatctgagaccttggcagcctggattttactgtccatatcactatcagcattttgctcacagccatttaaatagtctctgagtagtcccaaaatttttcttaccttgctgtcttctgctgagtcctccagactcttcctatctctgcctgttaaccagtttcaaagctactttcacattttcaggtatctttataacaatatcctagtcctattatgattttttttttgtattgggtaattcttgcattgctataaaggaatacctgagactaggtaattcataaagtaaagaagtgtaattggctcacagttctgcagtatttacaggaaagcatggtgctggcatctgctcagcttctaagaatgcttcacgaagcttacagcaatgttggaaggcaaaggggaaaccagcacatcacatggcaaaagcaggagcaagtgaaagagagggagagggagaaggtgctgggtgggggaaggtgccacacaactttaaatgacaagatcttgtgaaaactaactgtcatgaagacagctccatgccatgaggaatctgcccccatgatccaaacatctctcagggggcctcatctccagcattggggattacagagcaataagatttgggtggggacaaatatttaaactatatcagcctataaactaaaaataaaatcctaagcccccaaccaactgaacagatttcctcttggccataggaatcccagaaaaaccttaaaaactgaattcctggctgtattagtctattttcacactgctgataaagacatacctgagactggttaatttataaagaaaagaggtttaattgactcacagttccacatggctggggtgccctcacagtcatggcagaagacaaagaaagagcaaaggcacatcttacttagcagccagcaaagagaaaatgagagccaagtgagaacaagagccaagtgaaaatgagagccaagccactcttataaaactatcagatctcgtgagacttattcattatcacaagaacagtatgggggaaactgcccttatgattcagttatttcccactgggttattcctataccatgtgggaactgtgggagctataattcaagatgagatttgggtggggacacagccaaaccatatcattccactcctggcccctccaaaatctcatgtgctcacatttcaaaaccaatcatgccttcccaacagtcccccaaattcttaactcatttcagcattaactcagaagtccatagttcaaagtgtcatctgagataaggcaagtctcttccgcctatgagcctgtgaaataaaaatcaagttagttacttcctagatacatgggggtacaagcgttgggtaaatacagccgttccaagtgggagaaattaaccaaaagaaaggggctaaaggccccactcaagtccaaaatctagtagggcagtcaaatcttaaagctccaaaatgatctcctttgactccacatctcacatcacgctgatgcaataggtgggttcccatggtcttgcccagctctgcccctgtggatttgcagggtgcagcctccgtcctggctggtgtcatgggtgctcattgaatgtctgttgattttccaggcacatggtgcaagctgttggtggacctaccattctggggtctggagaatagtggccctcttctcaccactccactaggcagtgccccagaaggaactctgtgtggaggctctgaccccacatttcccttccacactgctctggcagagattctctataagggccctgcccctgcagcaaacttctgcctgggcatccaggcatttccatacatcctctgaaattgaggcagaggttcccaaacctcaatctttgacttctatgtacctgcatgctcaataccacgtggaagctgcaaatgcttgagcttgcaccctctgaagcaacagcccgagctgtactttgaccccatttagccatggctggagtggctgggatgcagggcaccaagtccctaggctgcacagagcagggggaccctcggcccagcccacaaacccatttttttctcctaggcctccaggcctataataggaggggctgccatgtagacctctgacatgccctggagacattttcccaatggtcttggcaattaacatttggcttctcgttacttatgcaaatttctgtagctggcttgaaattctcctcagaaaatgggtttctcttttctattgcatcagcaggctgcaaatttgctgaaattttatgctttgtttcccttttaaaactggatacttttaacaatacccaagtcacctcttgaatgctttgctgcttagaaatttatttcatcagataccctaaatcatctccctcaagttcaaagttccacaaatctctagggcagaggccaaatgctaccagtctctttgctaaaacataacaagagtctcttttactctagttctcaacaagtttctcatctccaactgagaccacctcagcctggagttcattgcccatatcattatcagcatattggtcacagccattcaaaaaatctgtaggaagttccaaactttcccatactttcctgtcttctgagccctccagattgttccaacctctgcctgttacccagttccaaagtcacttccatattttcaggtatctttatagcagtgccctgctctatcagtacctatttactttattagtcagttttcatgctgctaatacgacatacccagactgggtaatttataaagaaaagaagtttaactgactgacagttccacacagctggggcggcctgacaatcatggaagaaggtgacggaagagcaaagggacttcttaatggtggctggcaaagacaaaatgagagccaagcaaaaggggtttcctcttataaaaccatcagatctcatgagacttattcattaccaagagtataatatgggggaacctgcccctgtgattcaattgtcttccactgagtccctcccatgacatgtgggagctacagttcaagatgacatttgggtggggtcacagtcaaaccatataactggccatgatgggaagagaggtcagacatgcctttatctcatcccttttggagtttaggcacaactgaccagcatgaatgtcaaaatagatattacaagactgacaaaaaagacttttgtggcaacaaaatatcaaattataaacaaaacctaaggcaaggcaaggcaagcattaagtcttgcctgcaggcaatcagtcttattaaataggtcatattacggctgactctaacacaccatccttatttgaacttaaacattcctttctgttaactccaagtttttagacaaatctttgttcctttaaccaatttcagattaacaaatctcaatccatctatgacttgcaagaccccacttcaagatattccaccttttcgggcaaaatcaatgtatacctttcatgtattgatttatgtctttgcctataactcctgccttcctgaacttatccagtaatccagctgcctcagaatcacttattcaaggcttcttgggtttgtgctttctccaggtgatggtcactcataatggctcagaataaacctctttaaggtattgtatagagtttgtttttctccattaactggaggataatagaaacctctttatgaggcaccttcttgggtgacgttattactcaaagtttttaagcacaagacagcctgtctccagactgagagagagaccgcttccattagttaggttgtccatgggtattgacttttagcatcccattttccaacaacaatgaagtcatcattaattcaggtcaaactggtgagccttcaaatttttaaatcttatctcaaaggtctgtttcatgagctcactcttggtacccagctgctgtcagccaaggtaaagctaagagaacaaaaaatctattcctggagtccaagagaggaaatgtaatgtgaggaactgcttatgaagttgtcaaaagagataaaaatgagaaagtaaggcatctcagagattaataatgactgattaacaacttacaaaataataacacaaatttttgtgttagggctagagggtcatctgggaaaaaatggggttactatatgacaggagctggaactgcctggtaggacagagaagcatggtggaaaggataggtgatgagggctggagctgtgaagaagctgcctggaggaagatgagatgaagtaaagagacatcccagtaggagattaaatcacagaggacaactattaggctggtgcaaaagcaattgtggttttggactatgaattttcaataattataactaagctcaaacacatcattattaatcaaaataggaaccattacaatcaacacatttttgacaatgagaagtaagttggtttattcctgtagtgtaaaaatccatgctttgggattcaatgaactctaggaaagcattttctgcattctattggctgtggaagcattttccctgcaaaaagttgttgagatgcttgaagaagtggtagtcagttggcgagaggtcaggtgaatatggcaagtgaggcaaaactttgtagccagttcattcaacttttgaagtcttggttgtgcgacatgcggtcggtgttgttgtggagaattgggccctttctgttgaccaatgctggctacaggtgttacagttttcagtgcacctcatcaatttcctgagcatacttctcagatgtaatggttttgctgggattcagaaagctgtagtggatcagaccagcagcagaccaccaaacagttgccatgaccttttttttttggtgtaaattttgatttgggaagtgctttggagcttcttcttggtccaaccactgagcttgtcatcaccagttgtcatataaaatctactttctgtcacttgtcacaatctgatagagaaatgattcgttgttgttgtgtagcataagagaagaagacacttgaaaacgacaatttttttgatttttgctcagcccatgaggtacctacttattgaacatttttacctttccaatttgcttcaaatgctgaatgaccttagaatggttgatgttgagtttgtcaggaacttctagcatagtcgtaagaggatcagcttcgatgattgctctcaattggtcattgtcaagttctggtggctgtccaccacactcctcatcttcaaggttctcatctcctttgcaaaacttgaaccaccatggcactgtatgttcattagcagttcctgtgtcaaaagcattgttaatgttatgagttgtctccactgctttaggacccattttgaattagaataagaaaatcacttgaaatcgctttttgtgtgacgttatttccatagtctaaaataaacataaaataaacaagaaattggcaaaaataaataaataaataaataatacagcgagaaatgcccaataaaatgttgtataacataaagagatttatttaataatgtattccaatatcaaatgacaaattccaacaatgcaaaaaccacaattacttttgcactcactgagtagatgtacctaggagtgccatacaaagaggagggagagagtaggaacagctgagattctctcttcctcctgcttctagtctaccatcctactctccactgaccaaacctgcctaaaaccagtagacaacaaacctggggaacgtaattcttatgcatctaccccttaaattgcagagcacagcaatagaaatgtacaaagtgaatctgaaagtaaacaaatgcggacctaatagacatctacagaactctccaccccaaatcaacagaatatacattcttttcagcaccacaccacacctattccaaaattgaccacatagttggaagtaaagcactcctcagcaaatgtaaaagaacagaaattataacaaactgtctctcagaccacagtgcaatcaaattagaactcaggattaagaaactcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcattaaatgcccacaagagaaagcaagaatgatctaaaactgacaccctaacatcacaattaaaagaactagagaagcaagagcaaacacattcaaaagctagcagaaggcaagaaataactaagatcagagcagaactaaaggaaatagagacacaaaaaacccttcaaaaaattaatgaatccaggagctggttttttgaaaaagatcaacaaaattgatagaccactagcaagactaataaagaagaaaagagagaagaatcaaatagatgcaataaaaaatgataaagggcatatcacagaaatacaccgatcccacagaaatacaaactaccatcagagagtactataaacacctctgtgcaaataaactagaaaatctagaagaaatggataaattcctcgacacatacactctcccaagactaaaccaggaagaagttgaatctctgaatagaccaataacaggctctgaaattgaggcaataattaatagcctaccacccaaaaaaagtccaggaccagatggattcacagccgaattctaccagaggtacaagtaggagctggtaccattccttctgaaactattccaatcaatagaaaaagagggaatcctccctaactcattttatgaggccagcatcatcctgataccgaagcctggcagagacacaacaaaaaaagagaattttagaccaataggcctgatgaacatcgatgcaaaaatcttcaataaaatactggcaaaccgaatccagcagcacatcagaaagcttatccaccatgatcaagtgggcttcatccctgggatgcaaggcttgttcaacatacgcaaatcaataaatgtaatccagcatataaacagaaccaacgacaaaaaccatatgattatctcaatagatgcagaaaaggcctttgacaaaattcaacagcacttcatgctaaaaactctcaataaattaggtattgatgggatgtatctcaaaataacaagctatctatgacaaacccacagccaatatcatactgggtgggcaaaaactggaagcattccctttgaaaactggcaggagacagggatgacctctctcaccactccttccaaccttgtgttggaagttctggctagggcaatcaggcaggagaaggaaataaagggtattcaattaggaaaagaggaagtcaaattgtccctgtttgtagatgacatgattgcatatctagaaaactccatcatctcagcccaaaatctccttaagctgataagcaacttcagcaaagtctcaggatacaaaatcaatgtgcaaaaatcacaagcattcttatacgccaataacagacaaacacagagccaaatcatgagtgaactcccattcacaattgcctcaaagagaataaaatacctagaaatccaacttacaagcgacataaagatctcttcaaggagaactacaaaccactgcacgatgaaataaaagaggatataaacaaatggaagaatattccatgctcatgggtaggaagaatcaatattgtgaaaatggccatactgcccaaggtaatttatagattcaatgccatccccatcaaggtacccatgactttcttcacagaactggaaaaaactactttaaagttcaatatggaaccaaaaaagagcccacatcgccaagtcaatcctaagccaaaagaacaaagctggaggcatcacgctacctgacttcaaactatactacaaggctacagcaaccaccacagcatggtactggtaccaaaacagagatatagatcaatggaacagaacagagccctcagaaataatgccgcatatctacaaccatctgatctttgacaaacctgacaaaaacaagaaatggggaaagaattccctatttaataatggtgctgggaaaactggctagccatatgtagaaagctgaaactgaatcccttccttatatcttatacaaaaattaattcaaaatggattaaagacttaaatgttagacctaaaaccataaaaagcctagaagaaaacctaggcaataccattcaggacataggcatgggcaaggacttcatgtctaaaacaccaaaagcaatggcgacaaaagcgaaaattgacaaaatcgatctaattaaactaaagagcttctgcacagcaaaagaaactaccatcagagtgaacaggcaacctacagaatgggagaaaagttttgcaatctactcatctgacaaagggctaatatccagattctacaatgaactcaaacagatttacaagaaaaagacaaacaaccccatcaacaagtgggtgaaggatatgaacagacacttctcaaaggaagacatttatgcagccaaaagacacatgaaaaaatgctcatcatcactggtcatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaactattgtggaagtcagtgtggcaattcctcagggatctagaactagaaataccatttgactcagcaatcccattactgggtatatacccaaagtattataaatcatgctgctatagaggcacatgcacacatatgtttactgtggcactattcacaacagcaaagacttggaaccaacccaaatgtccaacaatgatagactggattaagaaaatgtggcacatatacaccatggaatactatgcagccgtaaaaaatgatgagttcacgtcgtttgtagggacatggatgaagctggaaaccatcattctcagcaaactatcgcaaggacaaaaaaacaaacaccgcatgttctcactcataggaggggattgaacaatgagaacacatggacacaggaaggggaacatcacacaccggggcctgttgtggggtgaggggagagggggggatagcattaggagatatacctaatgttaaatgacgagttaatgggtgcagcacaccaacatggcacatgtgtacatatgtaacaaacctgcacgttgtgcacttgtaccctaaaacttgaagtataattaaaaaaacaaacaaacaaacaaaaaaaacaaatgaccagcatgttgattttttttccttaaaacttgcagtgtaaaggataaaccaaattggaagtgacattttctataccaggtcaatgtcttttctcagtaagcatgcatctccttgactactgtattcatttttttctgtagctgcgtaaaaaattaatgggttgaaacaacatacactcatctcacagttttagtgtagcagaatctgtgcatggcttagctggatcttctgctcagcatcaaacaagactgcagtcaaagtgttgtttgggctgcagtctcatcatcagtttgactgaggaaagagccccttctaagcttcctcaggttgtttgcagaattaatttttctcgcagctatggaactcacgatgtcttcttcaaggccagcaaaagtgcttctcttcaacacggacctagtctcttgtagggcttttcaactgattgtcagattcattcaggataatttcccacttgattaactaaaaatcaatttatttgggaccttacactacatctgaaaaatttctccacctttgccatggtacataacctaaatacaaggaatgaacttttattctaatcattcccaaatagaaggaatgatcttttattcaaagatcttgcccacattcaaggtggggaggattatgtagggtgtatatacattgaggggttgggggggcaagaatcatggggtcttctgagaattatgcctacctccagtgctttgtataatcttcatatttttcccacatatagaagtcatatttcagaagttccactgttgaatttttttctagttctgtcagttgacataattgcctttttttagaaaaggcaacttccattccatagtctcagagataatgataagaagcccagtacatggtgattgcactttctaattttattctaagtttactggtaacagattatatcatcagaattgaagaaacaaatataatgtactgctgagttattcagttactgggaggagataatagtatttctaatgattgatgaatgaagtcagcaaaactagaggtgagtatgtggtaaactggaagcgtagaacaaaacatttaatttattaccttaaggagcttttattttatgaacagtggtcccttggattataaatctacatttatgggctctccaaagagctgtcaccttagaatagaaagcactgcagtccacagagtgaagatcagcgtctttacagaactgatggtagatagatgctcattatttgaataatccatatgcaagactctagaaagtggtgtggggatccctattttgggaagctatacattataacaggtatttttaagggccaagtttgtggtcatggctctgagactcattgctgggtgaatttgaacaattttcttaacctctttaggacagcttctttcatctataaatgaattggtggattctaaagttgaaggctccaacattctatatgtcttaaaattatagtagagatgctatttaggtgccttagaatttggaatccttgcttttcgttttttaaaaggagaaggatttcaagtgcatggtgtgttgtcagctgggaaaaagaaaacacagagaacacaaaacgtaagaccctcattaactagatggtaatacacatagcccttattgttttcatgtcataaagaaaaacctcctcagtatggctttgaaacctttcctgtttttgttccctcctgctgaagcaacaagagcccttgccttactttatgtatttcatatgtcacatcctctcttgattttgactgaaagatacattctcagtttcttaatctgacacgctatttcccctttaaggtggaagccagaatgtctgtgacatatcctccactcctccttcccctaggctgtagagatcttcccagcatttattgtgcaggcgttgcctgtgtcattgcaagttctgtagtgacatcatcctgtttctttgaggcagggaccttaattgttgctattggcttaaatgattaagtgaatgtatatattagactttaccctacatttaagtattccaggggtaagataaaggggtctcccttctctctagtaagccataggctttcaataatagaattttaaagaatagcattgccatagtttgagtatgtcttctaacaatcatgtgttagaaattgaatccccggtgaaacagtgttgggaggtggagctaagtggaaagtgtttggatcataagggcttcaccctcatgaatgaatttatgcccattgtaaaagagcttgagactgccagttggttgttttgctctctttttgcccttttatcatcggatgacacagccagaagtccctcacaagatgtgggctccctgacattggacttcctgaccttcagaactataagaaataaatctgttttattataaattacccagtgtcaggtcttctgttacagcagcacaacatgaattaaaaacaaatatatgcatcactttttaatttaacaaatatgtaacacttattgtgtagctggcattgttctacgcactacacacactaatttaattcttataacaactctatgaggtcattgctgttattgtctctgttttatggacaagagctgaggcacagagaagtaacttccccagtgatcttgtttgtctcataatgaaaaccagtgttttcttttttccccagcgtttaaagtggtctgtgtagtaaaacaatttttaaaaagagaaacacaatcattgttttttcctctagaatgtccaactgaaaagtagttgtttttaaatcaattaggagattctagttttgaagttgagccctattgttgacaagaagggagcactaaaggaaacccttgggactagccccataatgttggctctctctagttttcacacagaaagataactcttaaattaaaaaccagttactaatagagcaaaacgaaaaggttgagacagcatgacacagaatgggcaattacttttagaggactttttctccaatatttctaataaaatgggacatgtttcctcaatgctgctttgaagaaaatattgctaacttaaatataacttaaatcacaataataacaatccatgatagaggaaagaaatcgcacttttctagttttcttttatttgcatttaatagtgtggcaaagctttagagaccttttccaagattgctttagcaaatttgtgcctttgatcaaacacacaccataccacacacacagacacacacgcacgtgcacacacacacacacacacacacacacgtctattttgaaatccagttgctttaatggtcatcataatgatgctgtctatactcagcttctcaatacttcttttatgaccaagaactagacaattgtcaatacagaaaagtcaaggaggtaaaccatgtgacaaaatgtaaacaggtgttcaataacaatgtcttatgaaaatgactggtgttagaacagcagaaggatttgagatcatctgaggtttacatctctatgggccctcttgcctatctgggggctaggcttatgggggacatgcaataatacatttattcaacaaataaatttgtgagtgtgccaataaaaaactaaggcctggccgggtgcggtggctcatgcctgtaatcccagcactttgggaggcagagacgggtggattacgaggtcaggagatcgagaccatcctggctaacatggtgaaaccctgtctctactaaaaatacaaaataattagctgggcgtggtggcgggtgcctgtagtcccagctacttgggaggctgaggcaggagaatggtgtgaacccggcaggcagagcttgcagtgagccaagattgcgccactgcactccagcctgggagacagagtgagactccatctcaaaaaaataaataaataaataaaacaaaacaagacaaaaaacaaacaaacaaaaaaaactaaggcccagggaaattaaacaacttaatatcatgcaaatatgagacagcagagagaaacactgaatctaggcattctgtcttcatataccacattctttcccatactccttggctattatttttacacagtgcagatatttattttgttttttaaaataatatataatgccactatttatggagtataaatcaatttggctattacatgtttgcctaaaagaatttctgacatttattttagtacaaaaatgttcctaaatagcaaataaatttctgttattattttgttagaattcttttggtgtacctatttgcttctccctcaaaagtgcacgtctgcaagaatacttgtgcaggcagtccagggtggacagaaaggtctgtgggagaaaaaaatgtaaagattgaacctgaatatggattttgaaattgatgtgctttaccaagaaatttcaagaggagagaatgtatgcctttacagaaccaataaaatgattatggtatttattttcctttgccaattattgattcattagttcatattaatagatatcttaatttaaaagtattggggagttctccaattataccctaaatgatcaaagcataatacatgctgatatggtttggctgtgtctccacccagatctcatcttaaattttagttctcatgatccccacatgtcatgggagggaccccatgggaggtaattgaatcatgggggcggttatccccatgctgttcttgtgatagtgagttctcatgagatctgatggttgtataaggatcttttcctcctttgctcaacactttctctcctgctgccatgtaaagaaagatgtgtttgcttacccttctgccatgattgtaagtttcctgaggcctcccaagccatgcaaaactgtgagccaattaaacttcttttctttataaattacccagtttcaggtatttcttcatagcagtgtgagagcagactaatacactaaattggtaccacagagagtggggtgcttctttaaggatacactttggaactcggtaatatgcagaggtgtaatggtttggagggtgctgaagaagatgggaaaatatgggaaagtctggacctttgtagagacttattgaatgattttgaccaaaatgctgatagtgatatggacaaagaagtccaggctgaggtagtctcaggtggagataaggaactttttggaaactggagtgaagatgactcttgctatgcattagcaaagagactggtgtcatttttccccttccctagagatctatggaactctgaacttgagagagatgctttagaatatctggcataaggaatttctaagtggtaaagcattcaagaggaagcagaacataaaagtttgaaaaatttgcagcctaacaatgctattggaaagaaaaacccatgttctggggagaaattgaagcaggctgcataaatttgcataagtaatgagcagccaaatgttaatcaccaagacaatggggaaaatgtctccagggtacatcagagaccttcatggcagctcctcccatcattgattcagaggccaaggagggaaaaatggtttcctgggctcagctcagggccccctgctctgtgcagtcttgggacatggtgccctgtgtcccagctgtttcagcgccagccatggctaaaaggggccaagatacacctcagaccattgcttcagagggtaaaagccccaagcctcaggggtgtttacatggtttcgggtctgcaggtgcacagaagttaagaattgaggtttgggagcctccacctagatttcagaggatgtttggaaaagcctggatgtccaggcagaagtttactacaggggtggagccctcatggagaacctctgctagggcagtgcaggagggaaatgtgaggttggagcccccacacagcatcccccctggggaactgcccagtggagctgtgagaagagggccaccgtcctccagaccccagaatggtacatccactgacagcttgcactgtgcacctggaaaagctgcaggcactcaacaccagcccaagaaagcagctgtgatgggggctgtatcctgcaaagccacaggggcagagctgcctaaggctgtgggagcccacctcttgcatcagcatgacctggatgtgagacatggagtcaaaggaggtcattttggaaatttaagatttaatgattgccctattggatttcagacttgcattgggcctgaagtcccttttttttggccaatttcttctcttggaaaaggtgtatttacctaatgcctgtatccccgttgtatctagcaagtataatgactaacttgcttttaatttttcaggatcatagacataagggacttgccttgtcttggatgagactttggacttggatatttgggttaatgctggaaggagctaagactttgggggactgttggaaaggcatcattatgttttgaaatgtgaggtcatgagatttagaaggggctaggagtggaatgatgtggtttggctgtgtcccccaccaaatctcatcttgaattatagttcccataatccccagatgtcctgggagggacctggtgggaggtaattaaatcatggaggcagttacccccatgctgttcttgtgatagtgaatggattctcacaagatctgatggttttataaggggcttttctggctttgcttggcatttctctctcctgccaccttgtgaagaagaatatatttgctttctcttccaccattattgtaagtttcctgaggcctccccagccatgcagaactgtgagtcaattaaatccctctcctttataaattaaccagtcatggacagttctttatagcagcatgagaacagaccaatacacaagcctatgtgcattgtggacactgctcttactctgcacaggtctctggctcccacctgaaagttctgttcacacctcccttcattactatttgcttttgcttccaaagatcctttgcctgggacttgttttggagacctgctcttggactactagaacctcctggagctactttgtggacacaaaggaagcagaagtacctgcaattttatattcacatgagcaacccagagccagtgactaacttgtcaaagagtgtgaaaacccagctccttgcccagtcttgggacaaactctcagatatcacttatactccagcatctgcctgtaggatctagcctaacctttcctgcctgggactcagcctaaaattttccttactcttgaatgttttaatctttccatttcttttttccttcctctcttgctcatttttttcctgggagcacttcctgaataactcacttgcccaagaatctttgttttactgtttgcttctaaagaattggcctaaaatgtatactacatgatttgcaaatgttaaattctgattttagcctctgtatcaattttctaaaggggtctatatgtttcttctggaggctctggggagaattagttccttggggtttccaagtacattccaagtatctcccaacctctgcttccatcagcaaatctctcctgcctctgccttgcaaggatctttgtggttacgttgtgtccaccctgataattcaggctgatctcctcatcctgaagcctttaattaaagcaaatctgcaagtcccttttgctacataagataacatgttcataggttctggggattaaaatgtagaaatttgatggggtggactattctctttaccatagcaactcagaaagatgaccttctctgaaattttattaatctcctgtttgttacagtcttctgttacttatactcataagtgaaattgacctatcagaggtatttttgtgggtcagagttttgtataatattgttgttagtataacatcatttactgagaaaattacttttttctttggtctgaaactttttacattgcaaacaatgatcaatgtgaaaaaacatgtatttataaaatcaaaatgagtgtacaatgcttgaaagctgttcttaagattaaaaaaaaaaaaaaccccacaacacaagttttccaattattttcagtattttttccccatgaaagtttttatttcttctgtgccagttcaaagtcatttgcatagcattttataggatgtcatctattttctttcaaaatatactgcatgctcctattttctaatataatgctgtctttctttccttcttgattgtaaagtgcatggaatcttatttgttactatgcctttaaatgtcctagctcttaaatttataaattctgttatttacacattttctcttgcaaatgttttgaatgtaatatatttaggtttgctcatttttcctttgctagaattgaatatttagcatatattttctattaaatgataacttgttttagtttttgaaaatgagattattagtttcatgctgcccttcaacatttcattcaactatattttgctttatttggaatagctggagaattttatagatataccatatataactgatctcttattgctacacatcgatatactgttcaagttttttgtatcagaaaaagcactataataaacaaatttatattcacttctgtatgcttttatttaaatttccttagagaattttgacaaaaatcttgaaggagaaattgtctgggtgttttggggaaattgtctcttcctctttcctaaacacaaagattttacttcccattttagggcctctgatcagctccccacctccagtacggccccacaactcagcaagttttctttacagacatgtgtttgtggcctcttggattcccagtgccccactccatcactgtgtgagtggatttttgttgggtaacatttctccagcagagactctctgtgttggccaagtgtggcccttacctgtgccagaatcagcagatgccctagggaagacctggctagagaatgtcagtttctcttagaaagacatccctctctgaaattttaattcatttggtctttgttgcttattcattctgtcaaataacactgattgagcatctactctgtgccagagactaggaagtttttatgagtccagaaaatactttctagctcttaaaataatcaaagacaaagactaaaattactacagtgagaggtaagataagaagagtttcataagaggggccatggactgcttataaattggagaattccaggcatcagtgcacacatttgcatccaaatcactgtttctagtaaagcctacaaataattgaggcaaaagtgcctgggggctggattaactgggcgtattttctcaattcagcacttgtacttgagggtgttgacagagtgcagaggagaattgtaatcctattgacaagactgctgtgagaaaaaactaataaaaatgatgtgaagacaaacacccaagtcctgtttcccagggtttccaacattagcataaatgaaggtctgttttcaaaaactcagcagaatctttatgccaacaaatatatgagaactgatgtttggtatacacagccttgagggctgtgtgtgtgtgtgtgtgtgttgtgtgtgtgtgtgcatgcatgtgtgaaagtctggcagttctctgtattcagggacatatatgtatgtatgcatcggatggcagggacttggaatcagagcacatgaataatctctttgcaacctaatgatggtgtggcctctgacaagtgacacggaaaatccaggcttccacttacttttcttgctattgaaaataattatttgcctcatggagccatcttgaagttgaggtgaaataacacctgccataatggagttgtctctaagaaaagtaaacactgaaacaggcttctttttcagaacaatgacacttacctggacctagggtccttcttaaccacatttaatcatcataataagtgataaccacaataattgatggccacagtaagtaccataatagtaccaattgctaatatctcctcaatgcctcattgcacactcccagtccccactttggccaggcaccacctgcttctctgccacagtaagattacagtatgctgccaagatcactacaaatccagctgaactaaaatgcagaaataagagggatgaaccctgttccccagtttaagagccagttctggaggtgagaccaattggtagagcaggtaaacaagaagaaatggactgaaactaaaatcacacaaaaccatctgagaaatacctggaagcaccaagccctcagaagatctaccagttcttaaaacatgggcttagatttgcacattgtactaaaaagcatactcattcctttttggtttccttttttcattgtcttaaggtttttgattagtgccaccctgttgaagtcaccatgatttttcctatttcctgaaaagctttcaatatttcaccattaagtgctgagaaatgtaaaagaaaaatctatttacagttccactcgtttagaggataccaaacttgaatgttgtcttttatcacagttcttctttttaccaccacctgcagctctttaaagaccatgaactttgaatggttttagtatgtcaaacacttactgagcctactgagtaatgaatgatggaaattccttaaatcaatggtatacaaatgatggcactgattctatcctctccagggcattagttttcagtgtttgattggtatcccatcaaaacatgtactcctccactctgcaatatctaccaatgaaatcttccgaagtcccctcctctggctgctcaatgaagtccttcacttgtctgtatcccttgcctggcaagttactaaattcctttttcagcttttcctttaaaaaaaaaacaacttcaggagaaactcctctatttctagttgtttaaaatttttattatgaattgaaaactgaattctaccatatttttccctgtacaatttggctcttatatggtttctttttgtgtttatttagtttgctaatattttgtttagaatatgtgcatctttatttattaaagagatgggtgtgcaatctcactttttttgaagaatgtacactctttaagttttctggaaatcttggtatacgagggaaatatttctatattgaatgtctgggactattttccaataatattatgtagtgctggagtttctttgtgggaagaatttggatagtgaattcttttaaaataatggttagatgatttttcaagttgttgatttttcttgaatgatttttaagttttgtccattatctaaaattacaaagtattagcataaggttattcataatatattttaaatgtctatttaatatctgcacaatcaacccccaagagagacaatctgcatttttggtcctgagataaaatcactaactgttaaatttgagctctctcccccatagcaggagtgaaggaagactgaatggacaagtgtggggtggaggttgtgaaggttttcttttgattgcttctattttcttggtgaaatgaaaagcaaggtcatgggctgagagtgagtaggtaccagggagtatcaaggactggaagagaagaatgagttatggaagagttgtctcagagagtaaaaggaggaagtgaccaggaatatgttgtatgatttccaggcagcttgaagtagttgttgaaggcttatggtcataaaatccaaatgacatcagaccctgtggctgtgtgttcctccatgtgtggaatagatagagagctggatgtaactccaattgagattctggcctgtaagggtgaagaagtcagagtttgctggattggaccaattactaataaataaataatgctcatattcttttgttttgttaatacttgctgcctttaattttatattatctaataaaaagttcctttattttcaattttgctttatattttaatatatttggccatcctttaatttttaatcattttgtgccatttggctttagaaaacatatctcttgaaaacaggacaaaacaggtggtgatgcactctttcttattcttgcaaattgcattgtgttcttccttgctgtttttatttcctttttatgctatcttaaattctcatgtcttctcccattggtttgaaaattataattttaatatttacactctgatggtttcaaaacatacttgatactttgtctttaactacattagaaatgaaaatagacagcacaatattttccaaaggaatgcgaaaatttattacttttgttctcactgtcctctttctctctaaaagtattatttagttgtattaaatttttactaatacggaatttttgaataaggtgtttactattacatttttatattgtaatagttactttattcaccaatcagggaaatagaatgtttttaatttatttcacaattcattacttactatctttgaaataatacgtttctcctgtctttgaatagtatcctggtcacataatgaaaaacttcccaaacttagtatgcacacaactcactgggattttgtaaaaaggcagatgatgactcattaggtctgggtgggcctgagattacacatttttaacaagctccaagatggtacagatgagcagattgtctcatttgccgatcactttgtatagcaggaagatagagtgtttccttgaaaaccttctcctaagaacagtgcacagctagtatagtttctgagttcttgcagaaactgagactattccaagactactgtatcattacccttgtgcaatgacagtagtctgcctagctgattgtcttctggtgtcacagcatttttttttctcatagattttcttgttgtaatttttcagaaagattgctttttagaagatggaaatggatcatatgagtaagaacgtgcattcagtgagacatactattttgagtcatattttgttgactttaaattgtgtaaactttttgcattaatagtgtttaatgtgtaaagtacatcccacttgatgatatgtttctaaagttcatttgtttattttaatccaacaaacatggaaaaagagttctgtgaatagcatccttccaaacatacgtgatacagcactgattaaaatcagcaaaattccaacccccaaggagcttaaaagaaaaaaatatcctggaattaagcagtaatagtggagatcaagaggtctgaatgcattcaaataccttttaaaattaaaaattgcaagaataatttgtaagtatcttagtctttggtcttttatcaatttagcttgtctgcttattactgaaaattatgattgactttattaatttatatgatctctttatataatgtggaaaataactgttatatttaaatattgtgtttattttttaaaattaagtttgattttttatttaaccaaagtttttaaatatttaaatggtagaatcttttgcttcatgtgtttgtattttcttctctgtttgggaaatcatattgtacatataattttgggtcacaaactatttggctgactttaaattgtgtaaactttctgcattaatattttgaaacatgtagtgtttgatgtataaagtatcaatttttatcctttgaatgccattacattgtctttgtttctttatatagtcatatttattatgtgctctttaaaccagttttcctaatgtcagattaaaaaacaaaaaaagaaacttttgttttaagttcaggggtgcatgtgcacatttgttatatagttaaaatcatgtcacggggtttgatgtgtagattattttgtcacccaggtactaagcgtaacacccaatagtcatttttactgcttctctccctcctctcaccctctggtaagccccagtatctgttgtttccttttgtgtccttgtgttctcatcatttagctcccatttatatgtgagaagacatggaatttggttttctgttcccgcattaatttgctaaggataatggcctccagctccatccatgttctcgcaaagaacatgatcttgttctgtttcattccatacatagtatttcatggtgtatatccagattttctttatccaatatgccattgtctttgaaagtctctaagaacttgttgggtgcatatgtattttggatagttaggtcttattgttaaactgcaccctttaccattattaaatgcccttctttgtcttttttgatctttgttggtttaaaatttcttttgtctgcaattaggattgtaccctctgcttttttatgttttccattttcttggtagatttttctccatccctttattttgcagaagttctctgcatttcctgaatttgaacgttagcttccctaactaggttggggaagctatcatggatgatatcctaaaatatgttttccaggttgcttccattctccccatctctttcagggacaccagtgaatcacagattcagtctctttacataatcccatatttcttgtaggttttgttcattttgtttcatttttttttttttattcttgtctgactgtcttatttcagaaagccagtcttcaggctctgagattcttttctcagcttggtctattctactcttaatagttgaaactgcattatgaaattcttgcagagtgtttctctgctctatcaggtcagctatattctgttctatactggctattttgtctgtcagctactgtatcattttactgtgattcttagcttcctccaatttggtttctctgttctcctgactctggatgatctttgtgcctattcatgttctgaattctatttctgtcatttcagccatctcaacactgttgagaaccattgttgaagaactagtgcagtcatttggaagaaagaacatgctctggccttttgaattttcagagttcttgtacttgtcctttctcatctttgtggtctcatgttccttcagtctttgaagttactctcctttggatgggtatttttcccttttattttatttgatgactttgggggtttggttgtggtataaggtgggttcagttgactggcattgtgaatggaagattttagggggccttggatcagcccagaactcctgaactgcatgctctaactctggggtactgttattgccctggcttttatctctggcctctagagattagaagcctgctgcactggaggggcagttgctcttggactactggtcataacacttcgaagggcggggccagccaaagtacttcatagggtggtggcagtggaacctgtccttgttggcatgtgccagcagcagcagtggcaatgagacagggtgcacacttgtcagctgggcagggtgctagtgggtgctggggtgccagtttctgtgcaggcgttcacagcagcagtggtggtggtatgacttgggtggatggcagccctcaccggtgactgtgtgttcatgctggtggtggtattagcatgggggcagggggactggtggactcaggactgtatgtctttgagtgttcaggctggtggtcgtggctgctaagggctggggtggtctgcctttttccgctgtctagtttgtggctggcagcagtgtcagtgcagggatgtggtgctggtgggggcaggtctggcaggctccatgcccatcaacactaccacatcactggcggtgccgcttgggggtgagggtttagggtgcactcacacctgcagcagtggcactgcagggtgcacatgcacacgtgtactgctgtggaaggaaaggttaggtctgccggtgtacacatgctcctgcagagcaacgttgggggtggctgtggtcaactgcctgcaggcgaagcagcatgggggaggctgtagtgctagggagggtgtgagtgggctgttgaatgtccataagggctgctctgctggagcactctgccatcaggtggtcctctagcataggagctatgatgtgggcccccaggaggtaactggcctacaccaaaccctctgggctctgcacctgctggaggtatgcccctaccacttctctaatcagctttcaagtgtctgtggtggttgggagtttcctcctgccagaattaccgaggcctatggtgagagcgagttgctccttgcctgttcaactcacctccactgcaggagtcctggggggccaggaatgagtcctggtgcgcagttgtcccattcagggttcccaacttccttcaccttcagcctgtgttctgtgtcttccctctatctgttgtcaattccttccttctgaatatctgctaggagtgcgccagtctttcagatgtcccggtcccttagtgtgagatgttcttcctggctacgtctagttggccatcttgcaagtattttcatagtaggcaattatcagacttttaattatttctttatatcttttaggcaattggttaggcttaggcaagttttcctaacaatcagctggatgtgctatacccataagattaattcaaccagtgatcatatatgcatattgtgaacacataaacatcacactctattaatttgtaaacgtttttgaaaagaaacacttattaattatataatgtattattaggcaattatttatccagtttttaaataaacagagtttctacaatctgtatttttcaacatattaatttaatgtaggaattaattgcctgtgtttcaaattataagttttatcttaataaatgcttacagaattaacaagtctacactgttagagtgatcctagacttgttagtgaatcactaggagaggatcaagatgcccagacactgaagagacagtgtagcaagaatgcatcacacaggaatgggagagaatcagaaatgagaaggggaagatgccatagaatccatgacactgagcacttagtatgtccctagtaagacttactatgtatgaaggaaggtaacactcagcaactagcatcgtgggaaagagcctaagacagaacagatggagtaaaattgtaaacacttcagcacgcaataccagagacaggagttaaacatattgcactaatattctaaatgctgtcacaatggaacgatttaactcagttcagtgtttgggacatcactatcaccatagctaattacaggggaatccacatgaagcaataattgcttagaacatattcaagggccaggactgctttcatctgtgaattttgactttaaatcactgcctgtaaataatcacagccaaatatttgttgatttctcaaaattttgccattggattattaaaattttgccattttaataatgtcacaatattataacatagtttactgactgtatatatgcctcaatatataattgaattagttatgctgtttgttttaaatgttaataataatctttcattagatcactttcactcctccacatgacttccagaaacaatttgctaggttataaaagtattttcctttggattttttactaatatttcatgaagatatataggttggctttgaaacattggtgtttgatcacctcattcaagaaaatgccgtttcttcagatatccaagtcacttttatctccacttgcaaacttttatagtcttgttttgtaggttatgcatccttctcacagtatatcctgaagaattttaaatgttagttgctatagtgaaggagatcttatatattctatgcagccagaaggggctcatcatgggggtattaatttttatatatttataatatgtgcactatttattggacttttctaataatatttggcattgattggagcctttagtgcctccttgttcaataccatgggtatgtctgtattgatatagaattgagtctcagcagactagaagactctgaaatatctgtcagaaactaaaatcttgtgggaatgcctgaagtgaatctcacctttagaagggcaacaaagtgagaaactggttaattttggactctataatggatactattagattttactcttgaaacatctgggtggcagaggtcaattaagcatggttgttgaggaactggaaagtttttgttgtagtcttttgctgtaccatctatttacagaaagtattatttttaaacttttgcaaatataattttatgtttttccctaatttatattgctgccaaatgggagagcacaggtctaaattattgtacctgccacacctacatgaggtggaaaataccatgaaagtatctttgtgcagaaagggaggattcatggtgctttcatctgtggacctccagtggaaggaggacaatccagacctaatttagagcacggtgggaaacataccttttcattttatatctttaaaaatctatggaggggaagtaactgattcacacaatttagacattggtttatcctgtgtacttgggctgctcaaacagggcatataattcctaattccaagggaggataataaggtcttcttttcttgcaacccaaagaggttgagcattcatatatattttttcaaagtcaaaaaaagtacctatctgggaaaacccaaacaagctgtgagattgctattagttaaatgattatctaaagcatagatatatacatggaagcacatggagttgcattagccaactcttgtttggtatatattaattctacttctcttattagcgtaatagtgggacttcaagtaggtagtccttgattatgctatacattcattacgatctaggacagaggataaatttagccctcagatacattggtttttgccttcatgtttcattttttaacatttacattgacattaaagtatattgtttatgtgtctaagtttataccaccatttaaatattagtaatcaacatttttagtttttcttagaaacagaaaggctgctctgcccatgactggaattcacatccacaggggccccctttagatgagcatgtgcccctggcatttgccatgaattgtcaaacaatgttttggtcacatttatatctgcctcctccactaattttagcttcatgtctggttcctgaaggcagatagaactctcatttgcatttctgtaattcatttttatagactattgctgtatttcatcagaggtaacataaagattaaatagagtccttccctgtcagttctacagctgcctgagaaagttttgtctttaatgtgaaacaaattcttttctatcttctgttttcctttcctcttagcaaagatccaagtaataaggaagtttcaggaatcatggatatgttaatttcgtctttatatatgtatgtttcctacacgttatcgggaagggaacagttagatacgtcccttgtcaaagaataaacattatcttctgggttaaatttgattcagaaagattatgattataagtatttgaatagcattatgcaatatataaaagatgatcaattatagtacatctttcttatttttggaaataacttgaactatgtactatgctgtcaagctcaaagggtatcagaagagtcaaacagacaggtgaatatgtctaggcatatgttttgggtggacagggatgcacttccagccagcttctctgatgctgattcctggttttctccactacaccatgacttcatgtttctatcaccaccatgaagtgcttctctagtccttgaaaggaaatgtaaaaattgatattttcactgtctccccaggtttatggtttaaccactatgcagcttagggagagctagatcctgtagagaggagaaaaaggttaaatatctttaaagcaggtgactggctccaaggttcttaggttaccataaatgagaaaatgagttcttaagcaaagagaaggagcttgctttggaagaaatcatttcttaagaagccttgatgtgcagaagggacttactagctattttgtaccaattactatgtattcacaacctttcatttgtgatcttgttgaataatttataaagtgtcatgtcatcatcagaaagccatatgaggtagaaaacaatcctaagtatttacagatgagaaaactgaagttttgtgtggttaacatactcatagttaatactctgagtaagtggctgagtgagggttttagcccaggactctcgaggttgagtctattatagctgtcaggggtgctagaaggcagctattttcttgcaactgttctgtttcccaagtttcttctttattaatccattgcactccgatctaccttcatgagacttctctgattaaagacacctacattgcaagatcagaatctgtcaggcggccacagattgattttcttactaccagagcagaaaaacacattttctatttcccatatagatttttcagtgcagctgtgcaggtaataaactattggcacattcagattatgggtgatgcacaaaatctagatgtgttgtatatgatcttccaaaaatgcaaattaaaatggtatttgcttcatccttcagctctggtgtttcatcacccaatgtcactacaacagtctgacagaaactgcaggaacaggcagaatagaaaatgttagatttggaaattctggtaaactttatttaatatgcaccctatgcagagagacatggggaagatatgcctatgtttggagcaatatctttatcaaattagcaggacaaaatgaggctaaaggcatgacatatcttattgtccacagccagtcttgtagctcagagttctctggcactgggcttaaaggaaagaccacaactggctatttaagagacaatatttacaagaaggtgtccagtggaatgtcagtgcccatggaggtaacatctttccctctcttcatgtttctgtgttggtccttagtttaggatttttatcaaacatttctacattattgggaagttctggtggactttcgccaccatttttaccttctcaggaaagtgtttagaaggaagggtctgtcatttcttctagcccctcacttttcctccacaagggagaaggggtggttatacattggagggggctggagtaaaagtcccttcatatgtgtgatctcctctcccacttactttctctccaatatgcctcactacaggaagcatgcctccggaaaacacttctctggtttcctctagtctgttggataaaaactaagtcagtcatggtcctcagggaagctggttggatgattatctgctgttcatatcctagtagtgtctcactagccttaaatactggtcccatgacccactttagggaagaaaaaggaagcatttgctttggcctgatactaaatctcattttccagatcgtaattatcattgacagcactggcatttttattcctgtctgactgtggtttctgtctttgattctgaacataaagagagataaagtatttcaagtgtagtgacccattgtcttgctgacattagcttagaaaaagcagaacacagcagaaggagggcaagccttgcaagaggtcaccacagtctagaaacttggtttgccagggaaactagagctcatcaggaccttggaaatggcattcaacaaacaaatcataaggcactacagcttagcagtgtgaatatatcatcaggcagtgagaggaaaaatgttcaagtatcccactctctgggacccacgtttatctcttgtagggatatctaaatggcattcttactggaaacaaagatggccttgactgaggggaaagacagtgcactggatgatcctgttggcccacattagtaaagttggcaatccaccacagaatcaccattgggataaagtatcgccatgtgacagcacatggagtctccagcactggagacaaactgaaaggatcttggtggtgtggtagggggaggcctttatctaaagtccacaccagtgacttttctcctactactttattatctctctagacacaggggctaagggtatgggctctagggaaagacaagatctgtgtttgaatcctagatgtgttatttactagctgtatgagccttggacacaaaccccatgagcctcagtttgctcgtctgaaaaatggagatgacaattacacctacctaattggtgtggtgtgaaagtcaaattagtgctatgcatgtaaagtacagtgtctggcttgtaataaataagcagtaattataaactactggacctcaagtgaaaaagcctttggcagtagccctagtaagagctttagtgtagatgttgtttgaacaaaggttctgcgaggcaaatgtgcgaagcaaactaaaccttcctttgcaagacaggaataatagttctcagaaatgagaggcaaatgttctgtctttaaatagaaattatgactgttttgtaactgatgggctctatgagtgtgtcaagagcacatgctttgtggttagatagacaaagatacgcattccagatctctggcttagtaacccaaagctttgcttctttaggattagggaaaataagcataactatttcagaagattcctttggatagtaaaaataaggtgcttagctcaattgcccaataaatagttggtccttactgacaagtcaataccatgcctgcagcagctatcacaggtggcatagccatggcctagtaaatcccagatttatctctcagtcatctttctgtccttccattttcccattctctcatccttcatttcttcactcatttcatccttctatccttccttcgtccagtcttcccaatctaccatcctttcattcttctatctgttcatccatttatccttcaatcctcccttcttcacattccctttccacatatccttccctccatcttccatccttccaacctttcatctgtttattcattcatgcttccatccttctactcttgcatgccgacctcctcaggatttttgactagattcacacagaggcttcacactaagattctggaggcacacgtgtcttcaaggtgacttaggggacactggaaaggctggctatctataaagagtaaggaaggaacgctagccatgacagctcatcttaaatcagagaagcttctgatttgaagaaggaaagaattctttgaaaccttaggactacattatccccaagcgtccttggagctgtgttcagtctgtgcatgctgggatggtgcaatagtcactgtgtggactgacgtgctgttgtccttgccatccctgctgtaaatatttaattaatcgatttaggatctggaatcttattcaggaggctgaaatgaattcttctagacctaataaagttcttaagcaaaattatctccttgctatttggaataattcaaggtacaacaagacaattagtagcatgaaataaaatggttatttactccattgaaaggttggttaactcaatgtcaagtctgttgtgctgtgtgtatagctgtaatttcccatggtaaacttatgtgtttaattatagggtcaccaatcatgagaatgccagttaattgcaaaatcttaaagtatgtattaaacttacatgctatttctaattgagctttgatttatttaacatgatatgattgtagttacttttatcagccaccatattattattacttttgttttttatcgttttcaaaatactttctattatacaagtatccctggctctcagaatgatgttttgcagaaaaaatctctgtcagaagagaaaactgaaactcagggacttatgtaaggttttgtggccaacacatggcaaagtccaggctggaacctggtagttaaaagggttgagtattagccacacacacagggaaaggagagcaagtggcctgaggaaaggagacactcaggacgtccactgaaggtcaacatagagcaaagctttgctatggctccagatatgtcaccttcaagacaccccagctagtctctatgtctcagagcactaatctactatgatggttcatttaagatgtcagcttgatggggccacgggatcccagatatttggaaatattctttctgagtgcttctgttagggtgtttctggatgagattaatatttgaatcagtagactgagtaaagcagatagccttccctaatgtggataggtctcattctgtccattgaaggtctgagtagaataaaacactaagagagaattccttctgtccacctaactgtcttcaagctaggtcactggtctcctgcctgcagacttggactggatagaactccatcagctctcttggtcctcaggtctttggactcagatgaaaactacaccactggttttcctgggtctccagtttgctgactacagatgttggacttctccacctctataactataccagctgatttcttatagtaaatcaatttctctgtctgtttctacatgtctctctctctctctctctctttccttctctctttctcttcacacacacacacccacccccccaccccccgacacacacacaaacacacacacatgtcctttggtatctgcagggtgttgattccaaaacccccatggatattaaaatccacacatgctcaagtccgttatataaaatggtgtcatatttgcatataacctgtgcgtatcctcccatatgctttaaatcatttctagattacttataatacctaatacaatgcaaatgctatataaataattgttatactatagttttaataaataatgacaagacaaaaaggctatacatgtccagtgcagacacaactatctgtttttttccttccaaatattttctatttgcagttggcagaatccacagatgcacagctcacagatacagagaattcacagatacatacacccttggttctgtttctttggagaacccagactaacacatttactatgtattaacccagactaacacatttactatggtactttctactataatccttttgtagtttcaacacaatagttgtttggccttaaagcatactttataacagtaacaattaatatttgtatggatttttaatcttctattatgtgtattttcacatctaatccttttaaaagcctgcataacaaggcatttattaccatctcaatttactgatgaggaactccaggctaaaagaaatgaagtaagggctgggtgcagtggctcatgcctgtaatcctggcactttgggaggcagaagcgggtggatcagttgaggtcaggtgttcaagaccagcatggccaacattgtaaaaccatgtctctaccacaaatacaaaaattagctgggcatggtggccatgtgcctgtagtcccagttattctactcgggaggctgaggaaggagaatttcttgaacctggaaggcagaggttgcagtgagccgagatcgcgccactgcactcaagcctgggcaacagagccagcttccgtctcaaataaaaaataagaaataaaaataaaattaaaaaaaaaagaaagaaagaaaagaaatgaaatggggtaaggtgccataggtcacatctagataaggttacaggtggcgtgtggctgagcagggctcagcctgtgcttacccactctggagctgcctctttagagcagggccctctgcatttgacagtgaaggcaaatgtgctcagcaagatggcattgaagcttaagccctcgatcttttctctatcaaattctgcgatgtttctggttttaaaagaccattccaaatttaataatttgaaatgtgctattaaagaacagtcttttcagttgtgttgctttagaatggactgcattttaaaatgtgcctttttattcaactgctttctacttattgctcaccatttattcatgatatgttggcaaagtactgaatcttagtaatttatattttcagacagaggctggagattgcctttaacaaattaaacattatactaatgcatgcaggcagccactgtttgaatgaattgggagaacaagaatacctatttattattattttctttctagattcctgtatcagagtttaaattgtttcagagcaagaaatcacgaagtacattacttatgtatcctttttcctttttgtttacatgcataaaatttagatgggaacacacacacacacacacacacacacacacacacacccttcagggaactatgctaaaataagactcagaaaccaagagaaaattactttactgctgcagcctcctgcctgctctccctctctcccctacagagagaaacactatcatacattttatcttaattatccccattttctttgctctctttcccccacaggaaatatatgcatctctaagcagtctatagtttggttttaggaggtttggggctttgtctaaagaaaccatactgtgtgcactattttgtaacttcgttttttatccaacctgttttgaagattcttctccacatgtgtcatatacacaatttgccctagaaatgaacattttaaaaattgattagtaggggaatcatccacttccaactaaatgggcaatcaatattgcttggaaaattacctaaggagataaaagctccaattatccctagttgaacaaaagcctttgacagagcactgaggttatgggcaatcttggcttcaaccttcacttttgtgagttgaaatcctctgtgtaatggcttcagccttttgaagtcccactccacctgtctatgctgtacatgacagttattcctctccacactacctaaatgaaaggtagacacttgtgccagacaaacagaatcaataagatgtgtatgtgtacacacacacacacacacacacacacacacacacagagtcaggagtcagagagatttattataaagaattggcttatgtgattacagaggctggcaagtccaaatccgcagtgtggttggcaggctggagacccaggggagctgcttgtgcagatgaagtcccaaggccatctgctgaagattccctctggttcaagggatcagtctttagttctattcatgccttcaactgattggaggagacccactcacattatggagggcaacctacttactcaatgtctaccaatttaattgtgaattttatcccaaacaccctccaaattgatgcataaaattaaccatcacaatgctgaagaccagaaattcagagttttgaaatgtctacctgaaattatttctgctctataaatgtagatcacatttgtgacagcttctctgatgagtcttctatgtctttatgttctcttattgatattttgtgaactatcttaatgcctgacgtgtaccacattgttactgttattactttatcctttccttcaggtagattaacttcaggtcaggtaatgagtctcattcactttcccatctctgggacctcatactgtgcatagcacagaacaagtacgcagtaagtacttgctgaatgcaaaccaacacagtcttgataaatcacactcatttcaatattaaggtataataataataaatagaagtaagcctctttaatagaacattgtgaaagaaaaggctattttctttgcttttgctttctggtattaagatcgtgactctaagtgtctggaatgatccagccattcagaatatatctatgaataacagcactagactggaaggttctctaaagtacatctttataaaaagggtaaaaggattttcactcttgactgaaatcaaatagaactctatgtgctttgcttaccagttaacttaggcagagctccagaccactacacatgctccaccgtgacattcttgttctagccccgacttcttatgggattagtaataaccacagtgacaaaaaagatgaaacttatcctcatctggtcctttttttttctggaatctgctcattcaccctcaactagaacttaattcatggctctgggatgtctacttctggttaacaatccttacaacgatttgcagaaagtttgcagagtgtgcttgaccattttaagcagcatacaattggtaattgttatttctggaggctaaatagtcccctccactgtagcttctgccattccaatcatcttccacagaagccattctgagcatgtcggggcttctaccagttcactctggaagtggatttggtctcattactctctgtctaattttagcactctatgtttgcagcagtctctgattcatatacatctttctgcattagccatgaatagcacaggagcatttgaaaacatgctgggtgtggagaaccaactcttcaatgtgtgaacatgcacagttctttgtgtgatttaatttaatcttgtgagatagggtaacttatccacattgtgcagatgaggaaaataatctaagaatggctcacattataaaattcataaatggttctgccaaaattaaaacccagatccatgtctagaggacatgctttccccttttcaactctcctccagatatatgagcaccagaagctctggtgtgtctgctccttatctggaccctgaaggcaggtgaggaagatggtgattaagagactacttagaatggttttcctgacgcttcgccttccttgtcattctgacctccaccactgtctttaccaagcacacagtgaaccacctttagccatggataaggacccagtgctaagggctgaactgggaagacctctgtcatagtgcctcccgtataccccagaaatcatgactccatgcaatgactcccaatgggaaacctctaaacactcagcttgaatgcaggccaggccagaagttctggggactacccagctccacacctcagaaacagccctcagccaaagggctgaccacatatctctctgttagattggtctggttccaatcaagtcacaaaagcacactgtggaacaatggaaattcactcattcaaatctgaccaaagagaaattgcaagagataaggacactctataacatactgggaaagcagaagagtaaggaggatgaacaaatttggagatagccccttccccaaagcaaggattctaacctcactagagaaggtacagttgcaccccagtgataagcaaacctctcaggtttcctcagccagagttgatccacagtcagtgagcaagcaggaagcagcatcctagggcacaggccaggtatgtggtggtgtgcagagggcatggggtgccctggtgggcaggaggcctgaggttgtgtgttcatgttgagggagccacaggaaggtgatcagctggctggactggagctataaggtcacaaatgcaccatgcattctgcacatgtggccagagcagagccccaccaatgtcctcacacctatgcttctgagtggccatgcagcactgccaacaagaagggagctccctgatcctgcagtgtcccttgcagaaccctctactgagaaatctcaggatctgtcatgctcaatataaaggaggaaggcatacaggaatttcatctattattgcagtgtgagtattgaagggtgaattttgacttgagaggatgacccatgggttagagtgactctgaggtatactttgcaatgcctctcagagtctaccagtatgttaaaacccagttgtccatagatcaaattcgcatctttcatgggcttccttctatttatttttcacctccacatttcgtgacgtttgtttcctgggacagcttctatgcacattcttatctcttcatgtggttctagaaaaacacaaccttagcagaaaaatcaagcagagagttcaagaatgagtgatatatcatgagtttttactatgatgagtgtatgaggtcatcctgaacaagtaagaagcaagtaaaagacacacattgggatgaaaaaaatgggattcacataataattgtataacactgaaaaattatatgagctttgagtaggtcacttgcaatatgcagaaagcaactcaaagggctgctgagaggattaaatgaaattatgaatgaagagatgttagaatgcttacaagaaaacctttaccttcaatcaaactttcattggcccaagccaatgtgcatggtttcaaccataaagataaagaatgatattatcagtgtttgggactaaaatgggcaaagtgtcttggcgatcacaagtttagagtcagtacatttggaggaaagttagagaaagctaactcaaacttgagagggagagagagatagagaaagagatcacaaacttgttgacccacaatactgtaaagtccagcagtaatggcttcaggtacacatggatcaagatgcttcggaaggcctttactctaaatttttgcttacttttcaaatggcttcattttaaattcaggttcttccttcatgagagcccaacatctccaggtggatatttgatatattttcttcgtatttagttttaagagatttgattattacgtgaatttcttttggttcattttgtttgagaatgactcaactttttgaatttgtaggtttatgtcttttgccaaatttgggagtttcaactattattcctttgatttattttcagcacagcactaattatccttttcttctaaaactttgatggtatgattgttagacctttatgttattgcctggcagatccctgagactctgctaatttatttttcatctcttttgtttagattagattatttctattgatctgctgtgccttatgctctcctctgtcatctctaatcacctagttagccaattcattgatttattgcattctcttactgtaatttttagttttaacatttttagttatctcttgtatttactatgactttttatgttttgatttgttttaagggtgttcatgattacttgttggagcatttgtgtgaaaggtgctttcaagttcttatcagataattctcacattagtgtcatcctgatgtgagcatgtgtcttactgaagttgacatttaacacattcttgatatgctgtgcaatttaggatttttttggggggggacgttacattatgttacagaactagtttctgttaaaatagtttgttttatcaagcactcaatccatataggctaaggacattttgtagtctatggcttaaatgagaaattagttttcaaagccttgcagtgttattctgctgttcctattgatatgcagcccagtgacaagtctgaaacctggactattccatgctgcagctcagtgtcttaagctttcagtgtgagaaatatagagtgttcaggaaggacttcagatacacacttaaagaaccactttctctggctttctcttcttttctccttttactctacttggctgagaaagtggcactctgctggattttgtctaatatagggcaggggtaatagtaagtatttggccccacatgtctctggctacagtataagtggagaaggtaggtcaccctctgcttatctttgctaaatgcaaggtgacaatagttgagaggtctctgattgttcttagctactgagtcagtggggagaaacagcacttcttgcatggcattcaactggtatatagtaggtataatctacagggttccatcctgtaggtccacactctactagagcttctggcaaaaatgaaggttttgtggggagtttttgttctgtgtattttttggaagttctgagttgtaaattcttctagcatccaggttgggatatacatatagcaaatgggcacaaaacaaccaaacaaacaagcaagcaaaaaacacatgagtaaacaaaaaaaatccatggggaattactgcatttgctcctggaatcctgaggtcttacttcctttctttgtagttcagcattttcccatagttgctacattgattttgtccagagtttctagttgtaattagtgggagatgtaggagagagtgtgcttgttgcatcttagccaaatctagaaatacctagttttacattatatttcaatgacagaaatagaaattatgtatgtgtcaggtatacttgtatccaaccaaactatcattggatagatagttccagttgtcttggatttagaatggtctggagccaattcagtttcacaattaaactgtagatgaattcttccacctgaatgatagatgtgatagattaaccagaaaaaacttgagagatacctgttcgttcacaagctacactttccagacctgtcatctatttctgctgcttttttttgacttagagatagaggaatagatccattgccgtaatataaaatgtactccagttttgctttttctctccttgtggttaaagggaccatagccagtacctttgccaataattagcaccctcaagctgcctgaatttatagaactgtagaatattagagatgaatgcaatcttcacaatcaactttatatttacttcaacctaatgtttctctctggaactgtattttccaacactgtagatacatttcaattacctaatagctacatggggccagtgggtattttattgaacaatattttcatccacatggaaactctactggaaagctatgatctagaaccttctttactgagttgccaggcagtagctgtcttacctgtaattgaatacatctctttcaaactttaatacttctattttagtagtatgaattttaactagatatagcagtccctgctcagagtaaatgcatttggaagatcaaaggctctcaagtcagaatgacctgggttcaaattatgtttagggatagaaaaatacgggatatgtcaatttactctattttaatgaatttcaaatttattatctgtaaaatagagagaacaaagcttcacacataaagttactgtgagaattaaataaaataagtgtgtaaaaacaattaggaaagttacatacctgattgcttctttcctatttttaatcacactgagctccttaaaacaaaaagaaaatcctaaagtgtatgatttttgtgtgtgtgtgccagaatgctgtatttagacatcattgttgcagaagtattatctccctcattctttaattataccattgctatttttggacccaggtgtaggattttatattcattcatgctgaattctgttctactccactaagcctattacttaagcctttgaaggactttccaatccacatatgagcagggattttctctcttcttaagcctcacataataaacacttagatgatagttttctattgctatgtccaaaaggtttatgcacatgttgaacaaaagatatagttgggccctgggtgtcttttaactaaatcctgttgaccccagctcaaagtgtgctctcattactttgtattctcctgtttacacaagtagcaatccgaatccaaacaatatgaagtcttcacagagatatctctttctaataataggcaagggttgtgtaccagtagatttagtgctagtttttacttgttatatggaataatggccccattaaaaatgtccatgtcctaatctctggaacctatgaatatgttcacttacagagtaaaaggaactttgcagatggttattttaaggatactgagatggggagattatcctgggatatctgggtgggcaaagggtctttataaataaaagagaacagcagagagtcagagagaaattctaagatgctgtgctgctttctttgaagatggaagaaagtgccatgagctaaggaatgcaggtagcctctagaagtgggaaaagacaggatagggattatctcccagagtttccaaaaggaacacagccctacggcaacttcattttagtcctgtgaaatagagagtaaatttgtattgtgttaagccatggagtttttgataatttgttacagcagcaaaaggaaacaaataccttatattcagaaaattttcatttcaccacgatctgatctgttgagacagattcctccactgttgttgctagtgctagctgccatctgcagactgtattatgcaacagttctctggcagagactttaaacagattatgtcatttaattttcacaagaaatctataagccaaagtcatttttctaagtttatttatttgttttatttttttcgagatggtgtcttgctctgctgcccaggctggagtgcagtggcacaatcttgggtcattgcaacctccacctccggggttcaagtgattctcctgcctcagcctcccaagtagctgggattaaaggtgtgtgccagcacacctggctaattttttttgcatttttagtagagacaggatttcaccatgttggtcaggctggtctcgaactcctgagctcaagcgatccacccaccttggcctcccaaagtgctgggattacaggcatgaggcaccgtgcccggcctctaagtttaaataaaagaaacctaaggttcagagagtcaggaatatatctagtgcttcagaagcaggagtcctggcaacttctccctggctctctgtatctcagagtttaaagagcggtactggaaagaaccttgaacatttgcttttcctgcattttttttttaacctaagactctaattttgttatctcattataaagtagtgacaatataactgccctatttatgtcacaaagggatgctatgacataaaattggggaaaagtatttagaaatgcttaattttataaaacactttacatatgtattttattttcgttgcaatttaaggaattattagtattattttaatcccatattttcacagaatttccaagaggctaagcttcacaaatgttacatagcaatcataaaaagagcaatatttgtgtatcccaattatgcatattgggaaattagtaccattttggaattaatgaaatactagattgcccaattaaggtgagtgttaaattcatctaacgagcattgtctgtgcattcaattgttccccaatgaacatacgatttcactggaatagttacagttattaaacagaaaatttatagctatctctgagatgtttttgttaaaatcagtatgagagcgtccacctaattgcagctattatccctttctcaacttcatattgcagaacaccacatggctgcaatcaccttataaatggtgatgcttggagcattcattgtacatctcagcagaatttgttttctggtttttgtttttttcttctttccctttttaataaatagaaagaaagcacaaactttttgacctgatgactgaagtccttaagcaactgacaattttctcctaggagaaaattgaaaggtattccctttgtgtttttagctccgtttgagcaaatgctgcagcctggatgtgaatgtggaccaagatgagcaagttgcttgcaggtcagactggcttgtgtgaggatatgttggcactagagtcaacaatgcatcaaaaggagaggcacagatactgtggaggcagctaaaattggtaaaacctaaaattattctgctaatgaaacagtcttagcatggtaatagcaggaactataatagcaataaaaatagaaatgctttattttaaaacaatgggcatttaaaactgtttacttgaaaattggatagagatgtcttcaagaatgagtgatagtagatgaatatatgttttagagtcaaattcatctagattggtattttggatgcaccttggtatcgtcgattcttgacctgtgtttcttcatctgaaaatgattgtcatgccatttgctttaaagtgtagtaatgagatacaggagtgtaaaggatctgcgtggggcacacatgtaaactctgatagctattactactataactgatgttaacatgaaatatgggtggccaaagtggaagttataatgagccattgtctctaattagatcttcaaactggaaataaaactaatatcccgagtattgacttggggcatattgagattattttctattttatgcaaggagaatacatctacttagagcccagagcctgcctaactacagtctctgcagatctttgtggtaagccatgcttagttccaggcaaagctgggaaatagttaaattttgtgttgggctctttacagtctctgtggccctacccttacctccactcttactcatcattcttatcatctatccctattgtcttaggcacctctggctgctgtaacagaatactgcacattgactgggtggcttaaacaataggaatttaattctcacagttctggagattggaagcctaagatcaaggtgctggccaatctggtgtctgctgaggtctctctccttggcttgcagatgacctccttcttgttgtgtcctcacttggcccttctttggtgtatgtgggtaaagaggaaaggaggaagaaagctcgctggcgtttccttttgtaagggcactaatattatcatgcagtctccactgtcctggcttcatctgaacgtaatcactttctgaaggccccacctccaaataccatcacactggggattagggcttcaacctatggatatttgggtaacaaaattcagtccatggcacctattatttttaaaatgaaacaaaacaaataaaacctcacaagtttcctcatgtgctttactactaactctctcaacacatatttgttgatcatcagagccaggcaatgggctggaatctggaggctctggaaggactctggttgatatgtccaacctttgggaggtaagcagtctggcaggataaacaaagataaatcaattaataatagcaaattgagatagtctaataactatagattctagaaatgtcccctagaggctttcgactatggatctgacctactgaaaagattagagccaaagagtgacattttttattgagctctgaaggatgagaaagaggcatgtctagtacatttatggactcctctctaaaatttcaacttatatgttgaacacctactatgtgctaagatccaaagtcagcacagaaaaactgaatggtatatacattctgaccagaatgtttaagtttaaattgcagtatccattcacaattaaatgctaaaagctcttattcatggactgcatataagatacacacccattccatctgctagaatttaagtagctaaatattatctttggaaccatccaaaatcaccagttagctaaggtaccacgcataacatcatctggtcccttatggaaggggttttccccagtagcatctctgatacacatttaaggacattaagaaagataagcatagaaaacttgctctccccttcataagacttcacagaaagaacttttttgttcattcctttgtgttttagcacaaggaagctgctctttttctgtacaaatagttttgattttatagacattgaattccaattatatttccatctttgctttagccaaattggttgttaattttaaataatatttcaagatattatcacatgcatttttgtgtattaactttatgtaacatttggaatgtgtgtgctgataaactgtttcacttatagtaaagactaaggggaaggtgttaccttacacaagaagtgcagagaaagaagatggctctgatgctgattaattcagtggctcaacaaggatccactctttgcatctgtgtgtttcctcctctgaatgttggcttttgttattggagttcatctcatgggtgcaggatggttccatcacaaggagatgtgctcacattgaagggaaggagaggaacctacctagagatttgtcctcatgtctctggccaaactgcatcacatgctttttcattatccaataaccagcaaagaggaatgagattagcaacattgctctagatttaccagtattccccactctggaactggaggtctgctcccttcacacatgacagtggaggaagcaaatgaaacttagagtccagctagcaaagaaggttgaattgctgataagtacgtatcaaatttgtattatgcttacctgtgttttatatggatttttgtacccttatgtctttctttgatgcaatgctctcaactagtcattctattctatcctatgtgaatgtcccaatcatttattttaatgtaaagtggatgcataatcaaacaacaaaaaatagatattaaaacagtccatatactcatgtgataagccctacatttggtattaaagctatagatgtaaaaaaataaaaagaacaaaaagattagggctcaaggagataaaaaaatcaagaggcttttcttacgggcttgatacagaacgcagaggtgaggggagtgtactgccactctgagtctgacaggagaccctgtaggtagtgtttcttgcaactatggaggacattaacttgaaaaaagtattcacgagcggcaccacgagtttagaaacactattaggtagttaggtagttacggcaaatgtcagagtgcttgtcatgagtttaggttcaagcaagctgtgtttgtggtgtcctgttgaagaaatccaagaggcactcatgtgcatctatgaaagcatttcgaagttcagaaaaaaatgctttcataacgattatctcatttgttctttccaatcctgctaagctctacacattatatccataaagaaactgatgctctgaatggctgtgtgctttgttccacatcacactgctaacaagagtccaagaccttttagacatgatatcatttattgagtccaaagcctcagactaaaattttaaaattctacatccacaagacttcagttggataagaagatgctttggggtggagtaggtggaactgaactgagttctctgtttcttaatggatcatttgatgaagaagcctcacagcactttgttcatgtaatttacctgacttttgatctgtccatttacttgttcattcattcatttgttcactcatccaataagcattaaatgaacacaactatgctaggtactgtactgggtgtgttcagatacaaactacacaactcagaacagaagacatacatgagaaaaaagtatgtgttttgctgaggtgctgtttcaagggtgtctggaatttaggtccaattgttactagtctttttttgttccttagattctcagtatccacccccatcccaagtttgctacatatgatagaagatgacaaggcaaaagtattttgtcttgcattagaagcacattgcaagaaggagaatggaaggagaagatattcaacctttattttctagctctatgtgctagacagtcatttatatgttgccatataatcctcacaatatttgtgtgagtggacattattctactgcttggttgacttgataattggtactcagagaggtttagtaccttgcccaagtttgtattcatttgaagtaaatatatcagtatatattttataataaatataaaatataaaaagctaaagaacgtttttgttgataagtctgttggcttttcttaaacaaaacagagttaactcagaagatttataaactgagattaaaagtgactggggagattctaaaaaaaacaaaagaaaatattctaaagcgtaaaggaagcatttaagtggatctctagacagaaacacatgctgtttctcttgtgtcaccggaggagatcatggtgaagaaggaaattggaacaacagctgaaaatgttgagggtgaggatagtaaagctgtgggggacatgaaataaagttgcctggaatgcacttgcttcaaaggtctctgccacctggtctcttatgtatgcattctcctgactgatttccccgtcggtgagccagaacgtcaggcaatttgacaaaatgagagccttcaagtctttggtatcagattgaactttcttaaatgttataatagaaaaactattaggtgggtaggtagttacagccaatgttgcagagggcttgtccagtttcactaaaggtccaaaaaattggtaagttactagcagaatggctatttaggagggagaggtatagagaactccacagttaattcagtgcctgtttcagggcctttctgcttaactagaaactgaactcccaccctccccatctcccactttgcagagaagactgaaatcttgtggcttatccttcttcagttttattccttgccaacaaaaaaatggtgcaacaatttaaatccagcactaatcagtcaggtaccataacttgaagtgggtcaaacagtcccctggatgctattgtgcagaatgatcacttcctaccaccatcccaaactccaaaccctgtggcttgtcccttgcttgtttctgctcaccggataacttggactgggacattcttgcttggtgctgttggggacatttggcttacctgagtagataagtaggtgcatgcttcagccaatgcaacatatttcagtatcctgtccacactcatagttttgttcatatgagccatcattgctttacttctgtaatgaagggatcttgacagaaattaaaaaaaatacttatgttaaagtctaaccttactagaatgttattgaatatattttaagggatatttaacacatggtaagtcagaaaccatgtaaaaatgagccatattataagaggttctaatacatgtctcatcaatcttaaaaagaaaatggtcacaccaattaaaaacaaaatagacatccatcctctttctcctgtgacagaatttaggttcttttcctcagcctataaaacatccagggcttctccattcaagaaatgctatacattttccagctaccttactgtttcttatgctctcacttaccaaaattagttaaaaagtcgtccatatttctggtttcctatcctcatcacacattcaccttcatttcttagtgatcagcctgctgtctactgaaactatacacaagagtcaccgggatcactctggtttttcatttaatgggctgcttctcaactttctctctctgtacctctggcaggaaagatgcttttcctgaaacatattttctagggagtggttaaagctttttattttgagtctgggttgggaaatttggctccactgctttctaaaactgtgagcttaggtaggttattatgaatttgtaaacctcagtttcccttctgtatacaaagcgttactaattcctacttcaaaatgttcgtgagaagattacagaaggtaaggcatgtaaagcatttagtgagatcctggctcagagtaaacattccatgaatgttagcttttgcagccagcttccttttgtttccctttgattgctgtctttaggttcttcgtctaccactctatttttttttattatactttaagttctagggtacatgtgcgcaacgtgcaggtttgttacatatgtatacctgtgccatgttgctgtgctgtacccgttaactcgtcatttacattaggtatatctcctaatgctatccctctccctgaccccaccccacgacaggcctgggtgtgtcatgttccccaccctgtgtccaagtgttctcattgttcaattcccacctatgagtgagaacatgtggtgtttggttttctgtccttgtgatagtttgctcagaataactccatcgcattagttctcctctccctgggggcttctaagtaaatattctataaaagttacttcttcagctcacttttctctgtgtccacatgttttcctttgatgacataattattcccattgccactgtcaatgcatctatactcttaactcccaaatcctcatctctattttaagaatgagcctcctgcatccaattcttcacttaccgtcacattgaaatgtctgtaggactgttcagattcatcacaagaaaatcttacctcacctctcactttctaaactgctctgcgctcccagcatcatccccccagaagcccagaacacacccagcagcagcttcacaccccgccacccccatttcccaagggaatcagccactaagtctcttctcggcttcctcacctcaacactttttccatatccttacttttttttttgagattgagtcttgctctgtcacccaggctgaagtgcaatggcacgatctcggctcaattcaacctccgcctcctgtattcaagcgattctcttgtctcaacctccagagtagttgggattacaggaacccaccatcatgcccagctaatttttgtagagacagggtttcaccgtgttggccaggctggtcttgaactcctgacctcaggtgatcagcccgcctcggcctcccaaagtgctggaattaccaggcgtgagccaccgtgcccggccccgtatccttactttttcctacatcatcattttctatctcagtatctcatcatttcttgccttatctctagtaataatgttgaaagtatttctcctgctttagcctctgcctctccttcacattttcacatgaactgcctttcacgttgtagttttcatcatcttgctcctctgtgtggtaactggggaaacctcccctaggctacaaataagggccagattccaatatccaattagttggtataaattgaatttcccagcttctaatttaaaaatgttctccctgccactgtccctgggctttgactaccacagtctagtctccatgtcctgaaaagtttcccacctccacctcttctgccctaatgcatattccccccattcaggtctctttctctgaaatgctctttctccagcctcatcctatctctgtcctcagagatccttcaagtcctacaaaaattcttgctcttccaagaagttgtccagaaagaaaatagtgtagccctttatctgctccctggacacctggttttgtcatgccattacaatggcttcaccctcgttatcaatgtgcatgtatgtctgtgccattcattccttcaagtcagagaccacatcattttgaatttctatctttcctcagtggcatgaatatattaaaaatgcaatggatacttattttattgaattattgactgtttagaaattacaaaaccaaaccaacatatcacattagtgttgtgaatatagaattaattaattaattatttttgagacggagtcttgctctgtcgcccaggctggagtgcagtggcgtgatctcagctcactgcaagctccgcctcctcggttcacgccattctcctgcctcagcctccggagtagctgggaactacaggcgcccgccaccacgcccgactaattttttgtatttttagtagagacggggtttcaccgtgttagccaggttggtctagatcacctgacttcgtgatccgcctgcctcggcctcccaaagtgctgaaattacaggcgtgagccacagcgcccagcctattaatttattttttaaatcatgattgagaacagatcatgtgacaaatgttagacattcaaagaaaaatgtaatttttctctttgtgctggatagtatcccagtctttagacaagtggttctcaaactttgtcatgccttagaaccacatgagagcttgtcaaaaactccagagtttccgagttggtggatcatggctgatactagagaatttacgtctctacaagttcccaggaggtgccaatgctgctagtccagagatcacactttgaggaccatggtcctagataatgagtccagaattgacttcactactcttggttcaggtggagtcacttcattgtctgaatctcacttttctcttatataaaaggtattcactgggcaaaataataacttgcccagctctagtattctacattgatttgtgtaatgcatttttaatgaataaataaaatctagagattctggaacttttgacatttctttcaatactggtataagaatgggacatgagttattttcatatcttggattgtagattgatttcccctagatatattttaggaaatctagattatgtttcaaggccaaagtacagtcatctccaccttgctttgaaatagaatcttctgttaacagacatgggtgacttagttaagtggtagttgtttcgaaagaattctaatatggataaaatctgtcttatttttgcatttgtctaggctgaatctggaacaaggaattcacaggctatgcgctctggaccataatttgaacagcatcacctagaaagtaattattagaaatatttgcggaagagaaccagggaacagatagaatttatggtaaattgtctgataagtgtttaatgttgtattttgggtattatgagcctaatttttgtccaggaggcatgagatctggctaaatggagccttattatcttcactaggtaacccagacctttaccttagaagcaaagcagagcaggaaatagcaggtgttttgtggctgcacttcacttctgccatcatgttcatgcgttgctttcatctgagaatttggccaaaaatgaaaagaaagcaaagcaaaagatatacagcccacaggccaatctgtttagattcccagaatttggcagggcctcccagactgagtctttcattgaggagatgatcgatggcaataaaattcacacagtgaagacacagcttcatgctataaagagtcaagctggaatagagaagtcttattagattctcagtctctctttctttcatcagtcttaaagatacaactaattgctatagaaagcctagtcaacatatggggttgctgtctatgtgtcaatgttctttactcttagaacaccacagacacttgtagttgaacaagctgagttttttgcttgatgcaacaagaaagaacacacaccatgagacatctcaataaaggatagaggaaaggacttataggatttgggcttccgttagataacatttggtagggttaaaaaatagacctctattctggagtgggtgctgttgggaagtagtaaaattcaatgattaataacttaatatttcttatctatatgattgaatgagtctagcctaaagctctgataggtaaagaagcagcagacacatcactcataatagccaaagtatggggctacttggccatttttgtgattaggaaaatgttcataattttatctatgttctaacatgattgtgaagttttcctatatttttcatgttctattacattcacactctggctgggtctgttgtcggtatactatgaaactgtatatgctcagcaggaaaataccaaatcctagatggcagtaccaggctggctcctgaatgccagcaacagctttattctttcttaaatctgaaacactagctgtgcttactatgaggaaatatatgtctacaattaattccatcttcccaaagtttatatccaaaataaaaagcatactatattgtgctaaggagattttttttcttcttgttcttcaaagcaaaatatagtttcacaggtaaaaagatccttagaaatcatctagtaatctaatcctatgttgatcagagctctccacagaaacaaaaccaataggatgcttgtgtgtgtatgtgtgtgtgtgtaaatgtgatttatttattttttttgtaagggatttgttctgacaattatggagtgtgaaaacccaaagatttataggcagcaagctggaagcccaagagagccaaggctgtaagtttctactctgaatctcaagacctgagaaccaggagtggcaatggtgtaagttctagtctgaaaactgggaggctggagatctaaaaagtattcatgttttagtacaagtctgaaggcagaaaaaagacttaagttttagctcacccagtcaggcagaaagaggtcccctcttaataagattagttctattcaggtcttcagctgattgaatgaggcacaccatattgtgggagccaatctgctttactcagatgcaaatattaatgtcattcagaaacaccctcacagacacacttagaagaatggttgaccaaatggttggacatcctatgatccagtcaggtggatacataaaattgactattaaaggcaggatatggtggttcatgcctgtaatgtgaacactttgggaagtcaaggtaggaggattgcttgaggcaaggagttagagactagcctggacaacatagcaagactccatctctacaaaaagtaaaaacaattagctggctgtggtgacacaaacttgtagtcctagctacttgggaggatgaggcagaaggattgttggagcataggagttcaaggctgcagtgagctatgatcacactactgcactaaaacctatgcaacagaataagaccctgtctctaaagtaaaattaaattttaaaaaagaactgtcacaaagcccagttgggaaacaactaaaagtagtagtttagaaatcagggctccgtgtacggttttctggatctttagagagtaatcatctcactagtgcactgttgttactgcacagaaagtttgtagagaaaattgacctgcttagaatcaaagtttaacattccattccaaattgagaaatgttgacaaaaagaatcaaaatttgtaaaatatttcaagagattgactctgagccaaatatgaggaccatgacctgtgacacagccccaggagatcctgagaacatgtggccaagctgattgggctacaggttggtttgcacattttaaggagatataggacatcaatcaacacatgtaagatatacattggttccgtctagaaaggcaaggctactcaaagtggtggtgggggtggggaagggggcatccaggtcataggtggagttaaagattttctggttggcaattggttgaaatagttaggctaaggacctggaatcaatagaaaggagtgtctgggttaaggtaaggggttgtggagactgaggttttcatcatgaaaatgaagcctccagttagcaggcttcagagagaatagattgtaaatgtttcttatcagacctaaaaatatgctagactctttaattctttcccggatcagggaaaagacctagaaagagaaggggattctccacagaatgttgattttccccacaagagatagctttgcaggaccatttcaaaatatgtcaaagaaatatattttggggtaaaataatttctttcagggcctgctatctgtcaagagtgtgttttgtaagccctacggtctctgttttaatgttaatgctggtcagttgtgcctgaattccaaaggaaggagggtatagtgaggcctctactagtttttcaggttaactttggaatgcctgtggccaagaatgggggttcattcagttggtcagggggcttagatttttattttttggtttacagaaaccagtcgcaactgctcactctctgttcttaacaagtatatctactctgaggaagttcaagagatggcattacatagacaaacttatacctctaggcaatgagattttaaatatttttcaagtttattaaatatctgagttttgagagatttaacctgagccccattctgattcttaggcattggatcttgcagattgttggcaaccagttgggacaaatagtagacaatagaattaaaactgggttcaagacagtgctgaccagggtggcagtgaaactgatataggtgtaagagaatgagtcaggagaaagagactcagaccaaacagaaggctctcttaagagaaacagggcaattaaactttaatcctggcttcacattcccgatacaagctgtgccctgggaaacacaggtaacatttctaccagaggctaagaagggatcagagcaggcacatgataagggtgttggagttatcaaagtatgaattttaaaaacccatgcacaatggctaatctgacaagaactttgatgaaaaaaagtacacaatatacaagaacagatggataatgtaagtagggtgatgaaaattccaataaaaaggacattctagagatcagcagcactacaacagaaatgaagaatgcctgtgtctctgagcttgaggatatgactatacagcctttgaaagtcatatgtgactctagttctgatgtttgttcactttcttcaaactgtgtattttgccttttagtatgcccggtaattttttgttgaaaggcagacacaatgcagtgagtaaaaggaagtgcagtaaatagacctttattgatgtggtggtaaggttagggggtgggggaacattctatagttctatgggtaggtctcagtcttttggtgagcctgtgcctctggacttggacttcaccagtgcttctcagtgtgttggctccccttccccttaagtggtacaggatggctactgcaggcaggacttgggtatttcccccgtcccatgtggaagggtaatgctggctgaagttgggtattcgcctttccccaggtcagttaggctctgataaaaccccagaagattaggctctggttgactagtttctccagagggtagacattattaagaagagtgggacacggtggttcatgcctgtaatcccagcactttgggaggctgaggcaggcagatcacgagatcaggagatagagatcatcctggctaacatggtgaaacctcatctctacaaaaaattagcctggcgtggtggtgggcacctgtagtcccagctactcaggaggctgaggcaggagtatcagcttgaacccgggaggtggagcttgcagtgagccgagattgtgccactgcactccagcctgggtgacagagcaagactccatctcaaaaaaaaaaaaaaaaaaaaagaagaagaacaggatgctctggcatatttccaaaagggtcctcctctcctcccgcttttggaaacacaaggcaatttctctccactattcactatgaggtctagggagtaaatctcaaaaaagcatgggggtccccccaggactgggctcccctggagtttttgtctctcagtcttgatcccactgaactttcagcaattcatcaattacagttcaggtttctccgcatcaacagtggttccccagggtgtttctgcttgtgggcttctgctgtggttaacttatgattcactgtatccctttgtctgtctctccaattctggggcgggcagcagtttgccttatgatctcacttcagtgctgtatctataaagagctgttgatttttcagtttgtttagctttttacttgttagaatgaaatgacagcttccaagcctgttacctgacagaccagaaaccagatgttgttgtcttgtcatatttaattgtgttccataaattgtgtatttgaaaagttgtttgtaaaaaaataactgcaaaactaggatgatgctgtattttttcaaagagcatttggttttcttttgtcaggtacttgtacaaaattgcaatgttattactgcagtccactttcaggaagtgaggtgattaaaagttaaggactttcacttatggttccaacccaaagagtgaaaggttcacgaggggtttttccactagggatcctgaaaggcttcaaatgtttcccctagactttcaaggctgtgaattcaccattcaaccatttgtcttctcaggcaccctaatgacacagggaaaagcaattccagatgcaggatttggaattgtatcttccttctcctgtgtttgagttggctatttctcaaataccttcaataaaatttctgagacatattttttcaagcagctttgtaaatcctcattaggacagttgatccgtatcatctggtataccattacctcaaagccatgcatgtttaaattgtgtttgcccatccacttgatccactgaattcgtgctctgtcagacgccatgtcctgctcatgtttatttccagagtctagcacacttcctggagttctgcgtgcacgtcacacatgtattaaaataaagagtgatgaaaagaagcaaggaaaaaaagagacagtagccatcaatcatttcctaggaggctaacaggcaattgtttcccataataacccaaagtgaatatgattctttttcctgagtaattccaggtctacccatctaacactgcctctgaaccaaatctttccttgccttatagatactgcttatcactacctatacatatgtatctatctttagaaacatctctgatcttcacagcttacatagttgccaattacgtgcccaaggtttgagatttatttatgatctataattaattctgtaaaaagaagtcaggtgtttaaaacctgaaaaatctttaattttcacataattccatgcttggatcatgttaataatatatttataatacttttagagtgaagcgtgtcaaaataattaactgaacgattgtactttgtggtacaggtgtgaaaattgaatagatgtcctttgatagactgtatttcataggtgaaagaaaaaattatctattttttcattaaaatatcacaattttcctgctctttgtttagtggctgttaaacttctatgtcataataactctttttttgatttacctcttctattttgtggtatcatttccccttcaaaacccaagagtgttcattataccctgtggcaaaggaaagttttctcagtaagcaacagcagttaaaagtatatagtttaagttgttgaaataaggtttaaattcatgatttaatcaatagagagggtacaggtaacatggttatgtttgcagcatttctgacttaatcactgagttaaaatggctctgctcttttaaaaccatacttcaaaaaatacccttaggtctttaaagattctaagacatgaagctcataaacttttcattttctagaatcaagaggagcctccagcatactttgactgataggtttctacatttcaagtacccatttggtacctaattcactcctggccatcagactcccctcccgtaacactgtcaggcacacgtgaaaaactactgcttcagaaagttacaggcagagggcagatgaatttaactgtttcctaccactatcattgccaagtgagaatctaggtccatacctaacagcatcatgacaaatatgagaccacatgcatgctccatttatccaacaagggtgcacaggatatctacctgtgctcatgaaaaagatcaacataaacctgcccacatagaaattatcatctaatacaggaacccagaaaaaagcccaacacaaaagcgtaaaaattagtagataaagaggctacgaaaaggttccccgaggtggtgacaattgagatgggattgagaagatcaattagaggtaaccatgtgaagaaactggtgatggagacaatggcttggatgcagcagttagagcaacagacagaaaagcaatgtggctagaaagggatggaagatgaggccagtggggctgaacgcacccagatcaggtggtcttgtagaactaggaagtccaggtttgattttaagagcaatgggaagcttatgaagttttaaaatcgaggatgctgcttacctttttaaaagttctctgttgtgtgaggagaaggttttataggaggatataagtagaggggtgcagcagtggcctggggaagtggtcatggttatttgggctagaatgatgtgatggtttattttacttttatgtgtctacctggctggatcattcagccaggtatttggtcaaacatctgtctagatgtgtctgtgaaggtatgtttttagatgagcttaacttgtttttatttttattttttaagagacaatatctcactctgttgcctaggctggagtgtgctggtgtgatcacagttcattgtagcctccaacccctgggatcaagtgatcctcctcccttagccttccaagtagctaggactaaaagagcatgccaccatgcctggctacttatttatttttttatagagacacggtcttgctatgctgcccaggcttgtgtcaaactcctgtgcagttagcatttaaatcagtagacttggagtaaacagattgccctccataatgtcagcaggacttactcaatcaattgaatttcctaagagaaaaagactgccttctctgaaggagagagaattctgtcaggagactgccttcgggctctaactgcaactcttccttgagtctccagcctgctggcctatcctggagattttggacttgccagtcccatagtcttttaaaatcgttctctctgtgtctttgtgtgtgtgtgtctctgtgtgtgtgtgtgcatgcatgtgtgtatgtgtatctgtatctatatctatatctatatctatatctatatctgtatctatatctatatcttagatacatagatatcttctattgattctacttctctggagaactctgactaatataactaattacagagacatgcagagaaaagggtatattcttcaagaggttcagggattaggaacacagatatttgctgacatattgccagtgggggatctgaaaaagagagaaagtgaccttagctccaaaattcgggcctgagcaagtgaaattcagtggtgccatttgccaagctgaggaagaaagaggagagccagagtgtgcaatgcggtttcagggaagaattaaagaatgctgtcctgcacatgctgagtttaaaatgctgatcattccatatccaaatgcatatatctagtggccaatggtatgcatggattaatgtataaaaggcatcccggggctttagaaagagcatagactttgacattcattatcatgggttcaaatttcagctttgccaatttacagtatctgaatagattacttataccttttgatgcagattccctttttacatttgagataaaaataacatccacgtcacagagtttttttgagataacgtattgcaaaaacattgtatcttagcatagaaagatttaaaatgccacataaatgtattatgtgctcacaagaatatttgatttgatggaaaataaatgcctgagacaatgctgttggttgtcttcctcattgattgttttcacaagtgtaaatttaaatacttacatagatgacaagaagcctctagtgttgaagtatagaaactggtcaccttccctgggaagggggcaaccacagtaaagagtcacctgatgagcttcaggaaaggctggtaagccagtggacaggacaggtaggggtcattgtttgatgtctggcctcaaggcatcaaaaaagttcagtccctgcaaagaacaggggaggaagagctccatctgaaggatgatacataatcagcccagggcccgtgggtttctcatctatggtaaagcatatttttccttcattttttcccttaatgtaggtgaatcgacactttaaaaagatagaataaaaataaaacacaagaaacataattttagaaaaacaaaaatatgtaagacaaatcctaattatttacaattagatttatcccactgatatggtttggctgtgcccccacccaagtctcattttgaattcccaagtgttttgggaaggacctggtgggaggtaattgaatcatggaggcaggtctttcccatgctgttctcatgatagtgaataagatctgatggttttaaaaatgggagtgtccctgcacaagctctcttctcttgtctgctgccatgtgagacatgcctttcaccttccaccatcattgtgaggcctccccagccacgtggaactgtaagtccaataagcctctttcttttgtaaattgcccagtctcgggtacgtctttatcagcagcgtaaaaatggactaaaacacacatgtaaaatgagtctcaaaaattcctgtgaaacatattaaatgatttgtctgaagttttgcatttgtctgggtctgtacctgtaacaactaactcacaaactgtgagctctgagccataactggggaaatgtcatgtaggaagtaattctcagaaacatttgaggtggaggcccggggaacagatagaatttatggtaatttgttaaataaggggttagtattgctgtaatttgggtattaagaggcagatgaccctatgttttagccaagggcaagaggtctggggaagtcaggtcttatcctcactaggtgacccaggccttcacccgagaagcagggcagagtgggaagtggcaggtgtcgtgtggccatacttcacccccaccatgcactcctgttgtttttgtctgggagtctggccaagaatgagagaaaagcaaaagatacacttcccacaggccaaatctgtttatttttccggtaaaacttggcaagggcttccagcttttgttcttctttaaggatatgataaaagataattatatctacatgttggagaaccagctttatgccatcagaagccaaatttctggacaaaagacaagcataaaatctggtgagcagcagacagctggcccacagttagcccagagccaagcccaggggaggtcaacacagggtcaaaggggataggccaaagattggtgaggtgaggggtggcaacacttgaggctcatgtttctatggctccacagtttactttgttggttctagaaaactccgttgttaactaacaaaatcttaattagaataatcaccctagtaaaatgccaacaaataatatcactttctctgaaagaagactttactggctaagaaaggaaacagttaattgcttgagccttcacaacagtaatagatttgggaacaagagcaggtaaccaaactggttatactgggattggaaccaggaaagtttaattttgcccctgacatgttgggcaggaagccccatggctttctgtttcctccaagaggtcatgaagcacctcccatttccacgctgctctatccagagcttaccctggaggggtttggatctgatccgggccaagtgcagaaagccaggttgggtcatggagtacagaaatcatatctaggttactatttattgaaacgttaaaaaatatttcagttcatttgttccttcacttcaacttgaggtagctaaaataaataagtagacaataacagaatcaaggcaaaagtaggaagtgtccagatggatataaaataaaaataaaaactatcagcaagctcatgatgacatatgaaatgcctagcatagagtcatgtaagatttctagaaattgggtatgaatctatttctaagaccctaatagacaacatcagtgggaaatcattggtaattagtggagtcttgtaactacatgtgcaaactgcagaagttcccccatatccgtaggaaatattgccaagggcccgagtggatgcctgaaaccacagatagtatcaaagtcaataaatactattttttcctataaatatttatcagtggtaaagtttaatttataaattagttacagtaagagattaccaataattaataataaaatacggcaattataacaatatgccagcatcactactcttgcattttggggccattattaagtacaataaaggtgactcggacacaagcagctctcattaccatgacactccatttgatgactagataactggtaggtgactaacagacaagagcgtaaacagcatggatcctctgggcagaggtgccgttcaagtcccaggacagaccaagtggtatggagcaagatttcatcattggacacagaacagtgtgccatttaaaacgtattaattgattatttctggaattttccatttagaattttcaaactgttgttgaccatgagtaactgacactgcagaaagtgaaactatggatatggcggcacaggggtgttactgtaactaaatgtctggaagcattactttcctgaaatgaagacatgagaattttgtatgcggcctcataaaggagatatagtgtgatatagagatatttgactttctgttcttttaaatgctaaacaaaaagtggttttcaagtgaattgatctcatagtacataaaaatattgtcatttggctgcatgattgatttaaatgcagtaactatttgtcaggcattatgtcaacttagaaagtagtgcagagattattttcttatttaagtgcattagaatgcatatgtagtttagaaatgcaaatcatttagacacactccataacaaactctggctttattttaaatggttataatagaatccctttcacataagtaaatatttcacataatatttcacataagtaaaatattatgattccaagacacagatcttctgaaaatatttgaggggtctgacctgtggaggtgttacatagaaacgtgggctctatttgaatgcaaagttaaaaaaatagcatcatgaaggactttttcttctgctgagaccccagtctaaggaggaatctgtggctatcttttttcctctcattctaatacacagggcagttttgttcttctagtgcattttgtggaaaaaatggatggtgcatcactttgattcacagttctagtaggacagttttttcactgctgcccctctaacacttctgaatgaattttaatatggtctctgtccaagtgccctttttagcaaagtaggtgtggaagacaatggatttctttttctttactagctaaaagtgagaaatataaaaaatacctttaaatgtggtgtgtgtgtgcatgttgatagctgaaatcaatcatctgtcatgagaagatattttattgcctatgtttcagtcagtgatattttctttattcacttaaaaattgtaaaaaaaataaaatgtgccatagttcctctattattagatttctttccaagccatatctgtgtaattattttacataattataacgattactcacatactacataatagtagtttaatagtagttttatattattaaatttttattgcactttcgttatgtaatacttcacaaatgtgttttcatgtctttcttaaaatcattttaaggggtaacatatcataatttacttccatattctaggagtgctaagattgtttccagtgttcacttccacagtgaacgttctgttgcacggccatttactgtgctcagcagcagctctccttgtgtcattccatttaggacctaactgattcaggacactgctggtctcaaaagaggaaataaaagacatggctgaacacctcactgtctcctagaggctcttctcaggagtggcttccataacttcccatatcatctcattcagcacagcagttcaggtggccaaacctgaagttttcgagtcagaaagtaaaatccttccccatagagaggaagcgactcatttgaacaaaaatacaattgagtacaaccactacactccactgcttctttgagacataactgattacattttaagagagcctccaatgcccaactacatttattgtgtgtgaggtctgtcttctttcctttcccacttcttagctaaaaggttcagataagcaatatcatgatgtcatctttcatattaatattaatttatctgatgaattgtgccagacattgccccttaagtaagaatctataaactacactaggcttagacataatttggaaaaaaaaatctagtattgcaagaactgtgttatagatccattaattttacagctaaagttgatatgaacacatgtaaaaatcatatccaaagcacagcagtgtcaagatgtaaagagaatgcagaaaaaagaatttctgcggctcttttatgtatttatgccatatttccctttaggattcaggccttgctttcccaatcactagcgaaaagcagtgttcattatttgatgactaaacttttttaaattttagtcttttcaaaatatcaatcatttctaaattcatcaagactcttgaataaaatgatgcacaagaagttacatacaattgatagtgaactaatatttcagtgatttgtattgtccagaatcttactgtatttgaggaatagtgaggactaaatttctcaatgactatatttgctgagagttgccacttaatttctgaccttagtattttctttcccctttctaacaacagaaattctgtcttctgcaaatattttctataatatcacaggctaactctcagtgtttttttttaatttttttttattatactttaagttttagggtacatgtgcacattgtgcaggttagttacatatgtatacatgtgccgtgctggtgcgctgcacccactaactcatcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaaaagtgtaaaagtgttcctgcttctccacatcctctccagcacctgttgtttcctgactttttaatgattgccattctaactggtgtgagatggtatctcatagtggttttgatttgcatttctctgatggccagtgatgatgagcattttttcatgtggtttttggctgcataaatgtcttcttttgagaagtgtctgttcatgtccttcgcccactttttgatggggttgtttgtttttttcttgtaaatttgtttgagttcattgtagattccggatatgagccctttgtcagatgagtaggttgcgaaaatgttctcccattttgtaggttgcctgttcactctgatggtagtttcttttgctgtgcagaagctctttattttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccgttgcttgtttttctcaggtttgtcaaagatcagatagttgtaggtatgcggcgttatttctctcagtgttttttggtcatctttatgaattcaaattgtattagttgtgaaaatgagcatttgcaaagtaacttggagaaaaatgaaactttcaattttataataaaggcttatatttttatctattgcattaacattaaaacaattcacatgattcagattcttaagataaaaaaattactcatttcataatcctcttatatctctggttttgttttaaaattcagatttcagattcactccagaattatcttgtttctctcttctgttttcatattctcaccaatgactttttctacatgcatgtataagttttacatatttttaaccatagcatggctaacatttttcatccccatttggcacttttattctaacttataaatattttctcatgttaatacatggtctttaatatcattagtgctatacaagattttaccagaccaatgaaccactattctgtttgagtcattaaatagcatcctattattggagctctgccttgtttccaattctttgtaagcagacagtgctataatgattatttttatttctattggtgtttttagcttttatttttgtttgcaaaagtatcttacagtagattctcaggaatgagaggattgagtttgagcaccttttcagctcttgaaatctatgccaaattgcttttctaagtgagatgtaccaatttatagccacaatctgtatgttagaatgtgtgtgttattgcagcattgtcaatcttaattattagaaattggcttatgtaatagataaaaaatgttaacgaattttgacactcctgggtttaatcaggaagcgtttaaatttgatgttcctgttttctattgactaaggttgttactattattgttagtggtagtatttgtagtaggtgacatgtttccttgtgacctttacctcccgaggtcttgaccttctgtaacatgtaagctgatccaactatcttttgtctcttttagaaatagtcttttaattatatagaagtttaatcattttatatattttaatgtttatcaatgtattttgtatattagtcagaagatggaaatcctttcagtaatttaaagaaaaagaatttattattaagaactgctaacttggtataaagatgttaattactgaatagataaagagtggacactaagttgtcagggagttagcagctaaaggaagctatgcttacctctaaagctaaggggacaaagggaaaaaagaagtgtggaggttatattctgccacagagagaaactcagtcctctgagtagagaggactgcgtgctgcagtctctgggtctagagaaggtgctgaggagctgcaaccctgaccttcccaaaggaactgcagccacaggagtgaagatggatgtgttaatgttgtgctacaatgggaattaaaggggacaaagtactcctgtcacttctccagacttgcagttccttcgaatgccctctcttagtggaacataacagaagccaattggagagcaaaaatgcagcttgtggtgttccagccccagcatcacaaagcagggtatagaagattgtgctcaagctgagaatcaacaacagaatgacaatcattacatatactggaagaagttgggggtaattatttgaactctgttaaataaaacaattattctgaaactcattaaaaaataagaaggctttattcaagaccatcagaatacaggagagagatcaggctcaactcaaatacagcaaggacaagtgggggttgacagccaataaagtgaaggagttcatgggtggaaaattactaggaggagacatcaagggtatggggattcttgctaaaccaacatgacaggattcttgctagaggcaggtcaagaacttgtacatcaaaggtgagggatgacaaatttgattagatatcaaggatggggagatccttgctaaactgacttagcaggattcttgctaaaactggactaggaaggccaaaagcaggacaggggccaaggtcaaggcctaatttagaagagggttcagcagagcctgactaaagtttaatcaagaagagaatttttgccaggaaaaggttgagggtcattatttgagcttctagaaattgatatggcctctatgtactccttcatcctacaaggagagagagagagatacatgtgtaattgcttatttatgattttatagcttccttgtatcacaaaggatttgatattacttgcccatgttaacggaaaaaatcattgtgtatctggatctgtttgagattttcagatctacttttcttgaataaattccatatccctgattaaatttcagaagagatattcaacagggcacatactagtttaacgtattgttttttatttatttgtttgtttgtttttgagacggagtctcgctctgtcgcccaggctagagtgcagtggtgcgatctctgctcactgcaacctctgcctcctgggttcaagcgattctcctgcctcagcctcctgagtagctgggattacaggcacccaccaccacgcctggctattttttgtatttttagtagagaaggggtttcaccatcttgggcaggctggtctcaaactcttgacctcatgatccacccaccttggcctcccaaaatgctgggattacaggcaagtttaacatattgttatttccaactaggtattcagtttattgcttttaaaaaaatattttttgattaattgggatagatacttttacacacaaaagtggtaccatatttaagtgaagtaggaggcactgggctaagtatattccttattaccatacacattttttagagttttatgtgaatgctgggcttccaaagcaccacaggcccctgttaatgccatcaaaatttaggaattcttagaattagcaaattctcctttattgctcctaaacataaagattagttgaaagaataaaacaatgaatgaataagtggaactctttttacgatccaaccactaactgctggttttctgtttcacccctattcctttgagtatgcacacacgtattatgaaatcatgtgatatgatatatttaatcatatgttttaaacatattaccagatcataatgattgttctgtattatcatttaaagttttcacagtgtttcagtgaattccatttcagatgacagtgttatttttaattgtttttattaaaacatggctccaaaaactttcatttttagctccacatgtaaagagcttaaaagttgtcaaagttgtcactctgtccttaaaacaggaatgaaactgcatagagtaaaagtcaacagctttttttgggtcccattagagaaatgaggtcatgagacaaacagccaccaccaaaattggagagacagataactagagacaatcacagttgagatcatcttatgatgagcaaaagttggtaggaagaagcaataataaccacaagttggtaggaagaagcaataataacttccaccaattgatagaggtggtatgagtaatttctggggtctgcagtcttagaatagcacacttttattgattttcctctatgaacttcacaagttctaagtaaccattctgaaatatattcagagtgttctctgtagcaaaggccagaactcccagggaaaggacatttctagatacttatctgacatggagaaaggacaatttcccaactccagccccatctagccttccagtttcacctagggagggtaagaagcagtgaaacatttccaatgatatcacagcgtagggaaacaggtgcactaagagtttcagatttagtcataagaatatagaatgatcccctctgccactcctaatcaccctatcaacagggcttcaatagaataacagcaggtttcatcaaggctcagactctaaggcattcttaggaaaacccaaacataacaagggagacagaaagacagtcagtagacagaggacattggagtccctggaacatacagctaccacagacatgaagcacacctcaactcatagccagagggatgtaaaactcatcccaaaggttccacttatctaactctagtatctgatgtgtcatgtctggcttgcacaaatagttgcaaaacattcgaagagacaagaaaaaacaatgtctgaagagaaaaaagtaaccatgctcagatatgacacagaatttggaataataagacagtcaatttaaataattatgattaatatattaagcactctcataagaaatgtaggctatatatatatatatatataaacatagcagaatacacatatccaacatctgcacaatttcaagagctatgaattaaattagaaattattggaacaatagaaaaagaaaaagataagatagctgaaaaaaatattcaaaatatatagtaatgctgaacaggtttcaaaattaatgatgttcatcacactatattgccagaaacctcagagaaagctgaggtggataagtgccagataattgaaacttaggcatattgtatttatttatttattttctcaaatttgttgagggataatgacaagtaaaaattgtgtatgtttatggttttcaatatgaagtttttataaatgtatatatcatgtaatgattaaatcaagctaattaacctattcatcacctcacatacctattttttatgataagaaacacctaatttcttagcaatttttaagtgtatcataaattgttattatttttaatttattatgtatatttgaggtctacaacatgatgttatgggatatgtattgatagtaaaatggctattatagatgaagcaaatgaacacttctatcacctcatgttacttttttgtgtgataacagcagctaaaattttatttaacagaaagcccttataaaattttattaactatagtgctcatattatacattagatttctagacttatttatcgtacacttctgctgctttgtatcctttggcctatacttccttcttgttcccaattcccatcctctagaaaccattgttttacattgttttattctctctgtatattgtgtatatttgacctcttttttagattccacataaatgtgagatcatgcaatgtttttctgctggtagtttttgtgtcttctttagagaaatatctattcaggtcttttgctcattttttaatcaggttgtttttctgctgttgaattttaagtatttttcacatatttagggtattaactcattatcaaatatatggtttgcaaatattctttttcccaatcttaggttgcctttccattttgttgatggtttcctttgctgtgtggaggctttttagtttgacgtagtctcttttatttatttttgcttttgtagtctgagcttttcgtgtgatttgcaaaaaattcattgccaaggccaatgtccaacagctttttccctatgttctcttctaggagttttaggatgtcatgtcttatctttagtttttttatccattttgcattgatttttatatatagtataagataaaggtccaattttattttttgtctgtggaaatccagttttcccagcatcatttgtggaagataatgttttatccccaccttctcctcttggcacaaattttgaaaactatttgactgtgtatgcctggatttattttgttcttctgttatagtagccaaacaaattaggagacataccaagtatcttttctgactgcagtagaatgaaattagaagtcagtaacagaaggaaaactggaaaattcacaaataagtgaaaattaaacaacaccctcttgaacaagcattgggttaaagaagcaatcaaaatgaacattagaaaatattttgagtcaatgaaagcaaaaagcttacccaaacagataagatatagaaaaagcagtactaagaggggaagtacatggcaataactgtccatattaagaaaaaagaaaaaaaggtaaataacttaattttatacctcaaagaactaaagaaagaagaacaacctaagactgaagatagcagaaggaaggggattttaaaaattagatgagaaatatgaaatatagccgatagaaaactaatagaaaaaacaactaaactaagatttgggctttcttttaagataagtaaaattaacaaactttcacacttactggaaaaaaataagagaagactcaaataaaatcagaaatgaaagagatgtcatcacatctgatggcaaagaaataaaaaagatcataaaagactacagtgaataattatatgtcaacatgtagaaacacagtgtaccaagactgaatcatgaagacattgaaaatctctctcaataaagaaaagtccagcaccagaaagatgcactgatgaattctaccaaacacttaaagcatgaacagtgatccctctcaatctctcaaaaaaaaaaaaaaaaaattgaagagtggggactcccaaagttattttatgaggctagcatcaccctgataacaaatacagacaaaaaaaaaccctttacaagaagagaaaactacaagtcaataaatattcctgatgaatacagatgcaaaaaacctcaacaaaatactagcaaacttaattctgtagcacattaaaaggatcatataccataaccaagtgggatgtatttgtggaatgcagggtgttctaacatatactaataaataaatatgataccatacattagtagaatgaaggataaaattacacaatcgtctcaacagatgcagaaaaagcatttgacaaaatccaacacatttttgtgataaaatctctcaacaaactatatacagaaggaattttttgtatatgaaaagcccacaaatgacatgatctataacagtgaaaaaataaaagcattttctctaagatcagaaacaaggcaagatgaacactttttatcacatgtactcctcatactactgaaatttctagccaaggcaattaggaaagaaaaagaaataaaatatattcaactgagaaagaatgaagcaaaaactatcgtttggcaggagatgtgattttatatgtagaaaacatgaaagactacacacacaaattttcaaagtgatgttgggcaaaaatacaaagctggagacatcacactttctgatattaaaatacattacaaatgtaaaataatcaaaatagcatggtactggcataaaaacaaacacatagaccaatagaacagaaaatagactttagaaataaacccaggtatatgtggtcaatggatcttcaaccattgggtgccaagaatacacaatggggaaaggatagtctcttcaacaaatgatgttgagaaaattggatatccacgtgcaaaagaatgaacttgatctttatcttaccacatacacaaacatcaactgaaggtggattaaaaattaaatgtaagacctgaatctatagaactcagagaaaaacaaacaaaaaaagacttaatctttgttttaggcaatggtttcttagatacggcaccaagagcactggcaagaaaagcaaaaataggcaataggattacatcaaactagaaaacttctgcacagcaaaggaaataatcaacagattaaaaaggcacctacagaatgagagaaagtatttgtaaaccatatgtctgataaggggttaatgtttaaaatatatacaaatctttcacagctcaatagcaaacaaacaaacaaacaaacaaaaaacaaacctgatttaaaaattggcaagataggccgggcgcagtagctcaggcctgtaatctcaggactttgggaggctgaggcaggtgaatcacgaggttaggagttcaagaccagcctggccaagatggtgaaatcccgtctctactaaaaacacaaaaaattagccaggcatggtggcaggtgcctgtaatcccagctactcgggagcctgaggaagggaattgcttgaacccaggaggcagagattgcagtgagccgggatcatgccagtgcactccagcctgggtgacagagtgagactccatcacacacacacacaaaaaacacataaatagatatttctctaaagaagacatgcaaatgaccaagtatataaaaatatgttcaacatcactaatcatcaggaaaattcaagtcaaagccacatgagatatcaccttattgtgtttagatggctgttatcaaaaaccaaaagataagtgttggcaagaatttggagaaattggaacactgttagtggaaatgtaaaatggtacagctgctgtagtagtttgtcaaaaaagcaatagtagaactaccatatgatccagcaatctcacttctgggtatattttttaaaaattgaaatatatattatgataagatattaatactcccacatttatttcactgttattcacaatagtcaaaatatggatgcaaactaaatgttcatggatggatgagtagattcaaatatgtgacatagacatataaataaatattattcagccttaaaaaaaggaaatcctgtcatatgtgacaacatggatgaacctgttgatcattatgctaattgaaataagcaggtcacagaaggacaataatctattgtttcacttatgtgagaaatctaagttagtcaagctcatctaaagagagtagaattgtggttgccagaggcagggagagggtggaatgggaagttgttgttcaatgtgtataacatttcagttatacaaaattaataagttatacaaatctgttgaacaacactgtgcctataattaacaatactgaattttgcacttaaaatttttgttaagagggtagatttcatgttaaatgttccttccacaatatgaaacagaaaccaaggtgaaataaaataattttttattcttcactgatccagcagataactcttaatttaaaaaaatagtggcagcattgtatatggtgactatagtaggtggtaagtgaaattaaccatatcgatatagcggacaggagagaggaatgggaatagtatattaaggtatctgcactgcccatgaagtggtataatgttaatggaaagaagacttcatttagttgtaaataggtattgcaaactctatagcaatcactaaacaaaatttaaagagataattattaatatggtaagataggaaagaaaattgagttatacaaaatgcttaactaaggtcagagaagacagaaaaagaaggaaaagagaaacacagggtaaatgaaataaatggaaaaaattattaacacagtagatattaaaccaactaaataaaaatcacttacatacaaaggtctaaatacaccagttaaatgacagagattgtcagagtgattacaaaataagaaccaactttatgttgtctatgagaaatccactgtgatcataatgatagaaataggtggcaaatggagagatgtccaacttatttttaagaatggtgctaaaataattcaatggggaaaataatagccttttcaacaaatagcactgaatagaaacatgcaagggaatgaacttgtacccttacctcacaccgtatacagaaattaactcaaagtggataagagacctcaatataagtactgaaatttaaaactgttagaataaagttaaggagataaatctttatgactttggaatcagctctggattcttagatatgacatcaaaagtgccaatttaaaaaaaaaagaaaaattggacatcaacaaagttaaagtctcgttttgcttcaacaggcagtataaagaaactgaaaagtaaaactcacatagaggagaaaataatcacaaaatatatctgataaggtacttatatcttgtgtatcctcacatgcaaagaactcatacaattcaataaaaagacaagtaacccctttaagaaataagtgaaaagcctgaatagacattacttaaaagaagaaatataaatggccaagaagcacatgaaaagatcctcaaaattattagccatcaggaaaatgcaaatctaaactgcaatgagataccactttacacctacactttacacctgataaatggaataaaaaattcagctgataacacgtgttggtgacagtgaaaaaattggaatcttcatacattgttggtgggaatgtaatgctctaagtcaagaacaggatcttgaagtttctcaaacagttaaacatagttatcaatataatccagcaatttcatcatagatacctatccaagaaaaacagaatcatatgacaaacacaacacttagcacacaaaaatgtatagcagccttattaatagtaaccaaaaggtgaaataaacctaaatgctcacaactgataagtggataaacaaaagtagaatatccacacagtggaatattattcaatcataacaaagaggcaaatactaatatatgctaaaaatgaatgaacctagaaaacattatgcaaaatgaacaaatccagtgacaaaagatcacatattatatgattcaatttatatgaaattgttctaatggacaaatttatagatacagaaaataaactagtggctgcttatggactgggatgacaggtggatagaatggtagtagttaaagggtatggagtttctttttgaggttaaaaaaggatctaacatcaagagtggtgatggttgcacatacctttgcatatattaaaaatcattgaattgtaccttttaaattggtggactgtatttctcaatgaagctattttttaaaagcaaagaattggagaaaaatataccatgttgccgccaatcaaaagaaaactggacaagctatataaattccagacaaatgaacttaatatcaaggaaaagtaccagagataaagaggagtattgcaaaatgataatggatcaattctccaggaagacataaaatccttaacatatatatacctaacaacagagcatcaaaatatatgaggctaaaattaacagaactgcaaggaaaatagacaaatctaatagtatgattacaggcttcaccatttcttatcagtaactgacaatttcagcaggtagaaaatcagtacggatatagcttaactgaacaacaccatcaatcaactggatctaactgacatttatggaattctttatccaacaaacaccagaatacatattcttctgaagctcacatagaacattcaccaagatagactacatgctgggcagcaaacacatctgaaccaatttaaaaatagaaataatattcagaatgttatcagaccgcagtgaaattaaactagtactgaaaaccagaaagttagtgatgaaccccaaagtatctagagattaaacaatgtactactgaatcaaaattgtgcaatacaacataagcagtctttaaagggaaatttatagcattcaatgaataaaaagaaagatttacaatcaacaatctaagctttcattttaggaaaccaaagaaggaaaaatgacacaaacctgtaaaaagtggaagaaagaaattaagacctaaagtataaatcaatgaaactgaaaatagaaaacgaaaagaaaatcaacaaaaccaaaagctgtttctttgaaaagatctgtacaatgtattaatccctagccaagccaatcaggaaaaaagagagaagacataaattactagtattagaaagtgaaaaaacacatatttctccattgattatatgtcctatttgaacaatgtaatcctcttatttatagttcaatgacaatttttaaaagagcatatagatcatattgttgcataggcttctggagccaattcaccttagtttgaattccagccttgccttttccaactttgcatacggttcagataatcttattttccttttaagttagattcatgggtgaatttttaaagatgatataatagccacaattaagatcaatatgtggtggtgtacagaagctcatgtcaattggaaagagtgcttgttcattttgtcaggaactgagcagccatggcataagtctcacctagatttgcgaccacaggtaaattaattgaacaacttgtgcttcagttccattagctgtaaaatgataatatgaaagtacagaatagtacatatattataacattaaattcttgagaatatgaaatgatttatgttgcttgacatacaataattatgtaaatacaattatataatcattcttcaatattttgatctacataagttgattttctaatattgagctgacttttgctttctgaaaaaaattcaactggtttttcttactccaatttatcttcattcttttacatttagtcatagacaaagggacacatataagatgaaagagaagaaataatttaaaaatagagttaacacagccctgtcacggcggctcacgcctgtaatcccaacattttaggaggccaaggtgagtgagtcccttgagctcagaagttcaagaaccccctgggcaacatgataaaacctcatctctattttttatatatatatagcaggagatggtggtgcatgcctgtggtctcaactactcaggcagctgagatgggagaactacttgagcctgggaggtagaggttgcagtgagctgagatttcaccactgcactccactctgggtgacagagtgaaaccctgtctcaaaaaaaaaaaaaaaaagaagaagtaaggtcaacacaaaagttaccccagagatgctcagtttctgacaaaattaacaagcactctttctaattgacatgaacttttgtacagcaccacatattgatcttaattatggcttattacatcatctttaaaaattcttccataaatctaacttaaaagataaattaagaattatcattgttaacattttgacacttcttttctgtcaatatgtttttaatgtgtttttcttaagcttggtatcatatatagagagaggtaattttgcaacccacttctttcaaatatcatctatgatatattttcctatgctattgaacggaaccttatagcatagaaaacaatgcaaagctgtgctaagttcccatgaggtcacttttaccccagagctgctcgggttcccagcaaaataaaccagcactctttccaattgacatgagcttccgtacactaccacatattgatcttaattgtggctatgatattatcttttaaaaatcatctgtaaatctaacttaaaaggaacataagattatcagaatcatatggaaaacgtgtatgggtcactcaattttgagcctgccagttttctgtaatggtgaatttctagtgatctctatcttttcttaaacaaaacacttgaaacttctttattgttactttcatcttaatcttctaattacctggctgtatgctaaaaattatgagtttctcttcttacaataagtatattttttcatagattcttgtaagatggacatttgacatgtaaaaaaataccattggttgcaaattttcactagtgagattatttgggaaaaaaaatatttattttacactttcaagaatgtcacatagaaatgaggttttagttacagaagagatcattagtatattcattttttattaatgctataaaaatttaccacaaacctagtgactaaaacaattcaaatatattatcttatatttttgtagattacaagttcaaaatgggtctcactgagctaaaataaaggtgctggaagggctcggttcctttccaaaggttctaggggagaatctgttctcttacatttcccagcttctagaggctccccttgttccttggctcatggtcccccttttttatcctcaaagcgacaagtgttgctttcctctgatccttctcccataattatgtcttccattaactctgctggaataggttcctcaactttacagatccatgtcgttagattaagcccacgtgaataatctagaataatctcttcttctcaaggtccttaactacatctgcaaatgtccctttttccaaagtccaataattttcaaagataaattaagaattatcattgttaacattttgacacttcttttctgtcaatacgtttttaatgtgtttttcttaagcttggtatcatatatatagagaggtaatttttcaacccacttctttcaaatatcatctatgatatattttcctatgctattgaacggaaccttaacagaaccttttgaaaggtaacaattaacatctttagttacaaaaaaagtgatgtattcaatttaaattttcattaaaataaatgacttttgggtttccccccaaaattctgacctatggtttatcctttgtgcatttaatgtgcttgaagatcttggctctttccaccatgcaagtcattaaagccaggtcatgctccgcagcatttcaaaaagtcatcatcacacagctgagaaatgacccagcaacagataacagaaatcccaccgcctgattattcacatctttcaactctcattacaggtcaattttaggccccacagagctattttagtgtggccacaactgccacattggatgattgtcaaatattctaactgtggctgtcaggaagacaaataaacaaaccctggatcaaaagcccaccaggctgtgctggctctcacagggctggtgctttgctttgagacaagccctttcccatttgtgacttgttatggcctccaaaatttatatgctagaaatccaatcaccaacgtgatggtgttaggcggtgaagcctttgggaggtgattaggtcatgagggtggaacctcatgaatgggattagtgctttgataaaagaggccccaaggagctgccttgccccttcaccatgtgaggacacagcaaaaggacagccatctataaaacaaaaaacagtccccctacagaacaccaaatctgttagcaccttgatcttggaattcccagactctggatctttgagaaatacatttctattgttgacaagccacctagtttgggatattttgttacatcagcccaaatagaataagacagggctctaccactaagattttgtttgtttgtttaactctgggcaaattatacaagcctcttttttcatataaagtggagatatctgacactttgagtagaatgatattactacatatttagctcaccagaattatagcagagattcaacaagtactagttctgaatctctgaccatctggtctaaagaaggccctgccttcctttatttcacaacatttattaatagctgtaattaattattgttcactatgtttacctaactttaaatttcaaaagtgctaaaatcatacctttcttatgtagccatgtgtacctggcacctagctcagtttaatggacttagtaaatgcttaacattttctcagtaagttagtttcctcttttcttagctcccttacatgtgttaaatccatgacaatcattcctaagaaacttgctcaccaaacttatgaacaatgacacacatttttaaacttattgcctgaattattgctggtgtcacctgctggaattagacagtgtagaagaaaattttgtagaaaaagttaaacccaagacctgaatatagatagccaggaatgagagaaaaagataaattcctgtctttacttgagactggaggaatttctaggctttaagagaggatatcagagcagagtcagtgctcttgcttcggtcaaagcaatgtgcctgcttttcagcatacagaaaaagaatatgctaggttgcaaagaggaaatattgttgtaccattctgaacaggtaaatcctgcttaagcatttaattggaaagtgaaaatgaaaatatccaaggagctatacttcacacttgaatagactgaaataattaacgtatttataaccaaaataggacttactattgtaagtaagttttggaacttgaacgttcattgtccaggtcctttccaaggctgtggagtggctctagcaatctctttacgtgattatctgttttgtaaagttttcaattccgtagtgtaatttattttttttcttccactaccccgagtagtttaggtatttgggcccatgttttcctcacttttttgtttcaacctgctggattatccagagaagttccacttggagactgggtacatcattacttcaagcaggaaaatgtcaagacactcaagaccctccgtgctgtgtgggcacatggctgctgggctatgaggctttcccttggacatgtattttcagggcaataatgaccacattctgaggagaacaaccaagattttaaggagatttgttgtggttgttgtttgctcagggagagactatttggaagaacagagggaacttgactcagagctagacacttgggtacataatgacactctggaaagactttcaacttggactacagaaatacaactgaaaataattctctcttatcaacctaaataagtcagttcaaatttatggtattccgtttgcttaatttgtaaagcataaagtcagaaattgagtcataataataatatgaaacctagtgttctttaagcctttactttgtgtgaagcgcagtgataattacatagaattctcagagcaagatgaattaactcaaaatggatcaatgacctaaatataggagaaaaacaatgaaactactagagaaaaacatagggataattctttatggccttcgatttgttaataggttctcaaattttacaacaaaatcaaaggcaacaaaaataacagataaattattcttcattaaaattaaaaaattatgtatcaaaacacattagcaagaaagtaaaaagacaacctataaaatggaaaaaaattgcaaatcatatttcgggtaaaaatttagtttccaaaatagaagtaccatatcacatatactaggatggtgagataacaataacaacaaaaaaaggaaagaaagaaaagaaaagaaattgaaaagaaaaacagctgaaattaacaagtgttcacaaaaatcaagcaaaataggcaccctcatacattgctttgggggtaaaaacatagtgcagtttggcaccctgctaaaagctaaacatagaattaccatttgacactgcaattctactcctagatagatgcccaagggaaataaaaacatacgtcaagttactatgctcacacaaaaacttgtacagcaatgcttgtagcagcattattcatgatagcacaaaggtgaaacaactgttcagcaagggaggaatggataaacaaatgcttgtatatacacacgatgaaatgttattaagccataaaaaggaacgaagcaccaacacatgctatagttcgaatgaacctagaaaataatatgctatattcctgtctttgcttgagactggagggatttctaggctttaagagaggatatcagagcagagtcagtgctcttgcttgggtcaaagcaatgtgcctgcttttcagcatacagaaaaagaatatgctaggatgcaaagaggaaatactgttgtaccattctgaacaggtaaaaactgcttaagcatttaattggaaagtgaaaatgaaaatatccaaggagctatacttcacacttgaatagattgaaataattaacttatttataaccaaaataggacttactattgtaagttttgaaacttgaacgttcattgtccatgtctttccaaggctgtggagtggctttagcaatctatttacatgattatgtgttttgtaaagttttcaattccgtactttaacttatttttttcttccaccaccccgagtagttctatatgctatagttcgaatgaacctagaaaataatatgctaagtgaaagaattcagcacaaaaggtctcagattgcataatttctttcctgtgaaatatccagaataggtaaacccatagagacaaacagcagattagtgattgccaggggatgtgggtgagagggaggaagggagagtcactatttaaacagtgtggagtatttttccggggtgatgaaaaattttgaaactaaagaaaagtggtggtttacaggattgtaactgtaccaaatgtgctatttgaaatagttaattgtgtataatgtgtattttgcctcagaaaatgctaagcatgatttagtatataaacaccttgaaaaggcagaagaaaaatcacattgttatctctaataaaagtggaaacatcattgggcaaaatccaacatccatttctgaaaaactttcagcaaaatagtaacaggagggaactcctatagctgcataaagggcatctgagaacatcctatcgctaacaccttaacgctgaaagatggagtgcttccctccaaaataaggggaaaaggcagggctgtctactctctcagcatacataggcaaccagctggaatatggttactgtcccctgtggcaaaggaacaccacagggatgtcctcagcacctccaagaaaaagagctgggttcagatagctgctgggtccacagagccctgcagttagatcagcccaatagcacccaccaaacaggaactttccaagatgattgcaaacggggttaacatgttttttggagagcaactagaggcactggatgagactttgtcccctcaactgactgccatctcccactcccctccccaagtcaggcttctgttgagggatggagagatgtatttcctttaaagcaagaattaagtattgactactacaaaactaaactaaactaaactggaaatgtgcctgaagtgaacagagtcaggtgtgtgtaccctaagagggaacagaaatctccggagcctatgggaggtttcacccaagaagccccatcccacacagtgggttaaaagagcagtgcaagatcaaatcaagttgcttcaggattgcatcctgcaagtgaggcccacacaagggcaggctgttactagcagagagaaaagggaacaattggtattgttctgcctacctaaataggcatcgggattgtgattttgggtcagaatttctcatataaattgccacatcatctgtttttcaatgttctttccattaggcaactcacagcaagggaagtaattctggagaagaaattaagaatttctatattccctggaaagtattccatcaaaataacacacagagtagcacccaaaataacacccctagtagcaaccatttttagaagccatgattcctaatgatcaggcttcctgggatcctcagctatccagttctagtttagacatacatccttgcctcctattgccactatgcaatggaccatggatgaaaatctgaacaagactgctgactgctctgttaaaaaagcctcctgcatcactgcttcagtctcttggcctgaaatgctccttctactcatgaagttaatatcttgctgccaaaacttaattcaaaaaccaccatctaccatgaagcctcctctcattctcacagcccaaatgtattttttatctcctttaaattctgtatgttttctcatccgtttctatcatagttttactattctacctatgttgcaaaactctctaagcttagagccatattttatacaccaaatttcctgctacagcagacggtgctcaataaatatttgttcagtgaatgaatgagtgagtgaatagagctgaaggagtgaattaaggaagagagttattatagcatttccctttacaggagtagaaataataagcgccattatggattgaaactttgaaaatataagcagtagaaagactgtgttgcaacagaagtcttataaccacagcctttattcaaggtatttcccatgtttctctacaaagctaataatactttgattcatcttcctaagagagttataaaataaaaaggaatgatcatctaatttaatatctgatgtaattccagtgatgtgtaatttactagcttcttagccctgaactgttttttagtgttagtaatcacatctgttctgcacctttagagaataaagcactgccaatcaatatatgataatgcttttattaaaatgttcaaagcagaaaacaggtcttacttactaaatacttcatcagttctaaatttattcagaactctttcctcaaataagtaacatgttttaaacaagactgtggtttgctttctccaatattcctttcattgcacatgtgttagttcaagatggctaaagttctttgctttcccctgtcttgtgttgatgaccatcaaatgaggaaacagatatctgaacattgatttctttcatctatttgactgatatttattagaaaaaatggtaataattgctaacatatattgaagattcattatgtaccatgtttctaacatttgttttatatacagtatctcattgagtacacattgccaaggactgtataatgtgatgggctaaaatatgttccccccaagatcatatgttgaggtcctaattcccatactttagaatgtggctgtatttagagatagggccattaaagaggtcactgagttaaaatggagccctttgggctggacctaatccaatctgactggtgtccttattaggacattgtccctggtgcacagaaagctgaccatgtgaagagacagtaagagggtggccatctgtaagataaggaaaggggtctcagaggtcatctaccctgccagcaccctgatcttggatttctagactccaaaattctgacaaaataaatttttgctatttatgccacccagtgtgtggtattttgttatggcagtctgagaaaactaacatagatactgttatcatctcagttttacagatgggaagacagaatcttgaaaaggtcacagtctagtctgtggtggagcagatgctaaaaccacagtctgagttcaaaggctacactctttgctattttctgttagcacctcctgacattaatatcaaattgatttaactataagattgtggcaggcactgtgctaagaactttggtgctttatcaaacctggttgctgatacacttaaaacatttcttagagtttccccatttgtgtttcttgctgctgaccactttattcctcagggctcttccaattctcttacatggactcttctctttttccatccttttctctttccccaccctgtgtctatgacaaagtcagtattatctgggctgtccagtgactctcccacagtaatttttcttgacctttttaaaacaagcccaagtcctttggaactcaggcatctagagatagatattggcctcttaacatagttgtggccactcgtggactgtgactgagtttcctgtattgaagcccagctcaccgcctttcttttcatgtcactcaaacaatgttctgtgcagtctgtccagattcagcagttttgtccctggacacatggtttgttgccaccctccacttccggtcctcgtgaaggcagtttcatcttcactcttggatgcctccctgtcttcctactgttccagagcccatgccatttctgagatcctctgagctgtccttgtggcttccatgcaggtgaacacaggattatcagggataaatgatcagcagtgggtgggccagggtcacatgtgagaagaaacaggctgtgacctgagagtgagatgctgaaaaaattgggaggtgaaagttactgcatttgagaattccaaggatcttagaagacagaaatctgttgaagtgttcacacggacacagaaatcggtcaatatgatagtgcaacataaaggcgagttctcaaggacccccattcctcctaatgagaagaagacacaattattattatactgtgtctatttttagcaaaataataagcatgcgatagtatagcttgttttatgctttgcttttcaactgggtgaaaatccatgcaaaatgatttcccaccttatttgagatctaaagtcttaaaatgcagagcctatctgtgaagtcctccgcagcctcctgctcccacccccctgtccgcttgctaaaaggtcatgcattttccttcccgctgcagggcctttgcacttgctctttactctgccttcaatgccctttgttcaactatctgcacgactcatttattctcttccttcaagactttgctcaaatacaattttctccttaaggccttttctgaatactctgcttaaaattgcaactttctgcctccaaatcctcttcctttttccaggctttgtatttcttcagagcatctatcaccttctattatatcatttacccatgtattttgtttatttgcccttgtctgcaatgttcagaatgacttatttctcccttattgtgttttttaatgtatcttcaacacttaggagagtgcctggtgcacatactaagtagtcattattcatttattagataaatgaataaatgatgtagggaagaatctttgtatctgcaactctttgctataatctgttaaatttttaatttattatacagttcaactatgaaacttacctttctgaataccagaaaactccttaccctttttaatctgtaaattaaccagattcttccagggattattaagtcattctggtgatttttataattgacctttgttaacctatgatggatgcatttgctacagttcatactgaagacttctgaaatttttctaacccatgctgcattgacagtttccatgactatatgaatattaccaaaaaaaatcctagcatatgtacgttaacatattatcaaaattgaggaagggaattagaaaaacaggaaaaagaaaagagtgcaaaacagtgatcacccataaattacctagctcaataaatgttaccatttgagtgtacacacccaccccaacattcacaaaattgcgattgttttgtttgttcacattattcctaagtcttttccctcctttttcagaactgttcctgacacctcaaatctaataccagtgctgtagaggctgtggggaattgtcgccgttggccagggcaagcctcctttgatggcccttgacattcacacttttggcaatatatcttattatggagtcatcagtgttcaatattgagaattttaaagatgtgaatatataaaggcatctataaaggcagaaacatcacatgtaattccaaaagtcaaaatgacatctatttcttgaaaaatttttagtatttacttctagaaatctatttacacattttcatttgtatatgtatcttttcccagaattggggtcacatagtacattgtgtttataacccactttctttcatgtaataataactgtgaagattttcatatccagttaatattcccacttactgcctatgtgccatttatcacctacaccaacagagttattaagaggactgccacaagtaaagttacagaataattcatctgaaagctaaattaaacctaaaacacatcatattttccctcctttattcatggtaaatgctgttatctctaccatttggcctccagcagcaatttatgttcataaagaatttccatccaggagagaaaatggcactccacttttcgctttcaattttttataatgtgtgatgtgcttcacaggatttcactgctttctctgaccacaaacaaacagtggaactgaatggcctgtgtctactgccaccctgcttgtacttcccagctttctttcatggttgtctctatacagaagacatgtaagcatggaaaacaataagatcataagcatgtcacagtaagatcatatggagtaacctttttctcactcttaattgcaaatgaagtttgtataatgaaatgtttggaattacaaattaaaaccaccagacaccatttcacactctgtttgtttgggagaaagtactagtcaatgttaaaaagatgtatgaactcttatttagagtttgtataggagacacatttgttacaatcactttagaagtatttttggcattatcttttcaattttaaaatgtatgtagccagagatgcaacatctccagtcatagcacattatattacctgaatgcttacatatttatgagggctaatagtagcagcatttacaatggcaagaaataagtaaataaagcagatgaaaggtacataaacacacatatggataaataaattgtggcgtattttctcaatggattgccccacagcagcagaaatgaattctgccaaaaacaggaaagaagatgagtatcacacacctttgttgagtggaaaaagccacacatgtatacggattcctggaaggttcatataccttgccccacatgagtggaacaaacaggacttgaattcaaggcctctaacagaagggtgcagctgctcaacggtatactaacccagcttgcgcagatgtgcatattaacatacaaggatcagtgggaaaacacatcttgagaatgacaaagggaaaggaggggatccatggagtgcagtcctgagggggcaggtgcatgatcagaaaaaacagctgtgccactcaggcagcaggaaggcacgtgggcatgggtgcagaccaaagaaagaggtcggagtggggacagagggatgaaggtactttgttaacttaatttggttgcaagttttgtattcaaatgctaaaacagagtaccaccacgttgtgataaaatatgaactgtaattcatgctccatattatcccactctggagtttccttccccaaactaacttttgtagctctctcttctgatatttatttgcataattactaaacattctgtatcactatttcttatgaaaaattttatctatgtactttcatagaagataatgatcatacactcataaaccaacctcacactatcccctcccattacctttctatcataatttttaaaacattatttaccatttaatttatagaaatgtaattcttaccactgatgatccttaaagttagtgtataattgaatttccttttctgtattttctcttctgtaaaatggcgatgataaaataaaaccttcttcatagggctgttaaaagtaaaagtgtgtatgtataaagggtattaaacagtgtttggcatatgattcaataaatcttagcttcatttactatcgaaaacccagaggaagatacagaaattgacagactcaggttaaattcaaagtttcttgacctctcattcaaacgctattcatagtatgccacattcttgcttttgtcacatataaatttaaatttttaaaaaagtaattgctttgaaatgttagaaacaatgtggccttgcacataaaggtcaacaagacatcccaagtgcgacttgatgagtacttccatattctcctcaaatttattttattgccttgaccttttctcccagcctcagctgagtgattttcctggtttgttgaatacattttgcagtgatgttatgcttttgtgaagaaggaaccctttggtatgtcagtataaataccaatttaacgtcagagtgattctggagggagttgtgattatgagtttatttatgaaataatgaatattactcattagtctggcactgatgtatttgaagggataggctggattagaaccatggtggtaatagtgctgtcatagcatattttaactgcaggaacattgagagaataattgctggattagaactttggtgttaatagtgctatcatagcatattccaactgcaggagcattgagagaataattacagctactgaatggaacctccagctctcttaactaaagaaacccaaacactttcttaaatactcaatgaatattatgtcattgaaaccattctcccagcaatagcccacaaatactaaacaggatagaaaattatgcctacccaggctgaggaaggtggctgacatctgtaatcccagcactttgaaaggttgaggtgggtggatcacttgagcccaggagtttgagaccagcctggacaacatgacaaaaccctgtctccacaaaaaatagaaaaattagcccgaatggtggtgtgcacctgtagtcccagctactagggaggctgaggtggggggatcaaatgagcccaggaggtagaagctgtagtgagccatgaacaggccacggcaccccaatttgggtgacagatagagtgagactctgtctcaaaaataagagaaaagaaagaaaaaatggctaccaaatatgaatgccctggatctgctaagagaagtgattcacaaccatttgaaacttttgtttctgagtcaacaaaggatgcactaaaataccactactactgccacgaggaactctctgtttttgcagtcatgagcatataatatccccaaacaatatagacaatgtcaccttctcacagggtgtatctctgacctttcagactcagaggaaactctcaaacactcttgaacctgtagaggatggttattctcttcaaagcccatctatctaaaagtatgtcattttgtttgtttgcctatacgttattttcttctcacactagattttaatctccataatatcaataattttgtttttatcatgactattcccagtgcctaaaaaattttttagcataaagctgtgccaataagtagctgctgaattacacagttgctaaatgatacgacacagctagtttggtttatagactcatgggagccctacataaattgcacacctagctcaaaagaatccattattttgagaatccacacaccaaaatgtggagctgggggattattagaggactgaaataagcaagctcaaaaatgagttcttaggtctcaattttaaaagtttgtcttcaggaacctcatcttaattaatttattttttgatggggttttggaattttataatctatatcattaacaattaggtagcaaaaattttacaaatagctgagttattagtatttgaaacaacacatttttcattgcaaaaattccttttcacttgttcagcatctacctgtaaaaagcaaaattacacacatacgctgtaatttcaagggacactctaatattttcacctacataccaatctagcaaaaatgtcttcaaggcaaggacttatgaggctttcctttaagaccaaaaaatgtatgcagatataagaaaaggaattacccagagtaaacacttttggccaggagatttatgaggggaaggatgtctttctctgagggcatatatctcaattttgaccgagctgcgattctctccattagtttacattgctctgtaagcaagcaaactcttctgtttcaagaggacacacaagtgtctgaaagcactaagctgctatacagtgacatcaataatttgcaataaatttaaaaatcatacagtattacagaaaccacaaaatcataaaggattgcagaagagtcattgctgttgggtgtggagtgtagtagaaccaacaaagaaatacttgggccatcttagcatcctataatagtgccccaaatcctggaggggacccacagctctaggaaatgtagtggaaaaaattagagttttgaaagcatatgtgcttgatgttggggaagcagtgatgctaattttaactctactctatttacctgggatatattgggcaacttgaacaaactctgggccttagggtcttcatcattaaaaagcagaaaatacagtagtaacttccttagagattactgaaagaatttaacacctcacaaattccttaaactgtggcagtgcacctgctacaaaacagttctatggtgttgtctctatgttaaaaatgccatagagacacatgaaaaaagaggttaaaattaataatactttcttactaattctcatttaataaattttatattaattcccatattatatgaggcaaaatattttattctttttccattagataaattatgactacatgattccaataaagtctagagaaacacttttatcctgttctcttggctttgaaaggtgtcaagatataaaatttaccctagagggaagaaatgtcaaatatgtagacgctttcattgtgattttttttgtacctcctatattatttacatttcttgtcatttatattttatacataatatatttttaaatgaaatttaaacttgaaaaaattttgattgctactgctgtctgtatttaatcaacaacaaagacacaaaataaaatgagaaactcgtttaacatatatatgttctaggtagttttgaagagctaacatctgatctgatggcagatttctgactcagagattaaaatattattgtgaggagttctactagtgtcaagtttgagttagggtattcagacaaatattaacactgagatcaaattgaaagttggacaaaataataataaagttaaaggcattgaggagtttcgaggcattgaaaatttgtgacctaaaatctgggagaatagggataccaaaagttaaataagccatttggaactcttttagcttagaggtatttgctgttttcaaaaagtttgatagaaatgctgaggagccaaaaacagctatcaacaacatcatggaaacaggccaaaaaaactggagttcaaggaccacaagggaggaagggcacggatcaactcccagcttttctcttgggctctacaaagctacaagccaagagtaagagtgaacattaaacagaccatgcctcacaagactgaagctcagcttagaatcattttgatctctgattggattaaggtgatcagggatcctaagtacccctgcaggaagatagcatcatgtaatgcttcaaaccacttggatagcatttcatatacaatatctagcactaaaaaatgatcagtgatttgaaaagacaagaacatgtggcagaaaataaaagaaagtacagacaatataaataatagagagatggatagataaaggaaatagaaggtgcagattataagtagctgaccaaaaaaaaattagtgaactagaagatgagtcagaacaaattatccagactgatgtatgaaaagacaaaaggatgagacacccagaaaaaaatgatgtatgtcagatacagtgcaaatgattacatatatttgggatcccaggaggacaatgatagtgacaaagaaataataatcgaagggataatggttgataattttctaagattgtttaaagttatcaagccacagatttaaaaagtactagaggtttaggaagaatacattccaaaaaatacgcctaataacaccatgttaaaaagttgaaaagttcagactaagagaagatccttaagagagagagaaaataaaataaaaccgagaccttccaaaaagcaacaataagaaatgaagctaacttctctgcaagattaatgaagacagaagataatgaaatatcttttttttttttctgagacagtctcattctgtttcccaggctggcacaatctcagctcactgcaacctctgcctcccgggttcatgcgattctcctgtctcagcctcctgaatagttgatgagattacaggtgcacaccaccacgcccggctaattttttttttgtatttttagtatagacagggtttcactatgttggccagactggtctcaaactcctgacctcgtgatcctcccgccttggcctcccaaagtgctgggattacaggcatgagccaccgtgcccagccagatgatgaaatatctaaaaattctggaaagctggggaataagaaaccatcaaactaaaaatatcaatatccaagaaaaagatatatgttaataatacattgaaataaatacattttcagccaaacgaaacctgaaagtttgtcatcaacaaaccttcagttgaagaaataaaaacattcttccttcagaaggaaataatctcagattaaaatggaaggtttattaaacaattaatatatatatgtgagtaaattaatattaatttaatgtatttatatatgtattatttcaggacttaaatatatataatatctatttttataatatacagtgcaattgtaataaaggtaattaatatataaaacaacaagaatatagagttaggaaaagctaaagtagttaacatagttaatgtctttgtctcatccctgtggtatgtgtatgtgtttgtgtgtgtgtgtctgtctgtaggtgtgtttaagagtaaacacagtaaaagttaaggatacatgctgtattctttgaaaaatcacaaaagaattgtaaaggaatatatactgatatggtttagctgtatctccacccaaatctcatcttgaactgtagttcccataatccccatatgtcctgggagggcctggtgggaagtaattgaatcatgggggctgttaccgccatgctgttccccataatagtgagtgagttctcatgagatctgcacttctctttgctgctgaaggaaggatgtatttgttttctgttttgccacgattgtaagtttcctgaggccttcccagccatgaggaactgtgagtcaattaaacctctttcctttataaattacccagtcttgggtatgtctttattagcagtgtgagagtgaactaatccatatacctatcaaacagaggggaaagaaaataatttaaaaatatgtattaaattaataaaaaaatcgaacacaataaaacaacaagaagaacattaaaaaggcaggacaaatttaaacaaatattaaggtaatagactaaaatccaaatatttcagaaattacattaaatatgaatggatttcatactcaatgacacatctttccagatcagataaaattaccaaaaaatacaatatgtttgtgaaaaaaacacacatgtaaatataggaatatcaaataaatgaaaagagaaagggtgtaaaaaatatagcatgttaattctaaccaaaaggaagctaatgtagttattttaataactcacaaaataaacttcaaataaacgtggataccagagatgaagagtatttgacagtgtttcatattttactatatattatatagattttattacatatttgtcttagtcttggctgttataacaaaataccataggcttggtggcttatgaactacagaaattaaaattttaagctctggagaatgagacattgaagatcactgtggggtgccagcagattcaggcgctggtgagggcctgcttcctagaatgcctctctctggggtctgttagagttctgatgatctagttacctcccgaaggccccacatcctaataccatcaccttaagggttagaattccagcatatgaatttgggaaatataaatgttcaaggcatagcaatgttatatattttatatattgcatatttagtatatatttatataattttattttataatcaaaagtttaaaatcatcaagatgatgtgacatttttagatttgtgttgacttgttaaagtaactctaaaatgcatgaagaaaaaatgattaaaataaaagtgcagaaaaattcctaattatagtgaaaattttaaatatacattttccagttactattggatcaaggacatcagagattctttaaacattttcaacacatttgataccatttaactgcatttagtacagtgaaatcatccaataaactacaccaggatacttactcttttcaaaacacaaaattattatatgggcacagtgctattaagctagaaattaatgtctaaattaacattggaaatttcctacaaataagacattaagaaattcacttgaaataattcattaaaaagaaatcagtaaaattagagaatattttaattgtattacaaatgctaaaaatgaaataagtgacgcataattaagccacagttacagaggcaataatggtcagaaacatatattttagaaaagacagaggctgaagatctatttttaagtattcatcctaagaaacaagtaaaagaatagttaatacatgcaaaggaggcagaaagaaggaaataataccatagaaaggaaatcagagaaaagtaacctacacagagatgttgaggaaaataagaaaaagaaaagcaataatcaataccgtgaatggtaaaagggcaacatgaggatctagtagatattaaaaatataaaaagattttgaacaaatttatgcaagcaaatttaaacgtttgaatggcatggacaggttcgtagaaaaatatagcttattaaaatcaacacagaaaaatggaaaaatttgaagtgtttattatatattaatgacactgaactcataagcaatgatctaccaaagataaaaattaattccaaaagctaaactacagtttatcaaaatcacttatgaggttagcataaccttggaaatcataagacatctcacccatgaatatagacgaaaattcctacagaaattactaaactgtatctagctatctatgaatataaatttagttttaaatttaggtgtaaatataaattaaaaatataagttataggataaataaatcacaaccaagttgctcctcaacctagaaatttaatttcagcttaactgtaaaaaattaatcacggtaattcactgtattaacaacagaattgaggagaaaaaaatgatcatattaatagatcaagctaacgcattttataaaatagcatctatataaaattaaaaaactgtttgcatacttagaaaataatagctttaatctgattatgtttatctccaatttatctatttcaaacattacatgaaatggtaaagtattgaaagctaatgtgtctgggattgagagggggctaccacctcttctattcaaatttgtactggaggatctctgtagtatgaaatttatgtgatacaagtaatgtgcataataatcgaagagaaaaataaagctcattaacacagggtggattgaaaaaataatttatgtccacagataatgatagttaaaaataagcctctggattcaagatgaacaagcaacgtcaaatgtattcccttatgtgaacaacaagcagctattgaaatgaagttcaaaaagatatagtttacattagcaacaaagtcacatttatgtaaaaataaatgtaacaaaagatgttaaagaacatttgcattatactgcattgtaaaaatattataattaataaactggaggtttacattagatagaaggaaaaccatatttatacatgggaagagcaaatatttcaaatatgtaaattttcttcaaatcaataaattaacataaccataataattgttcaaccatttatgtctttgagcatatgtgtgtgtgtgtgcaagagagagtgagacagagagagaaagaaagcatatgtgcaaaataactgattctacaatttacatgaaatttcaaaaggacaagaatagacaaaacatttttaaggagaacaaagtgagaagacatactctaccaaatatcaagaactattatgaatccacataaataattcagtgtggtaataatataataagtgggaattggaccaatgaaacaaagaagagagactccaaagtcagattcatactggtatgaacactttatttatgataaaactggaactatataatatcaatggaatatatatgtgtatgtatgtatacatacatatatacaaacacacatacacacacacatagttatggtgctgagtcaactagctatcaaaatcgaacaaaaaaagagaaaaaaagaaaacccctacctcataccaaatacaaatattaaatcccagtaaattctagatataaaagtaaaaagcaaaccaataaggcatagatattataggagaatatctttgtgacgttgagaaaggggaatatttgttaaacaatacacacgaaaggccctattaattataaagggaataatgattggtctacaccaacatttgaaatttctttacattaaaagacacgactgggatagtgaaaatgtgaccaagagagtgggagtaaatacctgcaacatatacaacagtcaaataatttgtatttaaaaatatataaataaatcttactaacacaacaatgcaattaaaaatgtgcatttgacatgaatgtatgcatgcatacgccctgatggataagaatgttgttaatggcacaaattatattagcccaaatctagaaaaattctaacatccatcaactgtagaatgtatataagcattcacaaaatcgagtataatatatgcaatgaaataaattgtaactctatgcaacaataaagatatgtatcacaaacgtaaggttgggtggaagtagctgtacacaaataattgcatgtatttaattccatttatatacaggtcagaataggtagggaatcaagatagagggtatctttgggaaggcaactggtgatggagccaaggaagaggcatgaatggagtttctggattgtggacagtcttcattatttttgacttgtggtcatctttgtgaagctacatgtataaatagacctatttggggtgtgttccctggaagcagagcctggttgtgtgtgattcattgagacagagctcttcaaggaaagcagtgaaggaggagagggaaagagaggacactaagaaggatgcagtgttagtcaaaggtgagacttaaataggagttgacttaactcatccaaggtaaggctctggaccataactcacatccccacctgccttcagaaaaggggcagacacttttagccaatgtatatcagttagtagctgagcacacatcctcttcagtgggttgctgctgaggattatagcctctcctcccagctaacccctggtcaattctccagagagggaccagtagctaggactactgttagcactcagatgttaaagcagcggagaatgggtatccccgatggtgaagcatagagcaccaaagcatctatcaatgacatgaaccctgttgttgtggaaattacatattcaaatgttctcagtattaatgccatgggctaaagtcatgaatctcataaaagagcactatccaaagagcaggaacttgctaatcaggtttacttagggatattcctcatccacagcctctccacagtaaaccaaacctccaagcatttttctgaatgcttttttttctgtccaatggttgattttcaagaatgctccatcccgtctttatcatgtggatgcctccttatgagttttattaatttcatcatctctggcatccattgactaatgagtctttccttcatgattttcttttctgctgggtctgcagaggggacaagtgtgcatggatctgttggtatggaaagaagaaagaaggatagcgggggcatctcactatgaatgtattctttcttaaatctttaaaatgcaaaatgcttaatgtctcgaagaaaacctctcatctaggcttgatgggagtcatattctgccattaatgaaacacaaacatccctccttccctcaccttgttacatttaaagagactgaatttgaccaaattactttccctgaaccataaattgcttctctggccacaaacaggaaaggccatctcatttatccacaaaaacatttctttgaactttgaatattctcatctccgatataatgtaatgtgataaatctcacattgagggaggttaaaattatagaaggtatgggggaattaactttccctttagcatggtgggagatgagactaaagaggtgtaataggatgatattattgagtgtcatatttccaaaaacatttattaagcacctaacacttactagacattggaactacagaagtaaatattttctttgagaaagatattggaatggtatattttactcttaatcaatggccatattaagcaagatagtcatgttgttctgtgtgtggttaagatgtacaactccctggataaagtgaaggatagatcggccgggcgcggtggctcacgcctgtaatccagcactttgggaggccgaggcgggcggatcacgaggtcaggagatcgagatcatcccggctaaaacggtgaaaccctgtctctactgaaaatacaaaaaattagccgggcgtagtggcgggcgcctgtagtcccagctacttgggaggctgaggcaggagaatggcgtgaacccgggaggcggagcttgcagtgagccgagatccctccactgcactccagcctgggcgacagagcgagactccgtctcaaaaaaaaaaaaaaaaaaaaaaagtgaaggatagattcagtggtgggatggagaacagaaaatagagaatcattgagcattacactgcataatgcaagtagacagtgatgagaattgaaaggatggtgaaattgcagctgagagagtgatagaatacagacaagcctgggcagggaaattcaatggattttgtgatgaacttaagggaggaagtgagaaggaattaaatgatgactggattgctctcagatttctctccagtgtaacttttggtaatgttgaagggcatgtccgtgaaggtaggcagaagaagagatttaaggaagaagatgcaggatttgatctgtggtaaccagaatttgtgatacttgaagaaaaagatgtttggcatatttaagaattctaaagctctgctgagggaaatccatcaatcacttttttaaatgtattctggaaattacctggtttttaaaaattcgatttaataataaaaatatggttcatataaaatgttttatagttgataactatactgacatctacaaaacttgttattttccagtgctggcaagtaattttactagcttttaatcatgtgaatttgttttaattatcactgtagaaaaagaaaaacgacatccaaagagggtatgcgactgtgtcgagttcaacagaagaatgaggactgcacaattccatctagttcctgtttgaaagctcttttgtccacatgaccatttcccttatggactctccttctacttttgtgggattgtttttctaattagaaaattcattttagcagtattcttatcattccaaaagttaattacccgtgcactgtggcatgagcttcatatctgttgaatttcttcacctttaataaagatcattaaaagggaattagtggcttacttgtaatttctaaaatttttatatacatgagctcaaaacaatcatagatattacctcatattacaggtgaagaaatagagccacaaagaggaatcaaatctaaaacccatattctcactacactatggtattaaattattctctcatgttaaggtcaagacacctattatgtatctcctaactctggctgtcaaataaaaatcagctaatacacgccactgtagtggcaaacaactacccttctataattcattcttaatatagtgacattaagctctaatcacaaaaatcactaaaatcaagtcagcttccagtttatcacaagggaacataatttcgtcatattattcagtaggccttttttgatactctcgcacacacgtgacacacatgtgagtgtgcacacacacagacactaaaagaaatatagttcttaatatctcttctaagtagccctcaatgatacagtacacacatttaaagtaaaagaaataaagttagaaaatgcaaacaatacagaaaaatgcaaaattgcaagggaaattatttaatctacctcatacctaagacctctttccaaatctaaacactgacaatagatttttccattacttctttcataagcacatatccatatttatataaataggcatttgtttatatacttatatatgttcacacacatttattgtctgtttagtaaacattattatactatgcacacttgttttcctcacttaatgtcagatcttaaaagatatgtttctaacatatatattatgtttgtctttgggtcagcataattacagacatagatttagagctgcccaatccagtcatattcagtatcacattgtctttaaaacagaatagattttctagttaagtgatttttaacattcacacattttcaggaaaacatggttagttgtttttaaatatatcttctccctttctaagattaaaacctgctggcccgagtaatttgaacacatcaccaagaaataattcaatataatttttccaaaaaccaaaaagtatcatcactgcaaatatagtatttatttatttttttagaaggagtctcaggctggaatgcagtggggcgatctcggctcactgcaaactccgccttccgggttctagcgattctcctgcctcagcctcccaagtagctgggactacaggcatgtggcaccatgcccagtcattttgtatttttagtagagatggggtttcaccatgttggccaggatggtctcgttctcttgaccttctgatccgcccacctctaccccccaaagtactgggattacaggtgagagccaccgtgccctgccaaaattactgtttttaaacatctataattagtatttctactctttaatcatttttaattttacattctgtatttgtgcttttttctgtattccaggaaattttgctattgtcccatagatttcactgttatccatgcaaggactacattaagtggaaggattctaaacattacctttgagcacaatatgttgataaattttaataggtttaaataatccatgttgagtagctgtatatatctttggttgcatcactgattatttaagacaaattctttgaagtgggattattgagtcaggaaaatgaatcccaatgttaagacacatcagagactttgatgtaggggtatagacagtactgatgtttttcttgttgaacaagttcctctctatgaataatgcacaaaccactgcttgccaagtagaaaaagtgaaatgccactgggaaatgaaatacatgggtagactgaaaagaggaagtttttgagatgtgttagtggaggataataacttaaaattaaacatctatttaaaacagaaactttgatggtatcgtgtggaattctgcccaagggaaaggaagagtaaaggagaagctggacatgcacaatattgctatgagcagaaaccctaaaaatggtctggggtgtgaggcagattgagtagacaatcctagtacatgctatgggttaaatgtttgtgcccctgccctgcctaaaaatgttcttatgttgaagccctcatccccaaggtgatattatttgaaggtgtggtctttgggaggcgattcggttttcatgaggtcatgggtgtggggcatccatgatagggttggtgccctttaagaagatttctgtatccctcagcccatctccccactggccaccatgtgaggacataagaagaaagaggccataggtaagccaggaagagaggcttcaccaagaatgggaccaggctagcacctggatcttggacttccagcctccagaattgtaaacaattgttgttttagccacccaacctgtagtattctgttacggcagcctgacagtatgtaagctgggagcaggatacactggacaatatggtgggagagaagatactcatctcaatctcatgagttgtgctgggcttcggcaatgcaacagggagaagctccaggagacaggctgccctgaaaagacagatgagtgcacatgactccatcagcggaggacacccagaactcgctaatgccctcttagaaaatgccgtggagggagttcaaatgaagctgcaggatttggctgtaggatcctgagattatgtgaaatatattatgacagtttacactgcagggcttgctagaagtggatatttccactgaatttgaacagtttgctgaacagaacataaagaagatttggccccagagggttgaagcctgccaaggagggaagaaaaaagaaaagagagacatagcagcgaaggctgagctgaaagcagcatccctgtcttcctccttttcttacactccaaggacagcaccaactgaccagctgtgtcatcccagcagcttctaaagtgttctcctctctctatttttataagaatcacacaatgcacagcactacccaggccatgattgctcccagctctccccacaatgattcctccatccaatgggcaccacgtaggtgtagcttatcttagtcactttgggcagcttgaacaacagacatttatttctcacagttctggaggctggaaattcatcaaggcaccagctgatctagtgttggataacggcccacttcatgattttcagacaatgcttcttgctgtttcctcacatggcagagacagacgcagagagaaagtgagctgttgtgtctcttcttataagggcacttgtcccaggcatgagggctctgccctgttgtcctaatcatctcttgaaggacccacatttcttcacattggggattaggatttcaacatataaaacaaacattcactccataacacagcctctgctcaatttgaccaatgttctttttttctgtttgcaaatggaagggttgcattttttcatgaagatttatcataaggacatgcacaataagagaaataatttggagggtggtttcttgtactgctgtatgtgaataagtaagtgttgaaggatactcttgtaggtctctccttttgtgctggtaagaccttggcatactgtcttcctaggctctacacagatgatgtggacattaaatatgcttagtttcctccttgcccccttgggctcaatctgtccatttaagaaaaaatgaatgggtaacgtatcatgagcgctacaatttcttgaatttagaaaggtatgcaaagacaagtaagaaaaacgcaacactctactgttttaaaactattttgtgaattttggaggactaatacagccagaaattaaggtgtaaaaataagagatgtgaaaacctttgacaaaataagaagtagaaattagaaatgcaaaaaaaaaatactttcatatcactggttttttccattaaaatacaatttttccattgtgggatattttaatcaaaattacaccagggaactgaaatgaaaccattagactgtagtgagtttatttatctaaccaggggatcacaccagtttcaaagcaattttgttgcattttcatttcttgctgtgtcatgtcgcatatcagagatgcaattgaaaatgaaattatctgtaaccatgtcaccttaatagtatttatttaaaatgcaagtgttcttctctggcactttattaattctaagaatacagtatggtaattttaactaaggactatgcataaaattaaattttaagatgggctgaaaatccagttggcaagtaatgggatttgtgagtatgcatgtgtaacgagtagcacacatagacacactgcacccaggagagggagaattctgaaataaaggatgcttagttcattttgctctctcaaaacagcacactctgactgaatgggccagagtgggtccatttgcctcatttacctatatggaaaaaaaatctgaagggttcctttaacatgtaagaaactaacagctggggttctcaggagtgaataatcttacactgggatgttaacaatattcattttattaaaccattaccttgagcaaaatatttacatcaaactacaaagaacacggagtcagaatttttttttagaaaaaatcaggtacagttcctcatcactgcttctcagctggacagaatctctctccaggatggctgtgggcagaggctcatccacactgcggattctctttacttgagcatgttttactttctgcagcttcttatctcaatgtcccatattgttgtcatgtacacaagtctgctcaaggttcctgtgtatgtgttggggagtaggtgtgtgcctgtgtttgtgtgtgcatgcctgcatgtgtctctttgtgaatgggtgtgtctgtatgtatatgtatgcctggacgtgtctaggtgtgtgtctgtgtgggtgcatgtatatatgtatgtctgggtatttgtgtgtatgtatatatgtgtgtttgtgtgtaagggtgtgtttctctgtgtttatgtgtgtgtgcatgtgtgtctgggtgtcgggggtgtgggaaggtggatgtggatgtgcgtttgtctctgctgaaaattttaatccacttattacataaggacttgtccaatgctcattttagttatcatctttctaagttcatacccggagatttttgtttacagtaaattacctcagcaaaatgcttccaatttatattaattctcacttctgtttatttgcacctgtaaattttctaatgaaataatttggagctctagttttatgtgcgtgtttctgtgtctgtgtgctgataggaaagatattttatttcgaattggaatatgagcaaaaaagggattcccagaggcctggagccccagtgctgaggcacctgctttgtacaatcccattacacagctatctggcctcagggaggctgggactggtccaacctaatcatcctgccctcagtcttacatgcactacaatatgcttctcctgcttctttgtcatttgaaaactgtagtgagggttttggcttaagtgaccctgcctgacacacaagtgatggcattaaatatactttggactgtgttatgtaggaaacccttatccaccacatctaaaaactttgaagtcctaaaaagctcatatagcaaagccaaaaagtgctatatttactcattttaaatttttaaatggccaattactttatataataataacattatggaagctggaaaagaaaatggtattaaaagagtgagagaggctgggcgcagtggctcacacctgtaatcccagcactttggaaggccgaggagggtggatcacaaggtcaggagatcagaccatcctgactaacacggtgaaaccccacctctactaaaattacaaaaaaaaaaaaaatatatccaggtgtggtagcgggcgcctgtagtcccagctactcgggaggctgaggcaggagaatggcgtgaacctgggaggtggagcttgcagtgagccaagatcatgccagtgcactctggcctggtgacagagcgagactccgtctcaaaaaaaaaaaaaaaaaaaaaaaggaatgagagagaatggggggaaaggaaaagagtgagagacctcaattttataacaagaacaaaaattcttagtagcaaaaactagaaaagatagctcaaaaataaaagattattcctacctaaaatctccatgtgaaaataccatatgagaaaaaggaaaacagaagaatacccgtggcgagcagccttgaagaaggtccttaatgactccacctccttaatgaccccacttcctggcaaatggccaattattccatatcatagtaacattatggaagctaaaaaagaaagatattaaaagagagtgtgaactgaattcagtgactcacttatgaatagaacacgctggaagtgatgagatgttgctttcatgatgaggttacaaaatacccaggcttctgcctcaggaggcctctgtcttgcatgcatgagtggatggtggcggttgccatgtggggaggcccatgtggcatgccttgggaggcccatgttgggggaactgggacagccatctaggaaccgaatcctgctgaaaattacttgagtgaggtcagaagcagatgttcccccattccagttttcagatgatcctgcagcccctgttgaaaccttgactgtaggtttgcaagagaccttgagcagaggcacccagctcatagaactcccgggttcctgactgacctacagaaactgtggattaaatgctttttgttataaggaacaaagtttttgggtaatttgttatgcagcaagagaacattaatacagtacattatccttcatgctctaatttatctaataaattcaaggacttggaaaattcatcaatttattcactgaacaaggcaaattgtgtagcgtgtaccatacgctatgtgaaagtgagataagacggtccctccctcagaggccttatgttgtaatgggaaagacgacctacaaggactttttgggaaacttcttcctgacttgacctcacccaatctggcttgattccacttcccaaaatgcaaactgggtcccttcccactttatctctcaaacatgggtgctctctgtgtgatgtatctaacttcccaatgtgggattgggttttaggttttgaaatccagggtcaagacttcagagacaaagggtctattcctggtcctgagatgctgtgaagccacatggccaagcaggattttcagctacaaagtgtcaggtttgcttggtatccattgagaactctgaaaggattaatgagaataatgtgaagactcacaacatgattcagaagaaaaatgcagcatgacaagtattcttatgttcaaaggtaacctattttttcttaaaatataccacagggacataaacttttgaaaaaagtgtatttttgatcttttttttttttttactgtaatgagactggtgaacagctagcaaaaatccaggatacataactttttcatcatgatgccatggtgtctcaagccctattcaaaactcatctccatcacacattgagctaatgatttggggccagtcttttgacctaaacgtttgagccttagtttccgcatctgtgaagtagacatagtaatccctgccatgtcacaccacagggtttttcagtggcccccagcacttggcaccagagcacctcctccacaaacagatgagggatgctgtggaccaggaaggtgtgggaaccaagcttgacaagcagcttaaagtctgttgggaatctcttgctttagagcacacattactgcagaatttgctttctagcctgtgtacaatatagttagtacagctatttccctactttggggaaaaaattggtatcttaagaagatgtgtgataaccccaagtcaccctaaatctcagtgcagcagcacatgggcacctgctcattttgctctgtcaaagtccagtgaacactgccaagtgtactgggcagctctttgtagttgccagccacgctgtccagcctccttccacttcacatgcctctgtgtcaacatatttctctagcagggataaatcaagttaataaggtgagtaccaggattaaatgcttctatatagaagggagacacatcacttctgctcctgtttcattggccaaagcaggtctcatgtctactcaacatcaagtaaatgagcagaaggtccaagaattagtgacggactgaatttggtcagtgaaagaaatgcccaccacatgcatctggatcctccccccttcctctgaaatctctgtatgaaggttcaagcagagttcattaccaaaacaaatgcaatcagatttatggccaaacaggatatccagacctggtttctccttaacacataaagcatttgctgctggtatgaaagtgcctgtcctactcacctccctttgtttagaccccactgcctttgcatccatttctagtccctcctagaatgctctttatgctccccaggagtcacaatggaccgttaagccaaagcggagaagatgtgctgtccttgcctctcaccgttgaagcctgggatggggagtcttcacatccttagactggggtaccttctgaacaaaaactcaccagaatgccagaaccactctgtactatgatgcagacatctccttgttggggagtaaggatggaaagaaaagcacaaaggaagagcaaaaggaaccatctatgtgccctggcattcactttaagggaaaataaggtataagtgaatgcatttcctcaaatttcatttatcattttatatgttaatatgattgttagttgaacaaggtcactctgtctgtgagcaaagtaccataatgaatcctggtaaaacagtgaggttgacactatcccatgccctctggctcttgcttggggctctccaactgcattttaaaacttctataaaatcctacttatagatgccctcctgtagcttttccatgcactggaccttgtactggttagactcatcagggttcagtgagggacccatgcagaaatacctcggcaatgggcagatatatagacgtgaagaaatgtctttcagctatagtaactccaagactgaaatttacagcaagtcttacacaaaacaaggtcagtaactctgcatcttcggtatatagtgtggttactagacctctcctgtctttggttactcaccatttaaactccctcagacattagattaataaatagatcaaaattgatatcagtaaggaaactatagagctccagcaaagttctatatgacaaaaggaaacatataggataaaaaggaaaagtgattaataaatgtattaaaatttaaacctgctaatattcaaataattaaaactataaccacagcatacatgtttatcaaaatggcattttcttttttttttttcctttctttctttctttctttttttttttttgagacagagtcttgcttaatctgtcacccagcctggagtgtagtgacacgatctcagctcactgcaacctctgccttatgggttcaagcaattctccacctcagcctcccaagtcgctgagattacaggcatgtgccatcatgcctggctaatttttgtatttttagtggagacggggttttgcatgttggccaggctggttttgaattcctgacctcaagcaattcacccaccttggcctcccaagctgctaggattacaggcatgagcctccatgcccagccgcaaaatagtcattagtagctcagatgggagagggtaagggttaaattagagtagtaacctttgtctgagtcacacgcattgtgtaagagagagaagagtaaagctcctcttgtatgtgtatgagacgaggtcacagaggtcctgtgaataaaatcttccgaagtccctccctcatggagtgtcctggttgtgtagtgggaggggcaccatgattgagtcccttgttggctaactcctagagccattggtctctaaccatatttcactagactgtaaattctactccaggacatacattgatcttataaatttggcattccctgtgcataattcagagtctgccacatagtagggatgtctgtgaataccaatggagaagtttattatcttcacaagcagtgtgattcttcatgaggcccaaaatctgcctacatggaggtgaaatgtaaatttctgtaattagtgttaaccagtctgggacacatgttgttgccacaatgtctaccacaggctgccctcaccctctttctcccttggctgtcctcctctgtgaaggtgagcaaagccagacagcaatctccttgcaactgatgaggagagatgaggcaaatgattggcaagggagtcttctggggtggagcggagtttggagttcctccaaagattctttcttgcaaaaaaaaaaaagcagcagcagcccagggaagaacacttctgtcctgcactcttcctagtctcctgtctttgaatgtgattgtggacatgaagcccaaatttatggaaagacttggtaatcataaatgctcatatcacctaaatgccaacccagagcacaggccatcaaacagcagcagctaccttctcatagatgtcttgctataggagagcagtaatgccatttttgatcaggcattctgatacttgtaaataaagcattccttattggtgtcatatcccacatatttataccatttactcctctgctgggcttgggaaatggaaaaccattcatctgtttcttcttcttcttcttcttttttttttttttttgagaaggagtctcactctgtcgcccaggctggactgcagtgctacgatctcagctcactgcaacctctacctcccaggttcaagcgattctcctgcatcagcctcccgagtaactgggattacaggtgcccaccaccacgcctggctaatttattttttatttatttatttatttattttttaagatggagtctcactctgtcaccaggctggagtgcagtggcatgatctcggctcactgaaacctccgcttcccgtattcatgccattctcctgcctcagcctccaagtagctgggactacaggcatgcaccaccacgcccagctcatttttgtattttagtagagacatggtttcaccatattgagcaggatggtcttgatctcttgaccttgtgatccacccttctcagcctcccaaagtgctgggattacaggtatgagccactgtgcctggcccctctgtttcttttaacactttatttaaatgctgtgaactctcagttcaaaatgctttagtacaggggtccccagttcctgggacacagaccagtactgcttaagaaccaggccacacaggtgagtggctggtgagtgagcattatcgcttgagctctacctcctgtcagatcagtggcagcattagattcccataggagcaggaaccctattgtgaactgtgcatgcgagggatctaggttgcctgagccttatgagaatctaatgcctgatgatatgaagtggaacagtttcatcccaaactactcccctaccctgtccatggaaaaatcatcttccatgaaactggtccttggtgccagaaagtttggcaactgctactttagtagaaccagaataagacatatcagttcatttttgcttctactcacctgacatttgtttattgaatacatgcttcttacccagctctatgctaagagctactttacttagccttcctaacaagctttacttagccttcctaacaggctaagtaaagtagctcttagcatagagcttggtaaatagcatgtgctcaataaacttgtccattcttctaatacatttatgtcctctgtacatcaatggatctgaatgcacatagtatttctcttgttagtgtcatacaagtagtagcctgaattcaagaagtctcatgagagacatcatttgccgtagacaggcttagcatacttagccttcccttttttttttttttttttttttaaagacggagtcttgctctgttgccaggtggagtgcagtggtgcaatctcagctcattgcaacctctgcctcccgggttcaagcgattctcctgcctcagcttcctgagtagctgagactataggtgcccacacccagctaatttttgtatttttagtaaagatggggtttcactatgttggccaggatggtctcaatctcttgacctcatgatccacccacctcggcctcccaaagtgctgggattacagggatgagccaccgcgtacccttcttaacaggctaagtaaagtagctcttagcatagagcctggtaaatagcatgtactcaataaacttttccattcttctaatacgttttgtcctctgtcacatcaatggatctgaataaacacagtatttctcttgttagtgtcacatagatagcagcctgaattcaagaagcctcatgagagacatcatttgtcacagagaggctgactgtggaggcaggtgtcccctgtgaggatttcaaaagcactaggaatgacggatgaattttccaactttgctgtgattttactgacaagtgaattttcaaaggcttgtctggtatctgctttgcagattttccctttgcttttttattttttatttatttattatttttttgggggggttaatacttttaattacatgattgtaattatacaatttccactattcgatgttttgtataaaaccagttacaacccacaagattttcaaacgtgacaatatgtatcaaactacacacatacgcaaagtttacaggccattaggaagctttatcttaaaaataccttcaggaaaataaacattcattcaaccagttctcttggctttaaaaaatatgattagaaatatacactgtaaaaaataatcaagacaatgattgatcaatactgatcagttacattttaaaacttttaatctgtacatgagtgcaggttagataaaagtctgcaaattgttaatagaaaactgcagtactatcaccggatgaacatgtctgttgacaattttaccaggtaattaaggaggtaatttcctacacggtataggtgaattgtccagtctttaaacacatccggagtcatctctactcagtgacgaggagaataccctgatgtggggaaatggaagaacagcagctagcctctccagggcagtgtcagcgggagagaacatttaaaggaacaataaaataggtcttaaaagttgcttgtgatgagcactgctttccaaaatgcaataatgatttttttttaaatgtagaaagagaagctatgttaacaacagacatccaatgagtgcactgcttctgtggctcagatggtgactgggaaaagggagggctccaggagagccctcaggccatgcacaagcccaggacatccggcccagccccagcgagcacactggcctcgagcacactggcctcatgacaatgcttgggaactcctctaaaacttgcctaggcccaagaaaagagagaggtagcaatcacccctgtgagagggctagaggggaggggaggaagtaggtaggggacaggctaggggcatcaaggtcagaacggggaaatcctggaggccggcagacccgcgtgctgccgggaagcactggccacgccaggccattctgctctcatgaggagctgctctccaccaagttctacaaaaagccacgtccgtccctacttccaggaacccagttttgcagatactcttcctccagactgtcattgactcttgataattttgagtccccagaaagcttcaagggcacctaaaaatattcacttctaattttaattccatcgcaaactgtcccggtgtactttcagggctatttaaggctcttaagggaatctatctgacagacacagtttcatgttccatagcaacaaggtcttctataacaaggactctaatcccagaagattctgggtgtttgtggttttagttgggggtgaggggaagagtccactctcattcatagcaggaagaactttccatccctcagacccagagacttcttggattctagagatggtccccataagtctagagacggtccccgtaagtgtaacactgttgctatgcacaccatcccaagtcatttgattattacaaggaatgtttcttcaccaaatcacaaattttctatgactaatttcagtgagccagttaaacagaaggatttttagaaagagtcacagtgatagcaattctaggtggaaacttgagcaggcaacatgaagaggcagtttataaaatgaaaaaggactgttgttccgccaacacccttccttttctcagacaaaacaccaggaggcttgttcaccgtgagggagacagtactcacaaaagctgtggcacccacatttacttgttctgatgggatgaaaagccaaactaagaaggaatcagatggaagcacaattttcacaactacctggattactatttatgaaggggatggccttaaaacgggtaaggggaagaagtggtgccctgagaattcaatgctttatgcatggcacagtttaaatatttatattgtctcagcttaaaatagcaaaagtaatgttcctcctcccaccaaaatcttattgaagagtggtcttcccacagccaagtgggtctttgtgcctattcatttccagggacagaaaaccactgtttttctgtgatccagtccccagtgtttaaaagctagcctgaccccaccacatagtgcttggcagggaaagagtcacttgtttggctgagaatacggcatcttccgtctctcgtgatgccggtcagtttcatgctttcttccaagaaagtacaccaaaatggaggcactgcctttcaattaccttttgcattaaagactttaacttgtttattccaactgctttgatttcttacagttttgtgaaaaaggcagcttcttaaaatggagttgcctcctgatctggcgcacgccttgtgacttaggagggcatttgtttcccactgcctgtcaacatctcagccctccatgctcccagcacaggcaaaaatgggtttacaatcattaaaccacccacctcttatggaaggaactgaggtgagtactaaatattcttttattttgggccccatttttttttttttttagcagcaaaacaattctgtttctctaatttcttcatggcacagactctgctgtgttccagtagggttgcgggagaaggcactctgcagagttactagttgtgttccctagccaaaggcagcagtgagattcagaagcagatcattgttactgagatcacaggccttatcaatggccttaggctgatctcataaggaaaaaaaaatccaatgttacagagaaggactctaaaaaagcggtaacttttttttttaaagccgacattatttgagattgctgtttccaaggcgaaaaaccaatagtgtgttttttccatgcatggaaggaaatatgattttaatttgtatgactggcaaccaaacaatgggcaacctcccagttcttcagtccctaaaggacagaaaaaggaatgacttgcaacatcttccaactctgaagtcagtttctcctcctgagtcttctaaagctaccattaatattctcttgcaagttttaggttaccaaggtatcacctgatattacaacatgcaacagtgtttaaatgtggttttcacagattcttgttaataaagcactctttggtggaagacaagcagcttgggtacttatcagagttaatattactacagtattacaaacagtcaagtgaagatgataaagccaaatagtatcaaattacagaaagtaccatttcagtaatgccttttgtatctttacaaattttgacacagggtcgcaagctgaacagaaaataaatacataaaaaacctccatcagatcctcaattcttctgaaggccagcaactacaatgcttgccatcacaaggacacacatgcaccacagaccagccagctccctgggtaccagagggcttgggtatttacacctgagactaaatttacaacagcatttttgtcattcagcttgagagctgggcctttctttgagtcattctttttgggagcaagcccccaaaatccagccataaactggccccaaaactggccataaacaaaatctctgcagcactgtaacatgttcataatggccctaatgcccacgctggaagggtgtgggtttaccggaatgagggcaaggaacacctggcccacccagcccagagtggaaaactgcttaaaggcattcttaagccacaaacaatagcatgagcgatctgtgccttaaggacgtgctcctgccgcagttaactagcccaacctatgcctttaattaggcccatcccttcgtttcccataagggatacttttagtttatttaatatctatagaaacaatgctaatgactggtttgctgttaatcaatatgtgggtaaatctctgttcgggtctctcagctctgaaggctgtgagacccctgatttcccactttacacctctgtatttctgtgtgtgtgtctttaattcctctagcaccactgggttagggtctccctgactgagctggtcttggtacatttgcttgcacccaaactcaaaagttcattactgaaaccccagtggacattttctccattgattagcttcttaggtggaaagcaactaagtcttttgcaattttgttttgttttcaaattgtgctaatttctgttgcagttttcagttcctagagtcttccttcagttctggtcacaggtttttacttaatgcaaaacagttttagtccttgaaatggagagaagcagctatctgtcagggggtcctgatggctactatgttctgaaatcttcgagtcaggatagcaggatgggaagaatgtagtcacaaacaatccaccagatgacaacactacacagtgtaaaggtcagcacagccaggggagatgggagaagaatatcgtttgtttttgattgtctttgccttttcagggcccgacttctatcaccttgtgtcactccattgatttcgtcgtcatcaccgtaaggtttgggttcttgctggtcttgattctcgaccccatttatggaaatgtcatcaacaccagagagaagtttggagaaggctgctctgtgttgtccattctcctgcccctttaacttctgacgaaaatagtccccttccagccagaggcttgtttgcttcatcaccaaaaactgctgcggaggcccgatcaccaagccaggtctgcagatccttacccacgcaatggtctcggctgctgtcatcctgtaatgcttcatgatgtagcaggctatcagagtgcctgtgcgaccaaggccagctttacaatgtactgcaatggcaccctcagcattttcacagatatccagaaatcttttgacaatggcatcagtaggggtgctgccatctgcaaagaaaagatcatggtgatcgaagccagcatccgtaaagcgtttggcatcatgtatccttttattcagacgaataatggtagtaacattgtgattcttaaaatattgaatataagtctcgggagaatgttggtggtaaccactttcaagtctggctcttgaatgaggtccacagaaggcaataaatcggtctggtattagccaatttaaatctccgttttctgctttttcatagtgttcatattcatcaaggttaaatgagttgaaattaaggaagccatactgcattgccttctttactgcatgaaaacaggacacaggaaggggaacgtcacactctggggactgttgtggggtggagggaggggggagagagagcactgggagatatacctaatgctagatgacaagttagtgggtgcagcgcaccagcatggcacatgtatacatatgtaactaacctgcacaatgtgcacatgtaccctaaaacttaaagtataataataaaagaaaaaaatatttaaaaaaagaaaaagaaaataaaaagaagtgtaatgtacaaattgcagcttccataggcagcatctctgaaaggaatataggatgtatctccaaagattaatattctatatgctgcttctggggttctccccaagtatataaccatgtagcatccaacaaggaaggcagcatttgcttgttttctctgatcagagccagtaaaatgaacaattttcttccttaacattgtaatggactttaatttcttatttatcttgcaacaatatctgtaaaccatttgccagattgagtggtccaaagtcttcggagaagttctcatattcgagttcattatctatgctgaaataatgtacatttgatgcactctttggtctgctgtagagaatggcaaaacgaaggcgatcggtgatgtccaggtacacgtcgtcctgggggtcccagcggcgcgggtcctgcagcgtggagctgcgcatcttcttcacaccctgcaaggtcaaagagcagcgctgccagcagaggggcgcggcggcccagctcgaccgccgcttgcttttccgcttcctggaggcggccgcagccggtcagggagcaacgaccacggccccgcgcgcgcccgccgaggctcgcgccagcgccgcgcgggctctcaggacggcgggcacagagcggccttgcggggatggccggagccagcggagcccggaaggaggaggtggtgcaggagccagaggaggggcctggcccacagcgcctgccccgctccctcccgcaaccgccctccctttgcttttttaaaccatgaactgaagggctatatcatactgacatcaacaaagtgttagatgaataagtcatcatgctcttgtcatagcaaccacctggatcttaaccttctctccagtctctggaaattcagccaaataagtgttacttcgagtatgactttattaccaaatgacagtatttttgaagcactcatttaggatccattaaaagttggaggttttgaccatttgatattgaaagtcatgcctgcttggagacaagttaatgttgacatattgctttttcaccaactctcccaataccccaaccttggaaacatgggagcacaagatagttaaatagatagtttaaaagatggcatttcttttttctgttctatgtgggctttccaaagaaaagtcttggagaagctaaacaatgtgtgtagaagatcacacagggatatcacaagtgataaattttatacccagtgtcatcccaaagccaatatgcagcttcgcactcctcggcaacggaacaggcctctctccttcacaaaagagagcttcgtgaagcttcatccctaagttttgggttgggggtaaaataaagaagaggactgatgggttgttcttgagcttactactcattcatacatcttcttgccctttctgtttggtgggatttcccctaatcatttatatccttctggtgtccacaaggagacctaaattcccaattagataggctttatgaaattttaaaagtaaatgtatatattagaattagtttaggagaaaggagagaagagtaaaagaagataggtaaagattcatatttgtccttaaagattcaagcttctggatgccacaaatattttgattaatggggacctcaagaataattttgctcaccactgtcccaatgcttgccccccatccacaatatttctgtccagtgaatgcattgtattttcttttctccagtttctgttggaatacccgtatctgataggaaacacacgtctgaaggcatgcagtgaggatgttgatttcccttgccttttcttatcatttattaatagattcagaaacaatttactgaatgtttgctctttgctagagacctggttcttgctaagaaatgcaacctttcatatgagacagtcttgctcttggaatttgcttgtatagtcaccacactatccatgaacacttagacccctgtttataataattttaaaaatcctaaagacaactgattagaaaagtcacttcatccaggttgggccactcagatcccttcttctatgaggtaaacttgagtcccagagcccctccttattctctttggggtccccgagtgaaatgctcatgtaaaatttaatctgggtagccatatctgaaataagtgaaaggtaggctgagaaggccatgcttctaagaaaaagtaataaagcagactcctagagagaaacaacaatgattgaccacgtggcaccagagacgatggagactgttatctaccctttcagcctgaggtggtttccctctagttattggcatctgcttctcaagagatcttctccttaagttccggagatactatcttattcttccttccccagtcctcctgcaattgtctggctagtctgagagtgtttgtatctacaactcaatgatttctgcctaggtctttgttattcaggtagccacaggaatagactcttttgacacatctgaaaagatatgtccatggccgcttctctgtgggaggaaagtaaagggctctacttttctcagagaggttatttatttttcattgttgaatcccttttgctccttctacctttactgttgaactccaatgtgtgtggagggtgttgggcatggagaaagttttattttctcacccatattagctaccattttgaccaccatttctgcataagttgggatatacagacaactagaggaaggtttaaagagcagtctactaattgcctccaagatcatctaaactttacagagtcaaggctgtgtggaaaagtaagctattctgtaatgttggatcaaacaaaaggggagattctcactggtcatgcttattgaaaacaaaacccaacaaatgaggataactaaattacaatgaccaaacagggttgtcatgatgccacagttactcgcctgaaattcctgtacctttttacttataagaattccaggagctggtttcatcacaaactgataatgactattccaagaagtgctgtagcctttagccaatcatctgttagctcctttctgttgaccaatggtatttctggatgaacaggctgagaccaccttggtatacctcttcgttttgtccttaaaaatctgcttgtaaactccccagctgaaagcacttctctgacgtagtttgcatatgtgtttcccgggttacactcctcaaatttggccaaaacaaattctttacttatgctaattttgccttagacttttatttcagatcaacattatggatgccttagatggatgtgttttaggtgacccagttgttcaatgggtcgcctccattctttatctctttctaaaacctcttattcttcccttagtcttattcttttaagtctttcccccatcctaaattctagtcctcattttttgtctattttagttactcttccctaaatacatatccaatcccgaatctcctctgaattttatggtgagattattatccccagctcctcacagctgcttgtttatgctcctggggaaagagaaactatggcatcagtcatggagtcacctctgcagcctggctttctcccttccctttcgtttgagctccagctataagctcgttcccagaagctatacttgctttggcgcttatactcattctgttccctctatgtaaagtaaatattctcctacatttcctaactttgtagcttataatcctctgtccaaacttggtggttcccagagtacttgcatcttatttgattgtttggtcactgcacctgagaatttgccgtgtgtaattctgcataaagaaatactgtatggtaatatattcaacataccatctcacatgcttacctgatacatctgcttgtatggctgtgaagtttaaataacttaaaatacaaaaaaattagggctattggatttgggaaatacaagagttgtaaaatgactaattaaataatacaacagtaaatgattttatggcttctagttatttttcaagctggaaattatttggcatataagaaaatgcaagaattcaagcaagatatttgtcataaaataaaatgattaaggtggggatttcatgtggttctttcatttgctcctcttgcgttagaacaattcaggaggtttgtgcttatgagccgtttatgacacttaattcgtctttaaattaaggcatattttcactccaggattgtttttcccctccatataaaaataaaagacaagctttgtaaggcctatgaacagtttaactaagttgcttgcccttcatgccagtgacaagtaatgagtaagaactagtaggtgtcattgagaaaacagacattgtcactccagtgtcaatcaaaattatctggtagtgaaaactggactttaaattttaaaaataacgtgagagctgctagaaaaattatgaagaattgagtagggtcacagcactcgacaaatcttccaatttctctgccactggcttagtgtcacctgtacattttctagtctaaaagaatgtaatagcccaacagggtcagcagcgatatgcacctctcccaaatacatttctgtttacattcctgaggtccaattatgataacaatgacataatatgaattctaaacacatttgtattgttgatatagtaagaaatttttcaactaattagaaaactctaccttttaaaactgcacagttaataaatataacacatacgcatgtgctgctgtttctgcttttgttttttgttttagctaagagctaagtctatgactactacttcaggaatgtttgtcaatttaatatgagctgaggaccatcgcacttctagccttcaagcttgtattctatcaggaagaagggatagagaagaattggtagaaaacattgtatatctttgccgggcacatgtttgtagtcccagctatctgagagactgaggtagaagaatcacttcagcccaggaattcaagaccatcctgggcaacatagtgagaccttgtctttaaaaataaataaatacaaataagttttaaaataaaataaaacaaaatatgtgttttttaaaaaattgtatgaactcaacatatggctaattttcttcatttgtttcattattaatgaaattaaggaaatacaaatattcattttaatacagatttattacgtagaagtgtttgaacatctttacactatttactcttttatcacaaacccttcattgctttttattcttggcaccattcttaggaaaatggagaccacagcaccagcttctccctgcaaatccccatttgtgcttgagcagccaagtggttcacacttcttgccacattcagaagaaacttcattcattatgccagaaataactgagaaataatgagaatgtttcctataaagtctaaaaatcatactaaagaggggatccatttatactgctgttaggaattgaattgtgttcctccttccagatttctgtgttgcagtcttgatcctcagaacttcagaatgtgactgtatgagaataccggagtaggttgggcccatcatcttatatgacttgggtccccatacaaaaaggaaatttggatatctcaacctgaatgaaaaaaagataatcaatatataccaactttaaggtgaaccaaatgttaaaattatctaacaaagattttaaggcaggtgaattgaaaatgctccaacaaacaaccaaccacagatgaaaaatattaaaaattaataaacagcaatacgataaaaataatacaaataagaaaccagtatagtataacaactatttacattgtattaggtattctaagtaacctagagatgatttaaagtatacaggaagatgtgcataagttatatgcaaatactacaccatttttttgtcagaatcttgagcatcctcatatgttgatattcaagaggggtcctggaaccaatcaatcacccatggatacagaggaatgactgtacacagcaaaaaaaacaaaacaaaacaaaaactagaaagcgtcagcaaagaattaaacaattcagcaaagacacaaaaacataaagactttgagagaaaagaggagaccagttgggcacagctgctgtaatgtgataaacagctttgaaaaactaggtaattttacttttttatttgtggttacattagtttgctagggacaatcactttaatcatttttctcctgagtatgatgtccacctgtatttctaaaacaattggcttatgtcataatttcttgtttttcagatttttgttttgttttgttttttgagatgcagtctttctctgtcgctcaggctggagtgcaattgaatgatctcggctcactgcaacctccgcctcctgggttcaagcaattctcctgcctcagcctcccgagtagctgagattaccggcacctgccaccatgcccaattaatgtttgtatttttagtagagacagggttttgccatgttggtcaggctggtctcgaactcctcacctcaggtgatccacccacctcagcttcccaaagtgcttggattacgggcatgaaccactgtgcctggccctgtttttcagttttaagaattgtctgttgacttgctgctatgcaaaatgaggataccattgttgaacacacacacactcaccacctcctttcattttcccagggtagttttggattagagcaatatcctatgttacatttctaggataaaatgtatattatctgcttctgagtagtggaatatattttgagttaaattacttcctatatgcatttcttaaattaccaccttaccttatattttctcttttctctttcttttaagcttcttcattgtttgctatccaagttacagtctaatttgagattttctgaagattgatcacagtctgtcattggcattgggaaaagtggaatggaaaaagtctttttgcctttttagttttgtttccattttgaattccatacatgtgttattttgataaaaattaaaatgttgtaagagaaataaaagcaattactaggagcttagaagaagttaaaacttttttaagtacttgagattattatatgttcccactgtccaccgattttataaagagaagttgaggaccagagagactgagaaaacagcaccattccacagttaggggagccagggcttcaggccacatctgtctgacttccagtccaatctctgtgcaataccttaatgagaggtgggggaagaaggcaagggtgacatgggttggcatgctgtctgttcagaggataccttccaggcttggagaacaacactgtgataagccaccatgattcaatttgtagccagaaaggtaatccacgtcacaaggatgacagggctgaattacagagggctgggagcttctgtcaggattaactggtcacctgagtagaagaaaagacactcagctgtgaagcaaaatgaaacaattacgataagaaggccccgctcaggtttacttgcaactatgaagtactgttttctagacttgagcttagtttgggcaaattaacaaacttatatataaatgaacaaaggaagaccgtttcttgatcaaattagtcaaaatccagtgccatgtggcttccttgctaatgttagtttacttcaaaaaggggttatttatgctaatctttcatccatcaccccaagtcaattagcaaagtgcgcaattgcttaacaagtaatgcctatattataaaatactctctaataccttaagatgatgtatgaatgttggggttttatttgtacctctcactatccctttatgttacaggcaataatacaacaggccattaatgtctatttagtaattgcttgtttattaagcacttaactgaagtgcttctcattaacgggggggaatttaaataagaaaataataggaaaataaattgttgacaaatggatgtcatggcatatggctactgttgtcaaggcttgcagtgatcagcatctcaccttttttcttctttcacatacttatcacatttcttttgtgttctagtgtctgagctaggtgttgggggtgcagaaatattctacaagcagtccaaatcctgaggacacggaggaaagagccaccacctgtctgtcttcaggggaaaggtaatgctttagttaagcttgagtggaagttaagctttagttaagcctagatgttaagcttgagtggaagtttttccagcagaagagggtggaaaggctcactctgaaagggcacaaggctacaccaaggcttgtttcctttgcctctgaagtgtctagtcatcatgagcaggtcttcctatggcactaagtgttttatctatgaaaatatgattctttagaaatattttttctggtggttatgataaactcctttaagattttaatggaatataatttacttcacatatgtaggctctaaggcaagcttgtccaacctacaacccgcgggccgcatgtgggccaggacagctttgaatgcggcccaacacagattcataaatttcttaaaacattatgacattttttgcaatcttttttaaaggtcactagctatgattagtgtattttatatgtggcccaagacaattcttcttcttataatgtggccgaggaaggcaaaatctgaataccctgctctaaggctaacagatcttcatataaatcccaaatcctctgctctttaccatgtgacttcaatgtactaaatctacttgaaattgtctcctcattttgaaattataaatagcatagcctatgtgctagagttatgctgagtattaaatgatagaatgatagtaactagcacactgtttttcatctcattttgctttatttcatgtgactgtgttataatatctaatgtgaatgaaaaataaacaagatttggttctttgcaaagaagaaagttctaaagccttagaagttagtttcaagtttctatgacctttcagaaatgtattcatggatcaatagatacattgaaaatggatatttatgaacgtcattgcgtaagttcaagaaaaagagaaaaaagtgatattaacaatggctgaatgttgcatgatgtctttcctcatagaatcagagtcatgaaagtatttctgagatgaagaaatatttctgagactgggccttgatataagctgtaacaaggctaaagtaggcctttctctgggctagggacacattaagaatctggaaataatatgcatatagtagctgtttaggccacgcctggcaagtattctgggtatatatttcctttaagaacattaccagtgagattggcttgggtgctattgatttggctggcattcatcaaaaaaaaaaaaaatgaagaaaagtagacaaagaatttaaattaggggttagatctgctgaaaattataaggctgagatttcctttttcagtgaaaataacaagaagcttaattactaagttaggaatttctaatgttccctcaattccaatacacacacacacacacacacacacacacacacacacatacaacttgaagttttctcctccaaatacttacaatgttttataatttgaatgccactccaataaatatgttcctgaaactgttctgaatcttcattccagacccctctttagttagctgaacattcccaacgagtgagtaagtccaatatggtattgattgctgttttggtgttaggtattaaaaaagattatcattattgacaagaaactagtctctcactttgccctgttggacattacctgaattgtagccaagagtagccttcagaatctgtgtgtgagggtaaccatgaccttgagtagccatctctgaacactgcgggaaacaggaaaggaggcatgtgaggtagaagctcacatttttccacagcactgatttttggctgctgttcaccttgcagtctcttctgggaggcttcacagatccggataaatgatggtctctgctaatgttacatgttagaaaagcagactgggggttggccaggatagctgaccagaaacaccagtattataggtcacctactaaattccagctctaatgatatacttttggaataatataaagaaattttctgttacttaatggcaattgatagattgcttattttacttttatttgaaatgtttcagaaaaattccatccatgtaggctccaggacagagtgggctcttctcatgattcctctaaaataacctggcctggactggacactcttacctatcataatcccattatttcagtgtctggcctgtaagctgatatgttccataatgggcctgcacttagcacttctatgaatctcttagttcttgatattctttcatatttatgcatcattctcccctaaagctcataagccaccaggatggtacagtgtattctcaaaagcatctaaccatgctcagcatttaattgtcacataaaatgctctctaaattacagaggatgataattcatattttagcttcaaattatctattttgagagggctaaagtaaacaattttatatgcagatgattatttagatagtaattgatttgtggaaaatataacaacttgaaagtggaatatgagttgtagtctttgtttggcctaaaagtgtccaagctgtaagttataggaatagtccatgtaaatccagctcatctgaagctcttttactaattcactgtgcagcataagcccactcactttgtccccatgtgatttaatcacctacgtagagtgaaattactagataaatctctttccaatgggaacatggtcaggctccttgtataagaaattaatttccttgattgcgttgaatgtaaaatggaataacattaagtagagtatttatttttaccactgatataaggactccagtttcagctcagacatgtaaaagacctgggaagtcgttatatctgccccacagcaacaagaaatctgagcaaaatgaaaatcaatgacttttcttggacccatcagaaaactgagtttgtagcgtttgttagtctgcattgctatgaaggaatacttgagaccgggtaatttataaagttagttggtatattttggctcatacttctgcaggctgcatgggaagtgtggtgatctgcttctgatgagggcctcaggaagcttacaatcacggcagaaggtgaaggggagccattgtcatgtgtcaagagagggagcaagagaaaaggggctaattttgtgtttttagtagaggcagggtttcaccatgtttgtcaggctggtctcaaactcctgacctaagggatctgcccccctcagcctcccaaagtgctgggattacaggcgtgagccaccctgcctagcatggtggtgcatgcctgtaatctcagctacttgggagactgaggcaggagaatcacttgaaccagggagacagaagttgcagtgagctgagatcataccattgtactccagcctgagcaacaggagcaaaactctgtctcaacaacaacaacaacaacaaaaaagagaatatgggaggttccagtccctttttgtccaggaactcacccaacatttacaaaggggaacaaagaagaacctagaaaaagttcatccctcactcctttccccacacacactgtagtgctggctggggttggtggaagaagcagccactgccaaatctacccagactatttccaactatgtacttcatggataaaaggcttaatctggagggaaaattatcaaagttaaccctgagacactgttttaatttattaaactgaaagatggaaatagagatcaccaccaaatctctaaccagaagcataatcccagtttcccctaagcaaccaaagtctcaatctgcaggagaaaaggcttcaaaaccactgcaatttgggaaaaagaagaggagcaataagatgaggaagaatttttatcccaggaaaagggacaggaatagctgtgaaggctacatgtccaggacttaggttttgatacgtgccaaaatctttagctaaatgtgaacatcagataaccttcttcttagccaggaccaccaccactgtaaaaaacagcagtaaaagtagcagtggaatacaactgtgaagaggcacatggggagactcagtcaagtgggagccaaaaaagggcaccaatggagtggccagaaagcgctggtgcccatggcacaaacagtttcaaatgcagcttgtcttctgaccagatgaacatccatctccacatttaaggcctcacacaaggaaacttgtgcttttctcccaacatataaaatttatctaatatctgctgttcttttcatgtctagctataaccaaaaaattataaggaatattaaaaagcaagaaaaaaagtcattcaaagtgacaaagcaattgttagaactagacagagccatgacacagaggttggaattatcagacaaggaatttgaaaaagaaaactctgcttaacatgttaacggcttcaatggaaatgctagacaaaatgacaacactcagtgccaggtggataatttgaatagagagatggaaattataagaaaaaatcaaattgaaatactggaaataaaaatatagcaatggaaatgacaaattcctttgatggactcattagtagactggacatggctgaggaaagaatcagtaaacttaaacataggtttatagaaacttactaaactggaagcaaagagaaaaaaaatgaaaaacaaaaccagaacactaatagaacatcccaacactgtgggacacaatcaaatagtgtaacatatgcatagttgcattctgagaataagaaaaggagaagggagtataaaaaaaattgaagaaataatggctgagaattttctaaaaccaataaacaaaactacaggcctaaggagtttagaggaaaaaaaacagaattaatactgaaaacacacacacacacacacacacacacacacactcacaaacacacaccccatatcctattcaaactcccctgaagccaggacaaaaagcaaatctccaaagaaagtgggaaaaaaaaatcatgctagtcacagaggaacaaggataagaattacagcagacttctcatcataaattatgcaagcaaagagacaatggcatggcatacttaaagtgtagaaagataaaacagaaagataaacacaaaaatctgtcatacatagagcaaaaatattctgcaaaagtgaaaaagaaataatgaaggctttctcagtcaaagaaaactaagggaattcatggctagcagatatgtcctaaaagaaatgggaataaaatggaatcacaaacatacagacacaaaatttaaaaataaatgtgatctctgtcagcatagggcaagatccctgcttgttctagtctctaatatgtaacagaaggcccactctctgatctcagcactagcttgggtgcctcttctaattccaggtaagagatgagagcttttgcatgagctgcagtcatgaatccaggggattggcagcagagatgagagatcaaatcaggaaatagtattcaagatggaaattaaattgggaaacaataggatgtcacagagacaggaatactagagtaaaaaaaggaaaataaatgtggatgcagggaggtattgagatcttggaggtttccagagacgagggggtctcttcttaatgacacgtttgcataaaggagtggaatccccttcaatgaggttatagaagtggcatatcctaaatgcatatcaaagaattatctttaattcctcagattgctcctcagcttctttcagtcatttacaatcggtattaacatctgttgctctgtagcttttcagtctgattgattttaattactttatcatgctcagtgaacagattataaaatattgagtacctaaataaaaactaattaatgattctatggccacaattcaaaaacagtggtcaaacagggaaacattttctgatatatttaataacagtgttagcaatttttacagtagaataaatactaaatatcctttagggaaatggcccattattctttgataccttagaaataatacacaaaagaatcctcaaagatagataaaatctataactgttagtgctgtatttttaataaaatattcccactgatatctaagatacattcttgatttaaaagagtgacaaagactttattctgattggctgtgttgagtagaatggtacggcaaataagtagattaagaagagaggcagagaaagaacgtggtttatgatacttgcaagactcaaagcttctgtgtgccacaatttccttatctccaaaagagagaacaaaaacaactgctggtctttgcactgggactgaccttagattggaaaatgacctctttagtttcagataagaagtttccaatcttgttccaagataaactagtttacttagcttttctattctatgagatgtctgtgaagtaaggacaattatgccttccttataatttatgaatgaaaaaggctgtatcagttaataatgctttcagctgtgtggagccgagagcgactccaactttccccttaacaaatatggctttgcttccctcacttcccagggagcccagaggcagctgagccagggtcaatgtagcacattcatactaagcttcccataactctgagtgaagtgggtgggttcatggccccaagagtcacaatttctccgatccaattctaacatcacatctgcattccaagcaggaagaaggaatagaaagagaggcatcagcagagttctgtgaatgctggactgagcacatttatgttacgtgactgtcagaagctacactgaaggctgggaacatgaacacttagctttttctatctttataataaaatcacagtaggaaaagtggaatttggtgagccaattctcccgacacaaaggaagccaagggcaggggaaagaagtagcctaaaccaagaactaatgggaaaatagggcataccctagaatattggaaggggggcagtgattgatggactagatatttctttcctctgaaggtagagagcacctggttgcatctgggatggactggacgaaactggaaatcttatttagaacccagctgcaggttgccgcttttcctgagaatgatgaacgaacgatgcaagtaaacatttcaaagtgtcagtaccaagcctccacctcatccattttcataaagactttccaaagacctctgacttgactttacctgtggctttaatcctcattcctacattgctcctgacacggtttccaacctagtgtacctgcctaggtttgcctaggctggcacttccaccattaacatctgggcacgatggcaaaggttttcatgccataaaatgtggactttatcctgtgggaaatgtaggttttaaagcaagggagtagaatgaacacatttgaaatttagaaagcttcctgtgtgttctccacagtgtggaaatgtatttggatgggtgaaactgggggatgttacaacaattcaggtaagagatgagagctgagccaaggtaatgttaggggagtggaggggaagggtatgagagacaggaggtcactgtgcatttgttgtggaggattagggtgtaaagctggtcaaaggtgctgacaagacttcaagttgagtgaaaggtccaactttcgtggtaggagaaacaagctttggaagaaagatatagagttaaatgacagaccagataagttgaaattgcctctggaaatgcaggtagatgtgttccccagaaagaaagacatatggtgactgaaactggcaataaatgatgtttctttctggatggaattccagaatttgaagaaactaaggccgaggaaataaactgtggaacattgatattcaacaggcaggcagatgaaagtgaatcaggagaggaaagtaaaaagtagagaagagaaggggaaaggttaaaaaaaaaaaagaaaagaaacagatgccacagaagtcaaaccaggagagaacttctttgtttatctcatagcatggttgaatgttaatagcatgtagtgggtgagagaatagtctccagaaatacactgtctgcttcaaatattgcctttaccatttattaattctttgatttgaggcaagatatttaactccttcaatgttggttgtgagtgttaaaatagttaatacaaaaaagcaggtagaactttgtaagtgtatagttgagtgtaaataggtagcagtcagcaaatgcaacttaatattataaaagatgctatagctcccttttagttggtgagattcttaacgtgaaagtccattttttcttgtcattgctgtagcctcaaaactcaatgaaggaaacattgttgacactgtgtagttattttaatatcaaaacaattgttgttcacttccagcatttgaacaaaagagagaaagagaaggagagggagaggaactaggatgtacaaaacctatgctaatgtttagtgttgttttgttttaagcgcattttagctatgtttttcaacttctcttggccgtatgtgttaaaaatcctgcatttttttcctaatgccaggaaaatctctagaattcagaccactgagagacatccactactaccacaggggtcaccatcttctttcctttgcctttaaaaattgaagtgttatgtaaatacagtgcaatgtggaaatctgaagtgtgcatccaggtcaatttttagctgtctgactttcaatgagataaagatacaaactgtttctgtcactcagaaagtctttccatccttttccccagtcaatcttcacagcagaagtattcattatgctgacttctgtcataccatgctctacatgttcttgaatttcataaattgactcctacaccatgtacttttcaactccacagaatgtttttgaactttactcatgtggttttatggcccgttgttcattccttgtcattgctgtgtaatattccatcgtgtgatttatgacgatgggtttatcgagatgaagcagctgtccttttcaggagggttgaccagactgtactgtgcaatcactaagaatgtgggagttcttgcagaatcatcccactcctttgaagattcctgacttccaaccacagagttgatcatcatgtgacctggttcacagaaagaaaaaaattaaagggatttgggggtgggggtgggaaggagagacagcagcactgtccatttgttttctctgaggagcttaaatacccttcccatcatcccctagttttaaggaacaataaagaataactttctgggtcccttgggtgttttcattaagtagccacagaaagtgctagctagaaaagtctatagcgacttatatacagaagtgataacattctaaaatgggcagttttggcttaggggtggaaaatagttctcatatctcctaatccaatacctgcttttggggaaactttgatttggagaacagctagggtctagctgtaccctcttttaagttattttatgcccaaagtccagcctagcccttgtggagtagacatctgtcaggacagctgcctgggggctgcatgctggagacggaaggaggcagaggtgcagagagggactaacgtttacctctgaaatgctcccatgaaagattgtctggatttctgcttaaaagtactttatttataagatgaactagctgaacttgatataactgcatatattcattaccaaaatttaatgtcatctttccaagctcaccttttaatttgcaatcaaaacacaaagaaataggtgtacaaatgtaatataaacacaaatgttgcatgtagttgcaaaatatcagcacattgtaaaattggacatactatatggcttcatttggatgaaattactttaattaaaatgagaaagcattgaataatcttagaagtttgaatgtgcagcaaacagcagaatgggtgagagtgagccttctgtaatgaactctcctgaccaaagtgggacttagtggcatatacagtgatccatcaggggtgccatctgtctatgggaattcattgctaaagtaaggtcctcttaagttaatctttcagggttccttgcacaaaggataggtcttaccaatgacgtatttggaacacaaagcttaaatacttcatatatgaaacaataaaatgacttaaattcccttctccaattttatgaaacaaacatcacttgagatgcactatcttaggggaaagaaaactgtgcactaagcacttaccatatgcaagatacagtgttgaacatcatcgaattatatgcaagtgatatcattttgtttttatgactactatataaatattaatattctcagttcacgtatgaaaccaagccatgttcttgggttatatagataccaaagatctgtttttcacagtcaggaatgatgtgattctgggcttgatcttattccctgaacttctggtcatttttactatagaagcttaaagagaaaaatcagttaaatctttgggaggagaaaattttccttatgaatatgcatggccttatctctcaatgccttaggtagggacacctatttgtcttggaaatgaatggtactagttttcttaatagcaggactaatgatgtgtggctagaacacaatcagaaaccatactagtaataaaatcatggtgtactttatcatatagttctttgatatgcatagtcaacaatgtactgagaatgaaaaatggtgcttcacaggtaggactagtctacttacaggaaagcagaagtacaggataaaggtagagccaagataaacattcctaggatgccttaggcagagggtaagaagacaagggaaccgaggcagcaattgagttttgaagagtttatctggactctggagaaaggaaaataagtcagaaggacactattggtctaggaaatgataatattttatcatgattatgcttataatggtaaggaaggcagaaattggagattatggcaatgattaagaacaaacgtattcgggccaggcgtggtggcttacgcctgtaatcccagcactttgggaggccaaggctggcagatcatgaggtcaggagatcgagaccatcctggctaacacggtgaaaccctgtctctactaaaaaaatacaaaaaattagccaggcgtggtggcgggtgcctgtagtcccaactacttgggaggctgaggcaggagaatggtgtgaacctgggaggtggagcttgcagtgagctgagatcatgccactgcactccagcctgggtgaaagaatgagactccatctcaaaaaaaaaaaaaaaagaacaaacatatttatatttatagggaatgaggacatgggagaagaaaaaacctgagattatgtcagaaggaattaggttctaaaataagtttagaacttcaactgttaagcattttggggaacagagcttcaaagcatcacccttcaaacaggttactaaagtaagaggtagagaccatgagagcatagagcgataaggcccagtgcttagggaactcatttgcaggagatcaagttgagtggaaaagtgcaaaccagaccatcatagtcagtgcatgtctggcagtaaccctcagttgtagattgtaggtgtggaggtaagcatggttttagtttgatatacaccagagtacagattgctattaaatagagagagtgaataagaatcaatggctttattgtgtcatcacagcatctcaatttttaaaaactaccatgaataaagcattaataggaaagccagctacattgctcacatgctgcattttattattcatgtaacatttctgattggctaaaacatttcagtatatcaggcaatatacccagttctagaaagacagaaaaactagtcacaattgctggcttaccatccaatgtgtgtgtttacatgaggggggagaagagggagaccatacaaataccgtgcatgtgtcaaaggagctgtgatgtacagagtgtggaaacaccaaggagagaagagctagtttagcagctgcggtaaagaacggaagtagtcactgagcttcccatcctccaccagcctccaagtgcccttgtctttcacttcattattttcatatgattgatcatatataaccaacaccttagtccctcacttagctgatcaatttgtagtgtctccacataataaaatatcaaagaagaaagccacgatagtctgatgaaacaccatcttttcaggacaactatttgttagcatctaaaggcagagtttaaaacatggttcttcaatctgtgctctaatatagacaaatgagaagacattaatctaatagggcagtgtgagtccattcctcgaacagcaatgtgaacaatgaacacttggtccacaccagtacacctgcacacggctgaacttcagaattatttggagagtttgattttcaaagtgtagctccttaggctttatcatagactttctgaatcaggagtttcaggagaaagtccaagggtctgcagttatagaagcctcagaaggagacactgatgctcagcctaatggagtgaccaatattctaggagggtcttaaaactcagactgaagcaccatggctatctctgtggattctatccatcttggagctgtctcagcctctggtttccctgctcctgcaatcctgatgcaaacctgttagggcattctttctaactggatcctctgattatgctatgtgctttctcagagttactcagtttcctctgatctatagatctgttaaacacactctacacattcgccctgccttgcctttggctgtggcattatgcctatctgttcataatgacagcctagttctgccagctgactcacatgagctaactcttactaccctatattccacgttgtgacaacatttgactactaacctacttcatagttcctatatggaatcataatttttgtttttgaatattgtaagtatttgctgtatgaaagaatgaatttttctctctgtggccttttctgcaaaacataggtttccatgacaagtatttgaaaatacccaaattgctgagacccagtgactggatatttgaaagcactaaaagggagagtgatgggtttgactgccttagaacacttcagaggacttggtcccgatcaatcactctctctaataccagcactttccctggctataccctctcccaaaccactggctttcaagttgtcttttatcctaagcaatttgcataatattacctagatttctcagtaagatttggaataaaggaaaagaaatccatcttctatcttgagttcagctctataattgcaagattcgcacagaggctgaaaacttccacaaagcatttatttgcccttgggtgagttgccgattctctggagcaatcttctcctcttttgcatgcacagagtaaggtagcagagatgaaagacagctttgagcttcagctacaaatcagagcagaagggtgatgctggacagcctcagaattgtaactgatccagcttggctcagcagtgattggaagtaggtcagaaaatggcagtgctggagtccagactgtgcgggagaatactacatcttctttagtattctaacagtttcttgtcttgttctccgactttttactccttttttctctttctgtagtttttaatctttgtatgcataaagagacaaaaatagctaagaaattttgatgtagaaaagtgaagagagaacttaaattataagataataaatgtattttaatcttaacaatatttataacactgaggtcatttttcaagaagagacaaatagatcaattgctcagaatgtgaagcccaggaaaacaaactaacgtaaattaaaattaataactgataaatgaacatttaaatcgatagtgaatgtatgaaactatttaatgaattttcttgaggaaataatctatcaggagaatttggttaatttgccaccagaataaatactggctgggagagaaaagtcaaaatgtattttttaaaaagtagtcacaaaacaattgagataaaactgagaataatatttatttgctttggcagatgggataacattcaaatgatgaaaattataaaataaattaaagaaatggatgattaaaaaaattaaaaagcactgtacatgaaaagcaacataaagataattaaaattcatgcagaggacaaatacaagcattgggagagtattctaaaaatacatagaatttatatacatgaataggaaagcactaatgtactaatgtccagaagtgaaaagggcaaaggagacacaaaaataatccacaaatgactaaattcaaatggctaataaacatatgaaaggctttgttttgttttgatttgattttgatttttgagttaaagagagcgaatgaaaataacattcatggtagtttttcagtgctagcaatggtatgtaaagattagcatactcagacactaatgtgagagagtgtataaattagtagaggcattctaggtgcagtttggtattaggagtctcaataacatgcaactcctttaaccctataatcctgataatgagaattgtaagtttccatcaaatatttataaaacttttcattgtgccttcattttaaatgataaacaatgagaaacaacctacctactcatgaagatttccagtatgtttctgaagtgtttttacatcctcctcacaaggaggagagttgacaaagactacccaatgtcattatggtggaattgaatcatggcatctgctggtgaaataccagctgtgactacgtctgcagagagtagctctcacccagcaagagatggtgcaggtggtcttctgtacctagaaagaagttgagaagcatttcggaaataaaacttgcaaagcttggctgccagctgtggatggtctgggaaagagatggaaaacattcaagagaagctggcatttgtaggtcaatgaaccgagttggtggagacaataaccaaggctgtgagaatgaggaaggaaactaggcagaaacctccagttttcaattccttttggaactgacaaatgagaaaacagctacagagagacttgacagttcatctgcataaaagatggatggaattaacatttggggaggtccctactctgtgtgtatcaaacctatttcttattctgttttatttaattctcatggcaggtaaataaaatttttagatttaagcattcaacaaacatttcttgcttgcctgctatatacctgacttcatgttaggtgctagggagctggggacatagacgtgagtgcaatatacttactccctcttgtagagttaaataatacctatgatatcagttatctagcagcagaggatgaaaaatgtaagcctatttatttttaattttctttaatttttttcctcacttcaaagcctccctgctataccagtcttttttcttttcttctgttctttgagattatattttaggtatatatgtcatctttgcatatattgtcttttaaaaaaaaacacaggaaaatataaaatacctttcagcttcacttgttcccttttcttttgcctcagataaccaccatcatcaaattttctatatattcttccagtcatttttcagagcatttaatacaaatataactatagagaataatatttattttccatataaacatggatattttgtctataatagtctgaaactttttataatcagcaatatattttgagctcttactacatgagtgtatttcaatttagtttatttttttcaactactctatagcaattgtgtaaagtaatttatttgcccaatacagtccttaagaaataaaacattatcaattcagttgaaagcaacaatgtataccacccagatcaaatattctgctgccttatcagagggatggtgatgaattaacaagcctgtgaattgcattttgcttggactatgcttgagtgacaattgggtacaggattacaggcttctggttttctcacaccattctgatgatattattttactaagttccagttttccattgctgctactaaaagcatctatggtccatgtaatttttgttcttgagtagcttttgctttggagttctacagtttcactatgactgtgcttctgtggatttctggttattatgttattcttacaattattgaccactgaagtctcagaattaacattgttaatttatcctgtttagaatttcaagaagtgtcctcatcaaattctagaaaattgagaattgcctctttcacttatattctattaattcttctgaaattcaatgagatatgtattagaactgctcacttgttcatagatattaattcctcctttatatttaaaaaattcatttttctgtgttgtaattttgttgatttttttctaatacatattctaattcaataattattttttcagttatggctaatgtacttttcaacccagctatatttttattttaatgtttatattttatttcaaaaaattttttaaacagtcataatatttataataatctcttattcattcctgtagtattcaattacttttcttatgttttaagcattttggacatattccttttctagtttgtttttgttcatcctaatatctgaattatttgagctctaaatctggttttcattgtgtgtgcttattctttctcacagttgcttgttttgttttattaactttttagtttttatttaattctgactcatctgaatctttgggaatatcaagagcctggattgagggtatgtttgtctaaagagaatctgtattttatttttcccggtgcaatcaacctagaaagtagtgggagtgacttctgatgagagtggggttttttttggtggggttgtgtttgggggagaaaaattatttaaagttagatagtagcggtgtttgcataactcttgagtatactaaaaactgctaattttcatactataaagaggtgaattttatggtatgtgaattatatttcaataaagctgtaatacaaaaattagccaagaggagtttgaatcaactctacactctcagtcaaactttcctccaaatagtaccaagatgtggagctgtccagcggaaaaaatgtgtcagggcaaagagtatgtcctctacgaacaattcaagaaaagaggggatgaaggcaaggtcaaagctcagcatccttgtcagaaagcaaagttttaatttttcttcagctgtttatcaatatctgcttcattaataacaagtctctacatttttgccaatactggtttattttatttaatatttgctaatataatagattttaaaaaatctattctcactgctttttaatatgtttcttagattactgttgtgcctgaagtgttttttacattagctattctaattttttatttttaaaactaagttgccttttaaaatcctttacccatgtcctaccataaaactttttctcctaatgagttttgagagagattcataaaacaaagattctagtcatttgttgcaaatattacattctaaattgcttcttgctttcaattttatttataataacttataacttctatttcggggttttatatatagttctttatcacaggacatcaacagtgttaaattaagtaggtactttttaaaataagaaatatgtaaatatttacatttctttaggcatttctttaagtaagaaattcagcaaagccatatgggacataaggaaaatgtccaaaaaaaaaaaagaaagaaagaaagaaagaacaacaacaacaaaataaaaaacctgacaatttacatttagtacacataaataaaaatttacatagcaataaaagggccacaaactattcaataaaattacagactttttagagctaaacttactatagaacttagtagctgtctctgatgtagagatggcagtaagattttcctgctaaaataacaactgcaaagacggttttgggatgcaaaggattatgtgtttttatttagttgcaggaaatagaaatagaaacatttttattcttagtgactttttttttcctgtcaccagccattggaaggactacaatgtgaaggctgagatcaatgatcttattagtgactactgataggagtaggggtcctggaatattttgtgtctatactggcccgcctggcatctgacttcaactacactggctgggcagcatgagagctgaagacagaaagaaacacattaagcaacttttaattgtggatatttaaaaaacatttggttatcagatcctttcctactcaaagacggcaggaaacaggttctagtagggagaagaaaaaagaaagtggcctaatggacaacgatgcaggctttagtcactacaagtgtagggaggggaagacagggaaagaggagaatagtaaaacatgaccacaagattagcaaaatcctaaaagttgatgagattgctgagcaacaggagttcttgtacatggatagtggaagagcaaactgatgaaaaacctttagaaaactttggcagcatccatagaagctgaacatccttattcagcaagacccctcccagtcatagtcttcagtcagcagaagcatatgcctgtatgaactagtgcccatgtccacaaagaattagccactctctaatcctttaacttgatttcacagagcatgatactttcaataagattcttagtgacagagaaagatagattaacgttgctattagaaggctctgtttattttatttgtttatttttttcttgctcacattattaagaatggcctcacagaaataaactgctgggatttcaaatccaatactctatcgtgaagtacttgaacacagcaaccgtgcctcactcccttattgttcatccccaaatctaggaaagtgcaggcatttttcagggactcaatatgtaagtaagtactgaatataagcttcttagatgacaggcttacacatttcataaacaaccaaaaagcaaaacaaaacaaaacaaaaacaaaacccaaagcaaaaaccttcaaattttcctaaactaacatataaaattaaggagattttgtgtattacaatcattgtggtatttattaaatgtgccataaatattttataccatttctactagtaattgatgacttttactatgtttttgatgccttacaatgaaacaaagtatttggtggtaacaatgtattttaaattatcatattgaatatcttttacactataacagaaatttttgggaatgaggtgaaaatttgctctaggtttctttatgatgtaaatttatcatgggattctcttaaatgatgagcttgtcagggtagttgaatggcaggtctctgttttagtggtactttccctaacctccctcccaaaatagcacccctggttcattcattcttctgcaaccttacactgtattacatatttttatttgcccatgttatctctccactagtagaatataaactccttgaagacactttgtcaattgtgttcattgatgtatctcaagctcctataaatgctagtgacctaagaacttacccatctaccctcagaatatgtctctatccagtttcttttaggggcctcgagatagggctgcttccagcagcgctctaaattctcagctatgctgattattctcagtcctcggctgtagcaacagtgctctttcccttaattttattgtactttcagttctgggatacatgtgcagaacgtgcaggtttattgcataggtatacacataccacggcggcttgctgcacccatcagcactctttcttagtagttgacagtacagatggtcacgatgctgggctgacctctgctggccaccaggttgcaaacgcgaatgctagtgtgtttcttcctcagggcccagcaggagaattcctttgagctttgagcaattctttcagagaaaggagtcttctccccaccttttgtttaactatagtcctagagaggtagggatacagccaggcatagtcttccattattcctgattccgtttctcaaaccacgtgcctgtggccccatctgacactctgggcttgatttcttgaggtatgatgattttctcaaaagatgcctctgtcttcccatgaatctggtgtttttaggagttgcccaggccactcgatgtcctatatgtgtttatactccagtcattaacaacttccatcaagttccttgccactgggtttctcgacgcaggagatgtgaatggacaactaattcaaactcctggagcattctattagggttaagaatttctcacgtataccctcgcacttaggagcctcctctgccctaaatatgctggggacatctttggtgtgttgtggtgtctcctcatcagtaaatgaggtcttacgtctgtatcagcccaaacagtaaaaacagtggatcacaatcacaaagatagaacagaagaataggcaagacttctattctagtgctcttttccaggataattggtttttggggaggaaacgtagagttcatatgaacggatataaatggagttattctatgccaaacagagcctatcatgaaagctctgtaagaaatctcttccctcctgtccccatatttgcattcaccaccaggggtgtctctttcggtgtttgagtttcagttcctctgttcatatgaactctaaatttcctcccccaaggaccaattatcttggaaaagagcattagagtagaagagttgcctattcttctgttctacctttgtgattgtgatccactgtctttactgtttgggctgatacagatctaagacctcatttgctgatgggaagacatcgtaacacaccaaagatgtccccagcatatttagggcagaagaggctcctaacttttaggaccgtctttcctgctgcctcaggtgagcaacacacatacaaaaaaacttttctaaagtaaacagacacagatttttaggattgtgatacgtaatttttaaataaaaatatattcattttaagtgtgaatatgctaattgtagaaatttaaaaatgaaatataagaaggaaatggttttccagatcgcttatagccttagaaaccatcgttagcattttattatttttcctttcagctctctctaagagcagttttagatcatagttgctctcatgctttaattaaattgtgtatttggttttccatttagcatgaaatcagtatttcatttgataaacatcattttaataggttgcacattacttctttgagcaattctaccacaacataatagcctctcacttgaggaattttgggtctctagtttcaattgctgatactgatgttgttattttatacataatactataatactactcaccagtgaaaatgaaatagtaggcaatctggcagtatgtattgctttgaagttaatagtaataatactaataacccttgctagtttgggacctacaatgtgccactcagctgttttcatgttacctccttcagtccttaaaacagtgctgctgatagacactgattccatgtttcccagatgctcactgattaagtcacactacccaagtcatacaatcatcacaggtaggagccagctattagaacctagttcatctgaatctgaagtcaatgatgtttccattgctcaatgctgccatagataagcatgtgtatataaagttttccctgtcttatttcctaatgtgaagataaatgtgatttttttaattgaaatatgttatcagctaggtagaaaaaaatgaccaagaagtacactaggtatgaggaaatttcaacatgcacataatctctataagtataaatgtcccctagcattctgtactgtgggtaactgagaggcaagtgactcagattgggccatttgcattgttaaataattatttcttgctgtggccaggctcaatcaggactatgcacagttaaggtattacccaaatgaatggtgaggacttgacatgtgttgagagcctcttttgtgccagggaaaataggtagtactgacaaaagatgtgaggaacacattttaataaaatgtgacaactgtcattggatccaagaagtggatcatcaactcattctctggagtgagaagaaagttagacatggcttcccagtaaacaggtcagaaggatccggctgcatgagaagttgggggaagcagtacgtgaacagagatggtttccccttaacactgtcaaatgagaccctgagtgcctcttgaggacaggagcttttttcttagtacctattgtacttctcacagtgcctggctcacaagagtctgtcaatgcatacaaaatagatagatagacaaatagatatagagatgtggatggatagattaataggaagatatagaaaatagatgtatgtgtgagaaagagagagatagagatgaagatagagatcaataaacagatatagatagatgatagattagatagataaaaggatgaggaaaaatgggtagatagctacagataatgtgtgtgaaagatagagataaagatacaaatagatcaatcaatagagatagatgacacatagacacacacacttatacatgatttatctattctatctctctacatggatagatgatggctagatagatgaatataaaaataggtatatatacagattttcttctttctattgttactgcaagcctagagcatattaggtgctaaacaaataactaaggtttaggaaaataattggttaatggctgatatgtcttctcataaaccttgagctgttagcactatgcagtctcttctcagcacttcatgctttattctgtagcctggtgtggcaccgagccccatgttactgtgaggttcacacccaggacaagggttttgggcagcctagacagcccatgtcatctacattaaactctgctttctctttacattttttttcttttaaacacagcctgaacatgagtgagacaaacatctgtaaccttttctaacaatatcagaggatatcatttttatatttagaaggtggatgagattgaagtcaagaagagatgccggggcagctcatattattcacaagcaacataatcactgtgaaaatacaatcttttttccccctttggagacccagttactatatttttttaaaagcatttgtgcaagaaaaaacagcttattaaaatgcatgaggtctagcttgcctatcaccaataatcagaatatttttatctgccataaaatctcatgttgacaagtaatgttcttctcagttttgcaagtatgacgctattgtccatttgatttctccatcacctgctgacctacttcctgttactcacccagcaggccctcctgaggcaacctattgatgctcttgttggttcttctacccctttatctcataacaatctgtcagctcacccctccagagggtttaaattgccaccaactggtcaatagatgcaacctcctatatatcaatacgcctgcttccaccagtagctctttgacatcatctctcagataaattggtctctctcttttttcatattctgttctctccatgatgtcacatgaaatgtgaatgtttctctccagttggagtactacattgcttacatttaatctccatttattttcctcctacactcctaccccagagattttcagaaagtgagaaaagtattagaggtttggaaatgaatatacatgtctctaagcttttgaaatcttgtttccaaatatagagctgacttgatttgagaggaagaaaagcattagcaatattcttaaaggatgactttacagtgataatctgaattttattctgtgggcagatttcttcaatagtgattcagttatttataataacaacaactacatgaagaccaataatcatgaaagaacagtgatcatttttcatctgaacaaagtgtaattggattatcttcagagattctaaaaatcacaactttccaaagatccagtgtacatggtggatgtagaccagcgctgagctgtttcacgaactatcttcctgttaccagcaggtcaagggctggaagtctgtggaggaggacttgaagtccttaggctggcagccctcctcatgcagcggcaggccaggcagccctcatttctttccccagctccaggtcacacatggtagaatttccacctagcccccagaagttgtttggatcttgctgcccttgtattgtttggtcttgaggagtggctcttttctcatatgaagggaagatctgggtggattgccttccagaacttctgtcttcccctgcatccatattggtgtgaggaaccacggcagagtctgtgggaactgtgaacatgtaaaaggacagaatatcactgtgtaagatgactgtgttttctccaagaaacagaaagctatcagctgtctgaaactaacttttaaaatacgaaacaaaaaacagatttttttctccaaagtcagggagggaacctgaagctcggggttttctaaaacttctttgaatttaatgaagtgaaacactgaagatcactgggaaagggtgagttaaaagatcatagtgatatgctttcttacttaggagtttttgctaactacagcttattttcagaaggtgtgcatatcctgagtgtttctattatttttttgcttttctgcagcaataacataaaaaaaatcaaaataccagaccacatcaacacacatactttgttctttggaaagtaaatttggcagaaatagaaagaatcataaatatgatattttaaaaaggtgttttatttaaatatttaataatgatgaaagccccaaataatcaaaattggcctatttctattttaatttccaaccaaccaaggaaagcaggaattcatagactttggcaaggatattttgaagtgtgttgatgaagcttgtggtgagtgtgcactactcttcaccccagagtgaagaatggacacccataggaacagccatgtggctgtgacaaatgaagggccgtgccctaccttatgaaattgacatctggtcctagaattgcacagtcattgaaaccaatgtgcaaaacactgctaaatcagaaagacacttcagtgagaccctccttctctgccctatttaatttaacaccctactccaacatgccctttcccctttcctacctgtttttccctggcacttctatagctatgtattctatgaccacgtgtagccactgtgtatgacacttacttacttattatctgctcacacactagaatgtaagttcttccatgaaggaaggacttttgtttgttttacacatctgcagtgactgcaaagtgcctgaaatacagaaaacactcaatgcatatctgctgcatcaatgaatgaatgtgcttttaattacattagtaaatatttataatgagataaaagagttctactgatattgcagtgtaaatatctttaatggcagggcaaaatatgtaaattgaattatagaagttcagaactgaaacagaaatgagaaaattagaaattttccatacgggaaaactgagttcaagaaaagctataacttggcaatggtcatgtttgtagtgcacaacataatctaattctcctgagtccaaataaagccccaaatataacccattattattatgcattttgttgccttactactattagcatatagattatttgaatttatatacttttaggctgtgctatttgcatgtgtctgtattcaactgttgtttatctcaaaaatatgtattccatttggctcatccttaaatgtaatggcttaataactttattttttatcgatattttgaaaatatttttcataaaaaatgaagccttcaaatactggaggtttctgttgtatttaattttttgaaaatcattgtctctgctatttaatgaacagtattgtcttcatgtttttgtactgacataatagagttcctcagggtaggtaatttataattaacagaaatgtacttggctcatagttctggaagtgcaagattgaggggctggcattaggtaagggccttctcgctaagtcatcccatggtggatgatgagagggcaagagagggctgaaattgtccttttgtaaagaacccacgtctgagaaactgaacctactcctgagataatgagtttaatctactcaggagggcacatgccccgtgacccaaacacctcccaccaggccccaactcccaacactgctgtgttgagaaacaaatttccaacatatgaacttttggggacacattcaagtcatagcaagtattattcttaaaatatataaactaaatatttaataattaaaaatttgtggggaataaattattgtctttggggcagaaattaagtatatactttattttttccattaattaaaagcttccaattcaagataacagataccgtaaaactctataactttctaagacaatgttcaatactttttataaataaacatcattgtttaaaaattttagtttcaagaacatttgatttttcaacccattgagcgatgattacttatttatgaaggatgctaattaagcctagaaggagaggcaatctactacttgtgtgtatgtttatattagccaagggagttattgattaaattttcttcttttttattatactttaagttctagtgtacatgcgcacaatgtgcaggtttgttacatgtgtatacatttgccatgttggtgtgcttcacccgttaacttgtcatttacattaggtatatctcctaatgctatcctccgccctcccccaaccccacaacaggccccggtgtgtgatgttccccaccctgtgtccaagtgttctcattgttcaattcccacctatgagtgagaacatgcagtgtttggttttctgtccttgtgatagtttgctcagaatgatggtttccctcttcatctatgtccctacaaaggacatgagctcatcattttttatggctgcatagtattccatggtgtatatgtgccacattttcttaatccagtctatcattgatggacatttgggttggttccaagtctttgctattgtgaatagtgcagcaataaacacacatatgcatgtatctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcactattctaactggtgtgagatggtatctcattgtggttttgatttgcatttctctgatggccagtgatgatgagcattttttcacgtgtctgttggctgcataaatgtcttcttttgagaagtgtctgttcatatccttcgcccactttttgattgggttgtttgattttttctcataaatttgtttaagttctttgtagattctggatattagccctttgtcagatgggtagatagtaaaaattttctcccattctgtagattgcctgttccctctgatggtagtttcttttgctgtgcagaagctctttagttgaataagatcccatttgtcaaatttggcttttgttgccattgcttttgtgtgttagtcatgaagtccttgcccatgcctatgtcctgaatggtattgcctaggttttcttctagggttttttatggttttaggtctaacatttaagtctttaatccatcttgaattaatttttgtataaggtgtaaggaagggatccaatttcagctttctacatatggctagcccagttttcccagcaccatttattaaatagggaatcgtttcctcatttcttgtttttgttaggtttgtcaaagatcagatggttttagatgtgtgatattatttctgagggctctgttctgttccattggtctatatatctgttttggtaccattaccatggtgttttggctactgtagccttttagtatagtttgaagtcaggtcacatgatgcctccagctttgtttttttggcctaggattgtcttggcaatgctggctcttttttggttccatatgaactttaaagtagttttatccaatcctgtgaagaaagtcattggtagcttgatgtgggtggcattgaatctataaattaccttgggcagtatggccatttgcacaatattgattcttcctatccatgagcatggaatgttcttccatttgtttgtgtcctcttttatttcctcgttatttctttgagcagtggtttgtagttctccttgaagaggtccttcacatcccttgtaagttggattcctaggtattttattctctttgaagcaattgtgaatgggagttcacccatgatttggctctctgtttgtctgttattagtgtacaggaatgcttatgatttttgcacattgattttgtatcctgagactttgctgaagtcgcttatcagtttaaggagtttttgggctgagacgatggggttttctaaatatacaatcatgtcatctgcaaaaagggacaatttgacttcctcttttcctaattgaatacgtttatttctttctcctgcctgattgccctggccagaacttgcaacactatgttgaataggagtggtgagagagggcgtccttgtcttgtgccagtttccaaagggaatgcttccagtttttgcccattcagtatgatattcgctgtgggtttgccatatacagctcttattttgaggtgcgttccattaatacctagtttattgagagtttttagcatgaagggctgtggaattttgtcaaaggtcttttctgcatctattaagataatcatgtggttttttgtctttggttcgtttatatgatggattacgtttattgatttgcgtatgttgaaccagccttgtatcccagggatgaagccaacttgatcatgatgcataagctttttgatgtgctgctggatttggtttgccagtattttattgaggatttttgcattgatgttcactcaaaatcgctcaactacagggaaactgaacaacctgctcctgaatgactagtgggtacataagaaaatgaaggcggaaataaaaatgttctttgaaatcagtgagaacaaagacacaacatgccagaatctctgggacacatttaaagcagtgtgtagagggaaatttatagcactaaatgcccacaagagaaaggaggaaatatctaaaattgacaccctaacatcacaattaaaagaactagagaagcaagagcaaacacattcaaaagctagcagaaggcaagaaataactaagatctgagcagaactgaaggagatagagacacaaacaacccttgaaaaaatcaatgaatccaggagctggtttttttgaaaagatcaacaaaattgacagactgctatcaagactaataaagaagaaaagagagaagaaccaaatagacacaataaaaaatgataaaggggatatcaccacccgtcccacagaaatacaaactactatcagagaatactataaatacctctatgcaaataaactagaaaatctagaagaaatggataaattactggacacatacaacctcccaagactaaaccgggaagaagttgaatccctgaatagagcaataacaggctctgaaattgtggcaataattaatagcctaccaaccaaaaaaagtccaggaccacacggattcacagctgaattctaccagaggtacaaagaggagctggtaccattccttctgaaagtattccaatcaatagaaaaagagagaatcctccctaactcattttatgaggccagcatcatcctgataccaaagcctggcagagacacaacaaaaaaagagaattttagaccaatatccctgatgaacatcgatgtaaattttcatagtaacattatttactttatccactgatgatgatatttaatatatttgctgaattgcacagtatccacttaacaaaatcaaactttaaggactacagcttggatttcttgtgccaaatgatcaaacagtaaaagcactgacaatttagcctagggatagccgcagtgatagatgaggcagacaagtcaatcgagaataatgagccataagagaaacaattgatcattttatttgactgttcgatttaaaatatgcacatggcttgggggctccctgtcacatttatacacagaaattcccttatttctttcactttttcagcacacattcattggcggtttattaagtggcagtcactctgcctgtcacaaagtcatctagaaattatagtcaaagatctcactaagcaagattgtgactatttgtgggtccccttcaacctactgtgatacagccaccactcaatatttattgtgtattttagggactgctctaggatagctgcaacaagaaactgagataagtgaggaattaggagctataagaagagtaacacttttcaggcaccatggctcacgcccgtaatcccagcactttgggaggttgaggtgggtgaatcacttgaggtcaggagtttgagaccagtctggccaacatgtcaaaatcccatctctacaaaaaatacaaaaataagccgggtgtggtggcgggcacctgtagtcccagctacttgggaggctgagacacaagaatcacttgaacccatgagatggaggttgcagtgagctgagatcgcgccactgcactccagccgggtgacagagtgagatcctgtctcaaaaaaaaaaaaaaaaaaaaaaaaaagaacaataacactgatggacaagtccatgggctattagaaaagaatacttaaggggaagttggatttatgaggcttgtgcagaaaggctaaatggatgaggtgacttgagtgcgccctgaagaaagaggatcatttccctgcagagagaagaaggaacagagagaaggaatggcatatgcacaacataaacaagtaaaagggcacggtgggagggtgcccttcagtgggctggccctggtctgtggtgagggagaatggtgaaagacagactgaagaggaatttggaatttgtcactgggaccaaatattgagttgggaacagccacagcagcacagatgagctaggaagcacggagaggcagacttcaggggatgcaggcttcatggcaaaaacatcataactaaaggtgagctctggacagagagtaaacctcttggactccctgcttcccaggtagatcttttttcttctttcacttgaagccacttaaaagatggagcaccctcaatgaagttaggggcatgggagagatccaaaataggtaaaggattttttatttgaaaaatgtgtaaaaaccaaagtgaattatgattcatacgtgcatttgaagggggacactgctcatttttaggcaaactatactgtgtgattcttaagttcccccagcaaaattgtccttctgagagggcttgtgatttgaaccctttcttcctgggagtaataagagtttttgccatttccagggcaagtgccctgttgtggcaccatcctttcccctggtccaggtgttctcccctggaacatgcaattctcatagtctgggagactagatcagagaaggtgtctgagcagggcgctgtgagcaaagcagatgatctgatgtgttatcccttccctaggcactcttagtgggaaactgagaatcacaaactctgtgtctgtgtctaactctccttttcaatgtgcttgttaagaactctgtgagcataaaaaccggggtggaggggaagctgaatggtatgaaatcctggaaaccaggaagcttcaggaaatggcttgtaggaaaagggagcttggggccttttttgaagcttgcagcaggcagaggagctgtgcaattcagcgggcatgactcataaggcagctgctggctgtgaagacatgggactagaggctgagtccaagcttggctggtaggttcccatcccagctgccagaccagaacatccctgagggtatgctttctgggggctgtcaataattcacttccagtttgttgctgcaataagaaataacattttagtacattttactcatttggagtttatgacatccttgcacttagagaaggtggtattactcccatcttacagctggtgaaagggaggttaagggaacatagccagctgtttggcctcacctagctggtaaactgcagatctctaatttggatttgtgccttctaagtcatcagtctcagggtcccccaatgctactattctttctctaagagcccttttgaggctgtgtctgtcatggcaacagagctgcaaggattgtggggtaagtgacagttctgggcaggagggccctcagagcaggtgacagagagtgagcagaggggagagagatggaaggctccgaggaggtcagaagctgctaggagagagatttttccccaagtcagcaaccttgcagcattggtctctatgaggagcaactcaaattcagctagatttaaaatgctagagtcttccagtgcactagcagagtcctacacaagagcctgagacaagaaaagacagaggcgaacgacacgtatcagcattcttgggatcatacacccactctcattctcctaacagtcattcagcttttgatttcagcattgaccaattcagcagaaatttctacccagaaccagtgatttcaggcctcttaaaaaccagtggtatttatctgggttttgtcttcagcagcctcatcattgcctgattgcctcgcagttctcgaggggaggctggcagccacggcagcgtctttatcataaagatgatgttacctttctctctcctgatttcccttcggcttttatgtagtacttgaaggtgaaatattctatagaacattttgtacagtatgttctcgtttctttaaaaacacaacacaacaaaacaacttgtatatgcacagaaactacctgggaatcaggttaacagggcttcactccacagctgctgctggggactggaatgctgctggcaggtggctggggggggtcacattttcttttatacattttattatgtagtattttttaaagcttgaattacttaggtaataaagtaacactttattgagtaaatggaaaatctacttagatatatgaaacttttaaaaaatagaactttaaaattaaagaaaactggattcttttacatttgcatctcagcatcacccaatatacctttgtaacagacatgcatatgtaccccctgaatctgtaataaaagttgaaaaaaatttaaatgcccttctctgagtgttgtaggatatactgatagactccggacgcatgtccaagtcagagtttggttttcaggttggagatgtcctggcttaaattgtctagaaagatgatatcttttactgtttctgtgccatgaagatgtgtgtaacataccatctccctctacctcccacccccaacaccatatgaaggagccatttcgttatgcaaagaatacaatctgaaatggcttaaggggacttgattggctaggagctgcccatggcaagcaaaacacatggaatatgaagatatggaactgctaagaggaccccccagacacgactttatgcagaggctccttcttagctgtgaaggatatgttcaaaaaccagcagcggcttcctgaaaccacggataggactgagccttataatacactatgttttttcctatacttacatacctatgataaagtttaatttgtaaattaggcatagcaagactaacaacaatgactagtagtaaaatcaaatgattgtaacaatatgccagcatcagtacctcggtgctttagggccattattaggtaaaataagagcgacttgaacataaacactgagataccgtgacagtccatctgaaaatgagacggatctgaaaagaaggacaggtttcatcacactgacagatgcaggaggctgataaggagggtcccttgaggatctctgacccacctcacaagtgtttacatcagacgcttttgatcagatgagaaaacctgcccagggtcttgtctgcgcatgcctggaatggactggggacctacctgcactgggaagatggggtggagccatgggaagttcatgccttgtgcagggggaggagctgggcctcttcagctagtatgtggtggctggtattcaatctgtgaggtgggagccattggcaggattccctctcactttgctgagtgttttctttctgctcttctcacccttcaatgtgtccacatgcctaattttttctggttaagacacaagaacgtggatttagctgaactaaggagcaaaaattctgcatcattaagatggcccatatggggacatgaggaagggtgcgtaaggtgcggatgaaaaaatctttttcccttttatttctaagactttttgttcttggacttcttcttagggtagagaaaactgcgcctgccactgtccatatcactctcagggattgggaatggcagtgtcagtccaattcagcctttctatgggattttccttccttttttcgggatggacaggcgagcagccagatatggcccaacatccctgcatggcagactggccagtgttccctgccatgtgtccaaagagtcttcacctccaagtcttcccctcccctggccaggaagtccagctccatctaacagcaataaggtttttctccctgttggagaaaaccatttgcctaagaataagaggtgatcaccccaagcatctttcaaaccctgcactttaagcggtttttttgttttgttttctttttcttttttttttttttacccagttagctgttaacacagccctgaactttaaatgttgttttgcttttttttcttttctcccccaggtcaggagttaacttttaagggagagttttttccatttagaaaacattttactaggccaggaccccaattatcactgtttatatcctctgtaaacagtgatgttgtttttgtgaggttggtctcaagctgtagccaatctggtgtactttgcatgtctttctgtgtaatcagtagcaaactttgctgcaggcctccaacttgttttatgtatttgggagtgtgacctgtaatcatgtggcagtactttgttttagcctccaccattttacaatgacagcccaggttcaatcctggcttagggaatgagttctttctggtttggtatctgcatcactgttgccatttattgattctcttctcctccataaaccaccttggattttactttctttaagcctttaaaatacttggccacttggtacagctaaagccaggtaataagggatttgaaaagattttcttaaagaacactcagcttaattaaagtggatatccaagttataatatatttaaaaggcttttatgtttttctcttctgggatcttgttttgatggaaaagggttttttctcagtcaactgaattatttttctccattttaccttgccactcttaatgcatgcatgaaaggggagagacctctgttttcctcatggggctccaggaattaaaagtagatccctctaaaaatctgtttttgtatttcggctatccctgtttattaggccctagaaaccacatgttttcccagtcttgctcttaaagggctccacccagaggccaataatccaattagtagatgggcaaaaaaacaaccttctagctattggatctttctctgtcggtctatgtagttatatatgtgttttgtgtgtgtgatgtctgtaaaaaaattagctctaattaattgacttgaagggaatttgtaagggggagataaaggttgtggtaccttttagttcacatgattttaatatttgagaaataagagcagccttaaagattactggtaaaatgcagaagtcatcaaaattaaatttttgcctagggttaaaggattgttttgaattagataagataaaggtaaaagtgcaaacaagctgtggaaggattgtaaaaattaatcttgcaaaagaaattccatgtgtgaacataatgactaaattcaaaagggtatgatatggtttttctgtaaattgagcattgaaataaaagcacaacaagctactcttaaggcactaatctgctctttggcaaaatttgtaaagggttagaaaaggtttttctttttaaaatttctgaatcatcattttggcaaaataaataacttatggcaatctggaattctatttcataacatcaagagttttaaacctctaacacatttaacaggcctccccaaatcaaacatcagtttcaaaattgtctttcctgacaactggcttttggatgctacagagagaatctgcagcatccagaagagaagtaagcaggattatttgacatgtttaagtacacaggattaccaaaatgatgtttaatgttctttatgttatattttagggaaaatattaatatatgttccaaaattgtatgggatttctaaagttctaatatctgagtatatgctatcaatcacaattaaggttgtatgttaagttattataaaccactgagataaccaaatgactttatcaattgtgtttctaactgtaactaccctgaatattttgtttctcagagaccattgtcttgttttgatcctcttcaaaagacagtttatagtcaactacagaaatttgatatctgctttcaaatgcaggtttctgataactttggagattgtgacattggaataaaggaaaattgtacaggactcataaagagctgaagtgttcatgaatatcaagcaaaacagagttacctgaatggactgaactaatagaaaactgaattaatctttttgacttctgcttggaacattgctgatccatgctttgtttttcagaatcaaggaaacttatcttaaccttgagtaaggtatactcctgtgaacaaaatttggagcatatttacctctctctctttctggcttctccagaatttggaaactagttgtgagtattcttaccttatggcaatatagttgtttgcatcagtgcaataataatccattttcttttgcaatgagatgcaattggagaaacttggtgtgtcaccaaggctttgactggaatggtatgcttctctttaagcagtcaagcttgactactagagctgataaaagccccttggtaaaactggcctcataccctgtctacaccatccctgtacagggttcctaacctgcagtgaataaagaatgtcactttttaacaggcccaagaaactcgttttcttgggacctcaagaaaagaggagtttacccaactcacaggtatttgagggtacaaacccatagctgggctcagctttaaaaatcctatctgagattccttgtgaaacagagttccatcaaagccaatgcaaaaggcttatgtaaaaataattattcttgtggaactttatgcaaatcatcaggccaagtataaggctaaactctattttgcaaataactcagtcatatcatgatttgtttttaacaaaaatgaggattggagagagagaaattatgtttcaaaacttatctcacatttgtcataaattctagactccttagttgtttttaagtttttgcttacatttcaggctaaccttgtttattcctgtgaaccaaccagcaatctccaactgcagctcagaaggaacaaaaggagatgggaaatgtaaacatctggatcaatattctagttctgagcaattatcctgcagatcctgccaggtgatgggaataaaacaggatacccatcatccagaggtttcctttttgggaaagtaaggccaaggcagctaaccaaagccaagccccatgcacccaaatcttggcaagcataactatagccaccagttatctgtgcatgtcacaagacatctttttctctcccttgttggaggaggactgaattccacagcttcattttagcatttggcttatagtaaggagtccatgcagccccctcaaaacatatttttggttccaaactcaattccaagctttgggtagaagtctcatgaaagaaaactggatctgagggatccagaagcagatgataatggaagttaaaaggcacagtgcaggtaagcgtgactgattcctgctgattaagccaagcttcccatttcatggataaagccatgctagtatccatagcataaatgaggtgtagggaattctaaggctactgaaacaggggagatagggcgtacaaagccccctggcccacgttaacataagtgaaagcctctttgattccctgtcactcttgctgggacttgggatataagaatggaagaaagaaagagaaatgactcactttctccccctcaaacaccctgggtgttcactagaaaagagtagggaacctgagatgcctcactcccgtctttctacatgagtagctattcatcttcagtgtgtacccctttcaaatgcatcctgaacccctaggactcctttgaaaaaaaatgccctcttttttctttttcctcctctgtcctctcttcacagataggtaattttgtctccatgctacaggacattccccttggatacatcctccaaactgggaaaagttaatttcccaaaccttaaactggttggcttaagattgggcttggggaaggaaacccagaagcttgacatgctggcaaaggggaaacatttgtttttttaccagtcaggcttttggcctccctcttcctgtgcgaattggtaaaaggccttgggattttttagctgtccttaccccaccttgtttccttttgatacatcttttctaacaacccagtttgtctcttctcaccttcaagacatcaaacttcaaatagtcatgcaaccagagcctctgactatggccccttctgccaggggacccttaggtcagtccctgagtgagctgactgccatttgcccaaagcagcgccccctgtcagcaggaagcagataagatcaatcttcatccttaccttatccttattctaatggtagttaaatatacttctttagactggggaatgatagatgtaggaagcagataagggtgggggggctgtccctggagaatctcccacctgccccacaaggatttacatcagatgtttttgtgcaggtgagagactctgcccagggtcttttctgtgcgtgcctgcaatggactggggacccacccatgctctgggaggatggggttgagtcatgggaaatttgtgccttgggcaggtaggaggagcctgccctcttcagttcatgtggggtggactggtattcaatctgtgtggtgggagcccattagcagggctccctcttgttttgttgagtcgttttttatttttatttttattttttcccctttttgcccaataaattctgctctcctcacccttcaatgtgaccacttgcctaatttttcttggttacagctgaatgaaggagcaaaaattctgcatcaacactatgcagaatggtgcacaatttaaaccatatgaattgcttatttctggaatgttccattaatattttaggaccacagttgatcttggaatattgctctgtaataccccataataatattgaaaaatagagcatatagcaaccaatacatggtaaaaacattctatttcccaacttcttccaccagcgctacgatttcagccaataatttccaagttattaaagttttggtgtttggctttaccaatttttgtttcactacatggcatgggtctcaattgtttaagtctcagagaagcttcctcgctgcatgccacccaaacctaaagccggtggcttcattttatatatatatatatataaaatgtgtgtatatatattatatatatattttatatataatgtgtatatattatatatatttatatataatgtgtatatattttatatatataatgtgtatatattatatattttatatatataatgtgtatatatattatatatattatatatttttatatatataatgtgtttatattatatatattttatatataatgtgtatataatatatattttatatatattatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatatatattatatatatggtataaggaggtaattaatagagaaagtttaagcatgagtgtggtcttggagccatcttttctgggttggaatgccaattctgctagcttttactagctggaaaacgctgggcaagttacttaaacattattttcccacctgcaaaaagattgccttgttgagtaagatattggatgtttctaaagccattgctatgcctgagacagaatgacaagcatgccaccacagctgtacctggctcctgacacctgtgtatggctgatgtgtcacatctgtcctccaacagttttattctactggattcttaaggtaaggcacagtcttgctgtggtgttagttgtggaatgaagtatttgtttgctttaagaattatatcagaaatgggtgaattctagaattaattaaggatgcctgaaataaatatatatttatatattttccccacatttttaacatctatgaaataatagatgaatgtcagagtataattatcattttcataatagtacataaagtattacaataataatttttacaacagattacagggcaacattttctaaggaagatgtatagaaaataaagcaaaaaagaacaaaggcaaaaaacaaacacacaaacaaaaaaacccatggaataaaaacctgtttgactgatttgactgttagtctgtgggtctgttagtctttaggtctccagtgtctcccaaacaagaatcaggctgcaaagctatgtggtgcttcaacacccaaatggcctccctggcccaagggaatgatggaaaaggaagaccctctcacaggacagagaatagacacttctgacagtaagatgaattacagccctgttgggcaattgctcctcacacaacagaagccatttgctgctgagacatgagacttgttctaggccagaggtccaaaaaggacagtgttgagcagcttaaatgaagagagcaacatgtttttttttctcaatacaattctctatgggttttactatcttcccacatttagtattgtagaagagaagcctaatgctaatttattaatttgttttcttggcagttaattgtgctttctgttctcatattatatacatttttacatcggttctccttattttggaaaaatcagaaattttactaaggtatgtctggatgtcaatctttttatattatttgttttcctcttcaagaactttcttcagattgagaatatcttttctatgaatgctatgactgtaactgttggttgtctttccttctagttaggtacaagcacacccacacacatacacacatgtgcacacaggcacaggcacacacatatgaacccagacacattcacacagatgagctttttatcctctgggatctatagcttatatcaatagcttgtagtttttcactttgtcgttatctgttaatactttgtcctttaagcaggagaaactttcctccaaacaataaattccatttccttcctgttcagtatcattgattccagcatttgaaattttaataatcatattttccatctgaaagcagtcatttgtcatttctgattgttctgatgttctcattaaattgccacttttattcctttaatctgctaaagaatatgaatatgaaataaaggtttttggaatattctttttttctcatggaatgtgtccacaatttaatacagtaatatttagggtgacccataacttctcacaatgttttttttttttttttgcaaattttgtatattaagagctagttatctgtggtcatttttgtccagtcataggatttaagttttttttaaatttcctgaggttacaaaagatgctttaaaagtgtattttccttataatgcagccataaaaaagaatgagatcatgtcctttgcagggacatgaatgaagctggagttcattgtgcttagcaaagtaacacaggaaaagaaaaccaaataccacatgttctcacttataagtgggagctaaatgatgagaacaccatggacatatagaggggaacaacgcacactggggccttttggaagttggagggtggaggagggagagaatcaggaaaaagaattactgtactaggcttaatacctaggtgatgaaattatctgtacaacaaacactcatcaaataagtttacctacagaacaaacctgaacttgtagctctgaacttaaaataaaagttttgaagtatttttaaaaagaaacacacaaaaaacaaaataaaacaaaataatataaaataaaatgtgtattcctgagttaggggttcagttgagtctgaagtgggcttttgtgtcacagcagcacccatgtttctttctacttcatgaattcagctgcagcagccagcagcaggtcatggttgttcatctccggccaggattgttttgtttgctaggaggcagaatgatgaaaaacataagagaaaaacgcatgcttatatctgtttatataatcagtttgttatcagtttgtggactaaagaccaatttgtcatgttcctggacagagtatattccacttttacaagcttccacacagagtcttcaaacttttctcaagaaagccatgagctttttgaaggcagagatggtatctactctagtgttgaggcaggaaatttacacttgtgttcagtttttaggactggttgtaggaatgaaagaatgaatgaagatgcaagccaaacagtcgatgggtgagttctcctgtaaccactgagctgtgagagtcctgctgtccctagactgccttactgtgtcccctccctgggagagctgtggtgggtgtactctgcaccaattttgtgctatgctgggagggcatctcagggaatggtaggtgtgtggtacccgaggagatacacatgtggtctctttttatccacgtcttacatatctctgatgctgcacttcatctctccttggaactctctccatctctattttctctgcctcccttttctctgtccaggtggctcgaagctcaaaggatggagaaatcatcagatcagtggatacgataatttgtttaaattccaactttgtaaatcaggggttatgtgactttggccaggttgttcacttctattctgagttccagtttctttatatacaggacccagcactgaaacagatgaactttcaggtatttttgagtttctttagtcaattctcggtctcagttcgtgcccaccggtcagtttcccagctactgttagcttccaggtgggcaccccactgcctctccccacttttcttccaccactctctagagaagcccatgctgctggctctctccttagaagtaattgcatttctatactgccttgagacgcagataacaatcccttttctaggtaagacaattggggttcagggaggtaaacccactaggaaaagtgacatcgcagttaactatcggaaccagaatttgattttaggccaatctgaaaccatgatctcttgcccttttgtattttattttgctcaaaataaaaattcagaaaggatggatcaaacatggattttattaatttagaagttaattcacagttccacattgttattttctccttatgtgttgggcactacgcagagaacgcagactgccttggtatgagtaaataaaagggcatttcagtgctagctgatgctggccgctagaccctggtttggagttgaagaagagtgatcactcttagctttccacacagaggtaaatgggcaatgccctggcctcctgtggcgtctgcagcagtgccgagtctaacttgcaggtcagtggtcagtgatggaaaaggactcctgcttgcttgatgtcagagctaccacatgagagaggctgcacaaattctgacatcaaactgccttgggagaatgtacatgggactaagtgggtgtgggcttgaccccactcttaagtcattgactaattcttttcattagtcacactacactttctaaatctaaccacaacatttagaaacaacatttgtttggaaattcaacatgctgcaccagaaccaagtttgatcatattgcttgtgactcagggtctaaagactgcaacaaacttagcaaagatgtggttggtatccaaagggaaaagctcctcattttaaggtaacatctgcttgaagggcttggtgccccagagggtactttaccagaaggccattaaagatacaaatggtctctaaactccaacttattttatgtttcaattcagcaagccagagtcatcaatttttttttctttttttctttttctttgtctattcaacaacgctagtcacggaggcaggtaaacatgaaattggcagatgataaactctgaaaactaaacccatatagtaaagccaaattaaaacatttgaaaatgtttttattcttgtgtgttggttcattcaaaatagagacttcttttttgatttttaaatagatactagtttcattcccatgacagttttgttaaatataaagaatattttcttgtacatcttccacaggacaataaacaaattgaagtgcaaagtcattctgagaagggaaatttcaaaatacattttaggatccaggatcttttgcactgcatgtgaattagctatttttagcctaaacataagacttatatttagaggctgaaatcagctgatatagccttatttatggtctgacccaactgagagatgaaatccgctgtgatcatggactcagacacataaattcaaacttagtctctaaatataaggggctcctgatgactacaggtgacatttgctggagttttcagacttaacaaaagagtgtccctttttgaatgttttagattacatttttttaaaattgaatttttttaattcagcagctaaatttcatttaaaatgattttatatcttgtcctgattactaatgggggcttagaaatcatactgaaaacttcattaagttcctcattcatatttcagtaaaagttgcctcaattgactttcatatatattttgcaaacttagattaattttatcagaacatctttggtaaaaattattgatatgcttttatttctttggaaaatataatgtattagccaacctactgtggtaaaatcaactgtgtttttctcagtagagggacagtccattcttttctttattcttataagcaggggagatcagatacttccccagccacaacgattcagaattactcatttgaatggaggatataatctcaaacttctttctgaagctagtaaatatcatcctagtctaaattagttctgtctagagataattcaacaaatgacgtttcttataactggatttcaccttcttttctagtgaaagtgccttttaaaatgtatggagtagtgaaatgagcagatcaaggaatttaaagacatagggaaaataagaaagtggtaagaatttaccaaagccatgagctcactgtctttttcttgacatgtttgattagtttgtggaactgaataccttcacaacttagagtaataggaaaactacctctccacttttgttgttgttgttgtttgtttgttctcagaatttggcttcattttgtaggagagaaataatgcggagccattttgagacagaagtaggagatctgtcaagtcaatactgcattacagtttggtccgttgaagaagccatgcctgagatataaaagatgcttctacactttacccgctttatgtttacttcctctccccttttctttcatcaactttattgggttaaaacaccacataccgctttctctaaatgactccctgtgtctggagtttggttagaattttatgtcctaaaccaaacttgtggctatactactcgtgccctgccataatacctgacataatacaaaatataaagtcataggaaaaacttctggatgccatcccaaaccatgacatattcaatttagaatctcctgaatgtcaagatgacagatggcacacaatctgtatggatccagctcttgagcagcagaagcacataattgcaaagcctacgctgattaaaagatacaaacactatttcaagttgtctgtatcagaatcacaatgtttgtttaaagctgatccttcactagaaaaaaaagccagtttggttaaattgaagagaatgtggtaacctgtcaattctgaatagccactccatgaaaacgagttaatacatgttagaaagatgaaggggaggagtatttactgacacagcactcttcaatctctccattttgattacaaaagcaggccttacaatattgatttcacataatatgcattatttgccaaattttaaatttgtcctaattagataataacatgtactggtgttagtctttcccatagatgtcatttttcttgcgcttcatttcctcaaagtcaaactcgaatcctgtaatcttcttatagatgtttttaatgtcatcacaattgtctcaaagtgagtggtagggttgtatgcacgggaaataaagatctggctttctgttcccaagtctttcggtaccaggaggccactgatactaacaaattcccatctagttggctccaagagctccaaagatgatatgacttccttctcaggctccttggtttccacagttgtggtaactatggcaatatacttctcttgtgttgctacattgtgcgcagaggagatcgtgcaaacacagatatctgactttctactgacttggttctgtggaataatgatctggcaggagttgacatcactggtgttcttgatggagtggctgaggatgcaaataactctgatgacctggcccactttttctagctgatcttttacatagctagggtcacagatgagctgcttacagtgagcaatttctccttcggattttataccaattacttttccatcctgcacaatgatttcttcaattggcttattcagcatataggtacctccataaatagcacttagccttgcaaacagccttgtggcagttctccaaggccatagagtggataaaggtatggacttttgacgtatcttgccaaagattcactgtcatgtttaattctattaatggtttcacaacatggttgatctaagtagtcatcagttctgtaaagtgcaagagcatgaccagtaaaatctataacatcttggcccaaatcaaatttcttatacacctctcacattgtggtcttcttaggatcaattccctctaaagttctcggatctttttcatctaagttggcaacataaactaggaatttcctgaagtgacgtttcttaaacagtcctattaagctagatgtcagggcttctgtttcagtggaaggaaccttgtagatttgtccacacttatagacaaagctcccttcagtcgctaaaatccagatagtgagttatctctgtataaagcagcatttaaccagctgaccattagccacaaggaacttgggaatcaagtcaacattccagtctcttcctctccccattgatggttatggtggtcctggtattttaaatattttgtatacatcttccagtagtgttatagaggcactctctcctccattgtaagggtttcaatccatatgaagaactttcttgcccttcactgatgttacacctgaaaggatacattccatcaggccaatgcccagcacaatcacatcatactcctcattcatggtgggtggggcaggtgtgtatgcaggacccaagaaaggaaaaggcgcacggactctgtgacctccctacgaggctgtgaggtgctctctggcacaagggaaaagggaagagtactctccacttttttttttcttttctttttttttttttctgaaatggagtctcactatgtcagccaggctagagtgcagtggcgcgatttcagctcattgcaacctctgcttcctgggttcaagcaattctcctgcctcagcctcccaagtagctgggactacaggcttgcgccactatgcccagctaatttttgtatttttagcagagatggagtttcaccatgttggccaggatggtctcgatctcttgacctcgtgatccacctgcctcagcatcccaaagtgttgggattacaggcgtgagctaccatgcccactcctctccactttttaaggaaatattatttctagtgaagtttacactggatcttcaattttatgaaaaccatctaatttaaaaatatcattttcaatactttttctttgacttcattttcctaagtatgtatttcccctgcttgaatatggcttaaatatattattttatttccatagtttgaaggatattggatttaacattatcaacatgtaaatcactgctctgccacttactcagttgagtaaaatgggaataataatgtctaccatgtgaaactgcaaaaagggttactgatatgatgtacgggagatccctagcacacacagtatctggtggacagctgtctttcataactatgtgttaaactggaaaatcaagtcaagtaatctttgatttatttttacaaagaatatgaaacaagatagcataattaatgatagagacagggcttcaacccagcccctctgttgtttcaaccaccttttcaggcccataggtacaaagctaaaaaataaaatacaagtaaataaaacagataacacacaaacatttttttccttattcttaaaacatatttctctttggctgcacattcattctgatgcaagtttctctgtagagagttgttgtccagcgtttattgtgtgtatggctggttaaaaatgaatgtaaaattctcagctcttgcaaaccaactgcaaagacaaagaatgacagccaaatggggtagataggtgtcccaagaaagcatctcacagaatcattaaccaatatgccctgcagtatcagaatctattgatgttggttctacgctgagctctactgccatttgctatttattttgacaagaagtgaaaccatcaggaatgtgctgattcattgcccctttgataggagatcatggggcacaggggacagtttggtgagtaggcttcacactgtgctgtgtttttcccagaaggtttggtttatcattaagaagcagggaaatgtggcagaaaaacaaaaacaaaaacaaaaacaaaaacaaaacaaaaaccatggccttgattatatgacactttttttctttttctttttctttctttttttgagacggagtctctctctgtcccccgggctggagtgcagtggcgcgatctcgactcactgcaagctccgcctctcgggttcacgccattctcctgcctcaacctcccgagtagctgggactacaggtgcccatcaccacgcccagctatttttttgcatttttagtagaaatggagtttcactgtgttagccaggatggtctcgatctcctgacctcgtgatccacccgcctcagcctcccaaagtgctgggattacagacgtgagccaccgcgcctggcccgaatacgtttgttcttaatcattgccataatctccaatttctgccttccttaccattataagcataatcatgataaaatattatcttttcctagaccaatagcgtccttctgacttcttttcctttctccagagtccagataaactgcctcggttcccttgtcttcttaccctctgcctaaggcatcctaggaatgtttatcttggctctacctttatcctgtacttctgctttcctgtaaggagactagtcctacctgtgaagcaccatttttcattctcagtacattgttgactatgcatatcaaagaactatatgataaagtacaccatgattttattactagtatggtttctgattgtgttctagccacacatcattagtcctgctattaagaaaactagtaccattcatttccaagacaaataggtgtccctacctaaggcattgagagataaggccatgcatattcataaggaaaattttctgctcccaaagatttaactgatttttctctttaagcttctatagtaaaaataaccagaagttcagggaataagatcaagcccagaatcacatcattcctgactgtgaaaaacagatctttggtatctatataacccaagaacatggcatggtttcatacgtgaactgagaatattaatatttatatagtagtcataaaaacaaaatgatatcacttgcatataattcgatgatgttcaacactgtgtcttgcatatggtaggtgcttagggcacagttttctttcccctaagatagtgcatctcaagtgatgtttgtttcataaaattggagaagggaatttaagtcattttattgtttcatatatgaagtatttgagctttgtgttccaaatacgtcattggtaagacctatcctttgtgcaaggaaccctgaaagattaacttaagaggaccttactttagcaatgaattcccatagacagatggcacctctgatggatcactgtatatgccactaagtcccactttggtcaggagagttcattacagaaggctcactctcacccattctgctgtttgctgcacattcagacttctaagattattcaatgctttctcattttaattaaagtaatttcatccaaatgaagccatatagtatgtccaattttacaatgtgctgatattttgcaactacatgcaacatttgtgtttatattacatttgtacacctatttctttgtgttttgattgcaaattaaaaggtgagcttggaaagatgacattaaattttggtaatgaatatatgcagttatatcaagttcagctagttcatcttataaataaagtacttttaagcagaaatccagacaatctttcatgggagcatttcagaggtaaatgttagtccctctctgcacctctgcctccttccgtctccagcatgcagcccccaggcagctgtcctgacagatgtctactccacaagggctaggctggactttgggcataaaataacttaaaagagggtacagctagaccctagctgttctccaaatcaaagtttcaccaaaagcaggtattggattaggagatatgagaactattttccacccctaagccaaaactgcccattttagaatgttatcacttctgtatataagtcgctatagacttttctagctagcactttctgtggctacttaatgaaaacacccaagggacccagaaagttattctttattgttccttaaaactaggggatgatgggaagggtatttaagctcctcagagaaaacaaatggacagtgctgctgtctctccttcccacccccacccccaaatccctttaatttttttctttctgtgaaccaggtcacatgatgatcaactctgtggttggaagtcaggaatcttcaaaggagtgggatgattctgcaagaactcccacattcttagtgattgcacagtacagtctgatcaaccctcctgaagaggacagctgcttcatctcgataaacccatcgtcataaatcacacgatggaatattacacagcaatgacaaggaatgaacaacgggccataaaaccacatgagtaaagttcaaaaacattctgtggagttgaaaagtacatggtgtaggagtcaatttatgaaattcaagaacatgtagagcatggtatgacagaagtcagcataatgaatacttctgctgtgaagattgactggggaaaaggatggaaagactttctgagtgacagaaacagtttgtatctttatctcattgaaagtcagacagctaaaaattgacctggatgcacacttcagatttccacattgcactgtatttacataacacttcaatttttaaaggcaaaggaaagaagatggtgacccctgtggtagtagtggatgtctctcagtggtctgaattctagagattttcctggcattaggaaaaaaatgcaggatttttaacacatacggccaagagaagttgaaaaacatagctaaaatgcgcttaaaaacaaaacaaaactaaacattagcataggttttgtacatcctagttcctctccctctccttctctttctctcttttgttcaaatgctggaagtgaacaacaattgttttgataataaaataactacacagtgtcaacaatgtttccttcattgagttttgaggctacagcaatgacaagaaaaaatggactttcatgttaagaatctcaccatctaaaagggagttatagcatcttttataatattaagttgcatttgctgactgctatctatttacactcaactatacacttacaaggttctacctgcttttttgtattaactattttaacactcacaaccaacattgaaggaatgaaatatcttgcctcaaatcaaagaattaataaatggtaaaggcaatatttgaagcagacagtgtatttctggagactattctctcacccactacatgctattaacatttaaccatgctatgagataaacaaagaagttctctcctagtttgacttctgtggcatctgtttcttttctttttttttttttttaacctttccccttctcttctctactttttactttcctctcctgattcactttcatctgcctgcctgttgaatatcaatgttccacagtttatttcctcggccttagtttcttcaaattctggaattccatccagaaagaaacatcatttattgccagtttcagtcaccatatgtctttctttctggggaactcatctacctgcatttccagaggcaatttcaacttatctggtctgtcatttaactctatatctttcttccaaagcttgtttctcctaccatgaaagttggaccttccactcaacttgaagtcttgtcagcacctttgaccagctttacacccttatcctccacaacaaatgcacagtgacctcctgtctctcatacccttcccctccactccactaacattaccttggctcagctctcatctcttacctgaattgtaacatcccccagtttcacccatccaaatacatttccacactgtggagaacacacaggaagctttctaaatttcaaatgtgttcactctactcccttgctttgaaacctacatttcccacaggataaagtccacattttatggcatgaaaacctttgccatcgtgcccagatgttaatggtggaagtgccagcctaggcaaacctaggcaggtgcactaggttggaaaccgtgtcagaagcaatgtaggaatgaggattaaagccacaggtaaagtcaggtcagaggtctttggaaagtctttatgaaaatggatgaggtgtgggcttggtactgatactttgaaatgtttacttgcatcgttcgttcatcattctcaggaaaagcagcaacctgcagctgggttctaaataagatttccagttttgtccattccatcccagatgcacccaggtgctctcttccttcagaggaaagaaatatctagtccatcaatcactgccccccttccaatattttagggtatgccctattttcccattagttcttggtttaggctacttctttcccctgcccttggcttcctttctgtcgggagaattggctcaccaaattccacttttcctactgtgattttattataaagatagaaaaagctaagtgttcatgttcccagccttcagtgtagcttctgacggtcacgtaacataaatgtgctcagtccagcattcacagaactctgctgctgcctctctttctattccttcttcctgcttggaatgcagatgtgatgttagaattggatcagagaaactgtgactctggggccatgaacccacccacttcactcagagttatgggaagcttaatgtgaatgtgctacatcgaccctggctcagctgcctctgggctccctgggaagtgagggaaatacagccatatttgttaaggggaaagttggagtcgctctcggctccacacagctgaaagcattattaactgatacagcctttttcattcataaattataaggaaggcataattgtccttacttcacagacatctcatagaatagaaaagctaactaagctggtttatcttggaacaagattggaaacttgttatctgaaactaaagaggtcattttccactctaaggtcagtcccagtgcaaagaccagcagttgtttttgttctctcttttggagataaggaaattgtggcacacagaagctttgagtcttgcaagtaccataaaccatgttctttctctgcctctcttctgaatctacttccttgccgtaccattctactcaacacagccaatcagaataaagtctttgtcactcttttaagtcaagaatctaccttagatatcagtgggaatattttattaaaaatacagcactaacagttatagattttatctatctttgaggattcttttgtgtattatttctaaggtatcaaagaataatgggccatttccctaaaggatatttagtatttattctactgtaaaaattgctaacactgttattaaatatatcagaaaatgtttccctgtttgaccactgtttttgaattgtggccatagaatcattaattagtttttaggtactcaatattttataatctgttcactgagcatgataaagtaattaaaatgaattagactgagaagctacagagcaacagatgttaataccgattgtaaatgactgaaagaagctgaggagcaagctgaggaattaaagatgattctttgatatgcatttaggatatgacacttctataacctcattgaaggggattccactcctttatgcaaacgtgtcattaagaagagaccccctggtctctggaagcctccaagatctcaatacttctctgcatccacatttattttcctttttttactctagtattcctgtctctgtgacatcctattgtttcccaatttaatttccatcttgaatactatttcctgatttgatctctcatctctgctgccaatcccctggattcatgactgcagctcatgcaaaagctctcatctcttacctggaattagaagaggcacccaagctcctgctgggatcagagggtgggccttctgttacatattggagactagaacaagcaaggatcttgccctatgctgacagagatcacatttatttttaaattttgtgtctgtatgtttgtgattccattttattcccatttcttttaggagatatctgctagccatgaattcacttagttttctttgactgagaaagccttcattatttctttttcacttttgcagaatatttttgctctatatatgacagatttttgtgtttatctttctgttttatctttctacactttaagtataccatgccattgtctctttgcttgcataatttatgatgagaagtctgctgtaattcttatccttgttcctctgtgaccagcatgatttttttttcccactttctttggagatttgctttttgccctggcttcaggggagtttgaataggatatggggtgtgtgtttgtgagtgtgagtgtgtgtgtgtgtgtgtgtgtgtgtgtgtgtgtgtgtgtgttttcagtattaattctgttttttttcctctaaactccttaggcctgtagttttgtttattggttttagaaaattctcagtcattatttcttcaattttttttatactcccttctccttttcttattctcagaatgcaactatgcatatgttacactatttgattgtgtcccacagtgttgggatgttctattagtgttctggttttgtttttcattttttttctctttgcttccagtttagtaagtttctataaacctatgtttaagtttactgattctttcctcagccatgtccagtctactaatgagtccatcaaaggaatttgtcatttccattgctatatttttatttccagtatttcaatttgattttttcttataatttccatctctctattcaaattatccacctggcactgagtgttgtcattttgtctagcatttccattgaagccgttaacatgttaagcagagttttctttttcaaattccttgtctgataattccagcctctgtgtcatggctctgtctagttctaacaattgctttgtcacttaatgactttttttcttgctttttaatattccttataattttttggttatagctagacatgaaaagaacagcagatattagataaattttatatgttgggagaaaagcacaagtttccttgtgtgaggccttaaatgtggagatggatgttcatctggtcagaagacaagctgcatctgaaactgtttgtgccatgggcaccagcgctttctggccactccattggtgcccttttttggctcccacttgactgagtctccccatgtgcctcttcacagttgtattccactgctacttttactgctgttttttacagtggtggtggtcctggctaagaagaaggttatctgatgttcacatttagctaaagattttggcacgtatcaaaacctaagtcctggacatgtagccttcacagctattcctgtcccttttcctgggataaaaattcttcctcatcttattgctcctcttctttttcccaaattgcagtggttttgaagccttttctcctgcagattgagactttggttgcttaggggaaactgggattatgcttctggttggagatttggtggtgatctctatttccatctttcagtttaataaattaaaacagtgtctcagggttaactttgataattttccctccagattaagccttttatccatgaagtacatagttggaaatagtctgggtagatttggcagtggctgcttcttccaccaaccccagccagcactacagtgtgtgtggggaaaggagtgagggatgaactttttctaggttcttctttgttcccctttgtaaatgttgggtgagttcctggacaaaaagctcacaagagagtggaactctctcctaggaatacagcctttggaagcttcacattctcacactagcccacccgcagcctccaaaagttctatacaatttttaatttttgattggcttatataatatacagtggctcctgtttcagatgagaaaatgctggagccttctctccagatgtcgggatgtcacttttccctatgatatagtttggatgtttgaccccttaaattttcaagttgaaatgtgatctccagttttgaagtggggtttagtgaggacagtttgggtcatggaagcagatccttaatggatggcttggtgctgtcatcacaataatgagcgagttctcactttagtagttcatgtgagatctgtttgtttaaaagggactggaacctcccgtattctctctctctctctttttttttttttttttgttgttgttgttgagacagagttttgctcttgttgcccaggctggagtacaatggtatgatctcagctcactgcaacttctgtctccctggttcaagtgattctcctgcctcagtctcccaagtagctgagattacaggcatgcaccaccatgctaggcagggtggctcacgcctgtaatcccagcactttgggaggctgaggggggcagatcccttaggtcaggagtttgagaccagcctgacaaacatggtgaaaccttgcctctactaaaaacacaaaattagccccttctctcttgtgccctctcttgacacatgacaatggctccccttcaccttctgtcatgattgtaagcttcctgaggccctcatcagaagcagatcaccacacttcccatgcagcctgcagaagtatgagccaaaatataccaactaactttataaattactcagtctcaagtattccttcatagcaatgcagactaacaaatgctacaacctcagttttctgatgggtccaagaaaagtcattgattttcattttgctcagatctcttgttgctgtggggcagatataacgacttcccaggtctttacatgtctgagctgaaactggagtccttatatcagtggtaaaaataaatactctacttaatgttattccattttacattcaatgtaatcaaggaaattaaattcttatacaaggagcctgaccgtgttcccattggaaagagttttatctagtaatttcactctacgtaggtgattaaatcacatggggacaaagtgagtgggcttatgctgcacagtgaattagtaaaagagcttcagatgagctggatttacatggactattcctataacttacagcttggacacttttaggccgaacaaagactacaactcatattccgctttcaagttgttatattttccacaaatcatttaccatttaaataatcatctgcatataaaattgtttactttagccctctcaaaatagataatttgaagctaaaatacgaattgtcatcctctgtaatttagagagcattttatatgacaattaaatgctgagcatggttagatgcttttgagaatacactgtaccatcctggtggcttatgagctttaggggagaatgacgcataaatatgagagaatatcaagaactaagagattcatagaagtgctaagtgcaggcccattatggaacatatcagcttacaggccagacactgaaataatgggattatgataggtaagagtgtccagtccaggccaggttattttagaggaatcatgagaagagcccactctgtcctggagcctacatggatggaatttttctgaaacatttcaaataaaagtaaaataagcaatctatcaattgccattaagtaacagaaaatttctttatattttccaaaagtatatcattagagctggaatttagtaggtgacctataatactggtgtttctggtcagctatcctggccaacccgcagtctgcttttctaacatgtaacattagcagagaccatcatttatccggatctgtgaagcctcccagaagagcctgcaaggtgaacagcagccaaaaatcagtgctgtggaaaaatgtgagcttctacctcacatgcctcctttcctgtttcctgcagtgttcagagatggctactcaaggtcatggttaccctcacacacagattctgaaggctactcttggctacaattcaggtaatgtccaacagggcaaagtgagagactagtttcttgtcaataatgataatcttttttaatacctaacaccaaaacagcaatcaataccatattggacttactcactcgctgggaatgttcagctagctaaagaggggtctggaatgaagattcagaacagtttcaggaacatatttattggagtggcattcaaattataaaacattgtaagtatttggaggagaaaacttcaagttgtgtgtgtgtgtgcgtgtgtgtgtgtgtgtgtattggaattgagggaatattagaaattcctaacttagtaattaagcttcttaagttattttcactgaaaaaggaaatctcagccttataattttcagcagatctaacccctaatttaaattctttgtctacttttcttcattttttttttgatgaatggcagccaaatcaatagcactcaagctaatctcactggttatgttcttaaaggaaatatatacccagaatacttgccaggcgtggcctaaacagctactatatgcatattatttccagattcttaatgtgtccctagcccagagaaaggcctactttagccttgttacagcttatatcaaggcccagtctcagaaatatttcttcatctcagaaatactttcatgactctgattctatgaggaaagacatcatgcaacattcagccattgtcaatatcacttttttctctttttcttgaacttacgcaatgatgttcataaatatccattttcaatgtatctattgatccatgaatacatttctgaaaggtcatagaaacttgacactaacttctaaggctttagaactttcttctttgcaaagaaccaaatcttgtttatttttcattcacattagatagtataacacagtcacatgaaataaagcaaaatgagatgaaaaacagtgtgctagttactatcattctatcatttaatactcaacataactctagcacgtaggctatgctatttataatttcaaaatgaggagacaatttcaagtagatgtagtacattgaagtcacatggtaaagagcagaggatttgggatttatatgaagatctgttagccttagagcagggtattcaaattttgccttccctgggccacattataagaagaagaattgtcttgggccacatataaaatatattaatcatagctaatgagctttaaaaaaattgcaaaaaatgtcataatgttttaagaaatttatgaatctgtgttgggccgcattcaaagctgtcctggcccacatgtggcccgcgggttgtaggttggacaagcttgccttagagcctacgtatgtgaagtaaattatattccattaaaatcttaaaggagtttatcataactaccaggaaaaatatttctaaagaatcatattttcatagataaaacacttagtgccatagcaagacctgctcatgatgactggacacttcagaggcaaaggaaacaagccttggtgtagccttgtgccctttcagagtgagcctttccaccctcttctgatggaaaaacttccactcaagcttaacatctcactaaagcattacctttcccctgaagacagacaggtggtggctctttcctccatgtcctcaggattaggactgcttgtagaatatttctgcacccccaacacctagctcagacactagaacacaaaagaaatgtgataagtatgtgaaagaagaaaaaaggtgagatgctgatcactgcaagccttgacaacagtagccatatgccatgacatccatttgtcaacaatttattttcctattattttcttatttaaattccccctgtgttaatgagaagcacttcagttaagtgcttaataaacaagcaattacttaatagacattaatggcctgctgtattattgcctgtaacataaagggatagtgagaggtacaaataaaacccaacatttatacatcatcttaaggtattagagagtattttataatataggcattacttgttaagcaattgcgcactttgctaattgatttggggtgatggatgaaagattagcataaataacccatttttgaagtaaactaacattagcaaggaagacacatggcactggattttgactaatttgatcaagaaacggtcttcctttgttcatttatatataaatttgctaatttgcccaaactaagctcaagtctagaaaacagtacttcatagttgcaagtaaacctgagcggggccttcttatcgtaattgtttcattttgcttcacagctgagtgtcttttcttctactcaggtgaccagttaatcctgacagaagctcccagccctctgtaattcagccctgtcatccttgtgacgtggattacctttctggctacaaattgaatcatggtgcctcatcacagtgttgttctccaagcctggaaggtatcctctgaacagacagcatgccaacccatgtcacccttgcttcttccccccacctctcattaaggtattgcacagagattggactggaagtcagacagatgtgggctgaagccctggctcccctaactgtggaatggtgctgttttctcagtctctctggtcctcaacttctctttataaaatcggtggacagtgggagcatataataatctcaagtacttaaaaaagttttaacttcttctaagctcctagtaattgcttttatttctcttacaacattttaattttttatcaaaataacacatgtatggaattcaaaatggaaacaaaactaaaaaagcaaaaagactttttccattccacttttcccactgccaaggacagactctgatcaatcctcagaaagtctcaaattagactgtaacttggatagcaaacaatgaagaagcttaaaagaaagagaaaagtaaaaatataaggtaagttggtaatttaagaaatgcatataggaagtaatttatctcaaaatatattccaccattcagaagcagataatatacattttatcctagaaatgtaacataggatattgctctaatccaaaactaccctgggaaaatgaaaggaggtggtgagtgtgtgtgtgtgttcaacaatggtatcctcattttgcatagcagcaagtcaacagacaattcttaaaactgaaaaacagggccaggcgcagtggttcatgcccgtaatccaagcactttgggaagctgaggtgggtggatcacctgaggtgaggagttcaaaaccagcctgaccaacatggcaaaaccctgtctctactaaaaatacaaacattaattgggcatggtggtaggtgccggtaatctcagctactcgggagcctgaggcaggagaattgcttgaaaccaggaggcggaggttgcagtgagccgagatcatgccattgcactccagcctgagtgacacagcgagactgcatctcaaaaaaaaaacaaaacaaaaatctgaaaaacaagaaattatgacataagccaattgttttagaaatacaggtggacatcatactcaggagaaaaatgattaaagtgattgtccctagcaaactaatgtaaccacaaataaaaaagtaaaattacctagtttttcaaagctgtttatcacattacagcagctgtgcccaactggtctcctcttttctctcaaagtctttatgtttttgtgtctttgctgaattgtttaattctttgctgacgctttctagtttttgttttgttttgtttttttgctgtgtacagtcattcctctgtatccatgggtgattgattggttccaggacccctcttgaatatcaacatatgaggatgctcaagattctgataaaaaatagtgtagtatttgcatataacttatgcacatcttcctgtatactttaaatcatctctaggttacttagaatacctaatacaatgtaaatagttgttatactatactggtttcttatatgtattatttttatcgtattgctgtttattattttttaatatttttcatctgtggttggttgcttgttggagcattttcaattcacctgctttaaaatctttgttagataattttaatatttggttcaccttaaagttggtatatatggattatctttttttcattcaggttgagatatccaaatttcctttttgtatggggacccaagtcatataagatgatgggcccaacctactccagtattcttatacagtcacattctgaagttctgaggatcaagacttcaacacagaaatctgaaaggaggaacacaattcaattcctaacagcagtataaatggatcccctctttagtatgatttttagactttataggaaacattctcattatttctcagttatttttggcataatgaatgaagtttcttctgaatgtggcaagaagtgtgaaccacttggctgctcaagcacaaatggggatttgcagggagaagctggtgctgtggtctccattttcctaagaatggtgccaagaataaaaagcaatgaagggtttgtgataaaagagtaaatagtgtaaagatgttcaaacacttctaagtaataaatctgtattaaaatgaatatttgtatttccttaatttcattaataatgaaacaaatgaagaaaattacctatatgttgagttcatacaattttttaaaaaacacatattttgttttattttattttaaaacttacttgtatttatttatttttaaagacaaggtctcactatgttgcccaggatggtcttgaattcctgggctgaagtgattcttctacctcagtctctcagatggctgggactacaaacatgtgcctggcaaagatatacaatgttttctaccaattcttctctatcccttcttcctgatagaatacaagcttgaaggctagaagtgcgatggtcctcagctcatattaaattgacaaacattcctgaagtagtagtcataggcttagctcttagctaaaacaaaaaacaaaagcagaaacagcagcacatgcgtatgtgttatatttattaactgtgcagttttaaaaggtagaattttctaattagttgaaaaatttcttactatatcaacaatacaaatgtgtttagaattcatattatgtcattgttatcataattggacctcaggaatgtaaacagaaatgtatttgggagaggtgcatatcgctgctgaccctgttgggctattacattcttttagactagaaaatgtacaggtgacactaagccagtggcagagaaattggaagatttgtcgagtgctgtgaccctactcaattcttcataatttttctagcagctctcacattatttttaaaatttaaagtccagttttcactaccagataattttgattgacactggagtgacaatgtctgttttctcaatgacacctactagttcttactcattacttgtcactggcatgaagggcaagcaacttagttaaactgttcataggccttacaaagcttgtcttttatttttatatggaggggaaaaacaatcctggagtgaaaatatgccttaatttaaagacgaattaagtgtcataaacggctcataagcacaaacctcctgaattgttctgacgcaagaggagcaaataaaagaaccacatgaaatccccaccttaatcattttattttatgacaaatatcttgcttgaattcctgcattttcttatatgccaaataatttccagcttgaaaaataactagaagccataaaagcatttactgttgtattatttaataagtcattttacaactcttgtatttcccaaatccaatagccctaatttttttgtattttaagttatttaaacttcacagccatacaagcagatgtatcaggtaagcatgtgagatagtatgttgaatatattaccatacagtatttctttatgcagaattacacacggcaaattctcaggtgcagtgaccaaacaatcaaataagatgcaagtactctgggaaccaccaagtttggacagaggattgtaagctacaaagttaggaaatgtaggagaatatttactttacatagagggaacagaatgagtataagcgccaaagcaagtatagcttctgggaacgagcttatagctggagctcaaacgaaagggaagggagaaagccaggctgcagaggtgactccatgactgatgccatagtttctctttccccaggagcataaacaagcagctgtgaggagctggggataataatctcaccataaaattcagaggagattcgggattggatatgtatttagggaagagtaactaaaatagacaaaaaatgaggactagaatttaggatgggggaaagacttaaaagaataagactaagggaagaataagaggttttagaaagagataaagaatggaggcgacccattgaacaactgggtcacctaaaacacatccatctaaggcatccataatgttgatctgaaataaaagtctaaggcaaaattagcataagtaaagaatttgttttggccaaatttgaggagtgtaacccgggaaacacatatgcaaactacgtcagagaagtgctttcagctggggaggttacaagcagatttttaaggacaaaacgaagaggtataccaaggtggtctcagcctgttcatccagaaataccattggtcaacagaaaggagctaacagatgattggctaaaggctacagcacttcttggaatagtcattatcagtttgtgatgaacccagctcctggaattcttataagtaaaaaggtacaggaatttcaggggagtaactgtggcatcatgacaaccctgtttggtcattgtaatttagttatcctcatttgttgggttttgttttcaataagcatgaccagtgagaacctccccttttgtttgatccaaccttacagaatagcttacttttccacacagccttgactctgtaaagtttagacgatcttggagacaattagtagactgctctttaaaccttcctctagttgtctgtatatcccaccttatgcagaaatggtggtcaaaatggtagctaatttgggtgagaaaataaaactttctccatgcccaacaccctccacacacattggagttcaacagtaaaggtagaaggagcaaaagggattcaacaatgaaaaataaataacctctctgagaaaagtagagccctttactttcctcccacagagaagcggccatggacatatcttttcagatgtgtcaaaagagtctgttcctgtggctacctgaataacaaagacctaggcagaaatcattgagttgtagatacaaacactctcagactagccagacaattgcaggaggactggggaaggaagaataagatagtatctccggaacttaaggagaagatctcttgagaagcaaatgccaataactagagggaaaccacctcaggctgaaagggtagataacagtctccatcgtctctggtgccacgtggtcaatcattgttgtttctctctaggagtctgctttattactttttcttagaagcatggccttctcagcctacctttcacttatttcagatatggctacccagattaaattttacatgagcatttcactcggggaccgcaaagagaataaggaggggctctgggactcaagtttacctcatagaagaagggatctgagtggcccaacctggatgaagtgacttttctaatcagttgtctttaggatttttaaaattattataaacaggggtctaagtgttcatggatagtgtggtgactatacaagcaaattccaagagcaagactgtctcatatgaaaagtcgcatttcttagcaagaaccaggtctctagcaaagagcaaacattcagtaaattgtttctgaatctattaataaatgataagaaaaggcaagggaaatcaacatcctcactgcatgccttcagacgtgtgtttcctatcagatacgggtattccaacagaaactggagaaaagaaaatacaatgcattcactggacagaaatattgtggacggggggcaagcattgggacagtggtgagcaaaattattcttgaggtccccattaatcaaaatatttgtggcatccagaagcttgaatctttaaggacaaatatgaatctttacccatcttcttttactcttctctcctttctcctaaactaactctaatatatacatttacttttaaaatttcataaagcctatctaattgggaatttaggtctcactccttgtggacaccagaaggatataaatgattaggggaaatcccaccaaacagaaagggcaagaagatgtatgaatgagtagtaagctcaagaacaacccatcagtcctcttctttattttacccccaaaccaaaacttagggatgaagcttcacgaagctctcttttgtgaaggagagaggcctgttccgttgccaaggagtgcaaagctgcacattggctttgggatgacattgggtataaaatttatcacttgtgatatccctgtgtgatcttctacacacattgtttagcttctccaagacttttctttggaaagcccacatagaacagaaaaaagaaatgccatcttttaaactatctatttaactatcttgtggccccatgtttccaaggttggggtattgggagagttggtgaaagagcaatatgtcaacattaacttgtctccaagcaggcatgactttcaatatcaaatggtcacaacctccaacttttaatggatcctaaatgagtgcttcaaaaatactgtcatttggtaataaagtcatactcgaagtaacacttatttggctgaatttccagagactggagagaaggttaagatccaggtggttgctatgacaagagcatgatgacttattcatccaacactttgttgatgtcagtatgatatagcccttcagttcatggtttaaaaaagcaaagggagggcggttgcgggagggagcggggcaggcgctgtgggccaggcccctcctctggctcctgcaccaccgcctcttttcgggctccgccggctcccgccgtccctgcaatgccgctctgtgcccgccgtcctgagagcccgcgcggcactggcgccagccttggcggcgcgcgcggggccgtggtcgttgctccctgactggccgcggcggcctccaggaagcggaaaagcaaggggcggtcgagctgggccgccgcgccccactgctcgccgcgctgctctttgacctcgcagggtgtgaagaagatgcgcagctccacgctgcaggacccgcgccgccgggacccccaggacgacgtgtacgtggacatcaccgatcgccttcgttttgccattctctacagcagaccaaagagtgcatcaaatgtacattatttcagcatagataatgaactcgaatatgagaacttctccgaagactttggaccactcaatctggcaatggtttacagatattgttgcaagataaataagaaattaaagtccattacaatgttaaggaagaaaattgttcattttactggctctgatcagagaaaacaagcaaatgctgccttccttgttggatgctacatggttatatacttggggagaaccccagaagcagcatatagaatattaatctttggagatacaccctatattcctttcagagatgctgcctatggaagctgcaatttctacattacacttcttgactgttttcatgcagtaaagaaggcaatgcagtatggcttccttaatttcaactcatttaaccttgatgaatatgaacactatgaaaaagcagaaaacggagatttaaattggataataccagaccgatttattgccttctgtggacctcattcaagagccagacttgaaagtggttaccaccaacattctcccgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaaagatttctggatatctgtgaaaatgctgagggtgccattgcagtacattgtaaagctggccttggtcgcacaggcactctgatagcctgctacatcatgaagcattacaggatgacagcagccgagaccattgcgtgggtaaggatctgcagacctggcttggtgatcgggcctcagcagcagtttttggtgatgaagcaaacaagcctctggctggaaggggactattttcgtcagaggttaaaggggcaggagaatggacaacacagagcagccttctccaaacttctctctggtgttgatgacatttccataaatggggtcgagaatcaagaccagcaagaacccaaaccttacagtgatgacgacgaaatcaatggagtgacacaaggtgatagaagtcgggccctgaaaaggcgaagacaatcaaaaacaaacgatattcttctcccatctcccctggctgtgctgacctttacactgtgtagtgttgtcatctggtggattgtttgtgactacattcttcccatcctgctattctgactcaaagatttcagaacatagtagccatcaggaccccctgacagatagctgcttctctccatttcaaggactaaaatggttttgcattaagtaaaaacctgtgaccagaactgaaggaagactctaggaactgaaaactgcaacagaaattagcacaatttgaaaacaaaacaaaattgcaaaagacttagttgctttccacctaagaagctaatcaatggggaaaatgtccacggggtttcagtaatgaacttttgagtttgggtgcaagcaaatgtaccaagaccagctcagtcagggagaccctaccccagtggtgctagaggaattaaagacacacacacagaaatacagaggtgtaaagtgggaaatcaggggtctcacagccttcagagctgagagccccgaacagagatttacccacatattgattaacagcaaacaagtcattagcattgtttctatagatattaaattaactaaaagtatcccttatgggaaacgaagggatgggcctaattaaaggcataggttgggctagttaactgcggcaggagcacgtccttaaggcacagatggctcatgctattgtttgtggcttaagaatgcctttaagcagttttccactctgggctgggtgggccaggtgttccttgccctcattccggtaaacccacacccttccagcgtgggcattagggccattatgaacatgttacagtgctgcagagattttatttatggccagttttggggccagtttatggctggattttggggggcttgctcccaaaaagaatgactcaaagaaaggcccagctctcaagctgaatgacaaaaatgctgttgtaaatttagtctcaggtgtaaatacccaagccctctggtactcagggagctggctggtctgtggtgcatgtgtgtccttgtgatggcaagcattgtagttgatggccttcagaagaattgaggatctgatggaggttttttaatgtatttattttctgttcagcttgtgaccctgtgtcaaaatttgtaaagatacaaaaggcattactgaaatggtactttctgtaatttgatactatttggctttaccatcttcacttgactgtttgtaatactgtagtaatattaactctgataagtacccaagctgcttgtcttctaccaaagagtgctttattaacaagaatctgtgaaaaccacattttaaacactgttgcatgttgtaataccaggtgataccttggtaacctaaaacttgcaagagaatattagtggtagctttagaagactcaggaggagaaactgacttcagagctggaagatgttgcaagtcattcctttttctgtcctttagggactgaagaactgggaggttgcccattgtttggttgccagtcatacaaattaaaatcatatttccttccatgcatggaaaaaacacactattggtttttcgccttggaaacagcaatcccaaataatgtcggctttaaaaaaaaaaagttaccgcttttttagagtccttctctgtaatattggatttttttttccttatgagatcagcctaaggccattgataaggcctgtgatctcagtaacaatgatctgcttctgaatctcactgttgcctttggctagggaacacaactagtaactctgcagagtgccttctcccgcaaccctactggaacacagcagagtctgtgccatgaagaaattagagaaacagaattgtttcgctgctaaaaaaaaaaagggggggcccaaaataaaagaatatttagtactcacctcagttccttccataagaagtgggtggtttaatgattgttaacccatttttgcctgtgctgggagcatggagggctgagatgttgacaggcagtgggaaacaaatgccctcctaagtcacaaggcgtgcgccagatcaggaggcaactccattttaagaagctgcctttttcataaaactgtaagaaaccaaagcagttggaataaacaagttaaagtctttaatgcaaaaagtaattgaaaggcagtgcctccattttggtgtactttcttggaagaaagtacgaaattgaccggcatcatgagagacggaagatgccgtattctcagccaaacaagtgactctttccctgccaagcactatggggtggggtcaggctagcttttaaacactggggactggatcacagaaaaacagtggttttctgtccctggaaatgaataggcacaaagacccacttggctgtgggaagaccactcttcaataagattttggtgggaggaggaacattccttttgctattttaagctgagacaatacaaatatttaaactgtgccatgcataaagcattgaattctcagggcacttcttcttccccttaccctttttaaggccatccccttcataaataataatccaggtagttgtgaaaattgtgcttccatctgattccttcttagtttggcttttcatcccatcagaacaagtaaatgtgggtgccacagcttttgtgagtactgtctccctcacggtgaacaagcctcctggtgttttgtccgagaaagggaagggtgttggtggaaccacagtcctttttcattttataaactgcctcttcatgttgcctgctcaagtttccacctagaattgctatcactgtgactctttctaaaaatccttctgcttaactggttcactgaaattagtcatagaaaatttgtgatttggtgaagaaacattccttgtaataatcaaatgacttgggatggtgtgcatagcaacagtgttacacttacggggaccgtctctagacttatggggaccgtctctagaatccaagaagtctctgggtctgagggatggaaagttcttcctgctatgaatgagagtggactcttcccctcacccccaactaaaaccacaaacacccagaatcttctgggattagagtccttgttatagaagaccttgttgctatggaacatgaaactgtgtctgtcagatagattcccttaagagccttaaatagccctgaaagtacaccgggacagtttgcgatggaattaaaattagaagtgaatatttttaggtgcccttgaagctttctggggactcaaaattatcaagagtcaaggacagtctggaggaagagcatctgcaaaactgggttcctggaagtagggacggacgtggctttttgtagaacttggtggagagcagctcctcatgagagcagaatggcctggcgtggccagtgcttcccggcagcacgcgggtctgccggcctccagaatttccccgttctgagcttgatgcccctagcctattccctacctacttcctcccttcccctctagccctctcacaggggtgattgctacctctctcttttcttgggcctaggcaagttttcatgtgacaacttaactggatcatagggtgcctggatacttggtcaaacatcattctaggggtatctgtgagggcatttgtggatgtgattaacattggattcagtagactgagtagaacagattgcccttcctcgggtgggtgtacagcatcatctactcgggtgaagacctgaatagaacaaaaagttgaaggaaggatgaattcactctcctctttgcctgaaggcttgagctggaacattggtcttctgctgccttcagactggaaattacaacattgatgcccctgattcttgggcccttaaactcagactgggattatgcaactggttttcttgggtctccaacatgcagcgatcaaattacaggatttctcagcatccataatcacgtgagcctattccttatgataaatatcttcctatagattgtgtatatagatacagatatatgatatctgttatattctatctacatagtgtgaaagcatatgtatctttagatctatatctatatgtatgtatgtatgtatgtaggtaggtgtctatctatctatctaatctacctaccaatcatctattttattgattctgtttttctggagaaacttggctagtgaaatgcatccttaggcaattttatcattgtataaacatcatacagtgtactcacacagtcaaagatgggatagcctactacacacctaaactatatggtatagcctattgcttctaggccacaaacctgtacatcatgtactaaatatggtaggcaattgtaaaacaatggcgaatattggtttatctaaacttagaaaagttggtggaaggtggaagtatgacagataaaaaatgatacacttttatagggagcttatcatgaatggagcttacagaactgtaagttgccctgggtgagacagtgagtgagtgctaagcaaatgtgaaggcctagaacattaggatacactactgtagactttataatcactatacacttaggctacataaaatttattgaaaaatatttttctctgataaaaattaaccctagcttcctgtaactattttactttattgagacttagcttaaaacacattgtgcaactgtacaaaattatttcctttctttatatttttattctatatgctgttttctgtttttaaatcttaattttattatttactttttaaactttttgttaaaaactaagacagaaacacatacactagccaaggcccacacaggtcagcattgtcagtatcactgtcttccacctccacatcttgtcccactgggaggtcttccggggaaaataacatgcatggagctgtcatctcctgtgataacaatactttcttctggacacctcctgaaggacctgcctgaagatgttttacagttaactttttttttaagtagaagtacactttaaaacaataataaaagcataatatagtaaatacaaaaccagcaacatagtcatttgttacaattatcaagtattatgtactgtacttcattgtatctgctataattttatataactggccacatagtagatttctctacaccagcatgtccccaaatatgtgcgtaatgctttatgctacctcatagtgatatgacatcactaggcaataggagttattcagctgcattgtaatctcatgggaccgtcctcacacatgcggttcatctttgatgtgtggcatcattatgcagcacatgaccatagatggcaatactacttccaaatcacaccctgaattcttcctcttctccccattgcctcattgtgtcagcagtttttcctatcctcattcacctggatcacagcaatagccatctaaccagtttatttatttcctttcttgacttcctatactacagtatttatctccatcatagcctgggttatcatctataaatgaaaatcagttcaccactttttcacatttaaaaccattagaggcttcccatcagagcataaactctaccttcttgccacggcttgcacaggttcttcatggtctgccactggctactgcccccacttcattccacaccatccttgagctggccaccaagctcatccccagtgccttttgttatgtgtggacttttgtacttctgccagagggacttcacactaagaggtatttccagcctgatatactctttcctatgacattcacaccacagattgcttcttatcattcagatttcagaaacaactttccagatggtctcaaccaactgtcctgattctcttgtccactgcacagtaatcccggctcagcgtacatcactatttcctagttttcaaatgattaaatgaatttgttgatgtgttagtttatttgcttcctctttatctgactcatgaggatgtatattttctgagagaaagaagcaattattcaacactatttcttcagttccaggtacagaggagtgtctaatatagaataaccatcccaaagtatttgttgaactaagcaatgtgaaacatttatttaaatagtgtacatcgaatgaatttggtacaaatgcacaatttatatgtcaaatctaccttaattctttcctcattagtatgctgtaattaaaatacatacaaacgtaaggaattcaattatgtaacaatactgcattgtgtgatggttttcaatgctttatgatcttatctttctcagcttggatggctataacaaattaccataagctgggtggctgatataaaacaaaaactgatttctcacagttctggaggctgaaaagttcaaagtcaaggcagcagtaagcaggtttagtgtctggtgagtgtgtacttcctggtcatatatggtttcttttcacaatgtcctcagatggtggaaggggagctctctgggcctcctttatgaaggcactaatcccatctgtgagagctccaccttcatgacctaatcacttccaggaggccccacctccaaccaccatcatattggagattagattttttcataaaaatttttgggagataaaaacattcagtctcttattatcatccacaaaatgaaaacacagaataaaataattatcatgaggaactcacagctccctgaaacatatctatgggtttcagtttttgaatgtactagacaagcattgagtcagtctcctctgaatgtctggattcaaccgagtttctaaatgcaggatttttagattagtggtgactgaaggaactcctgatttcttccttgagaggcctggactgagcatagtaaatcttccctcctaatatctcaatagaatcatcgaagtacaaagctgctctcctgaagagtttgatagaattcagtacagttaataatttaactagctctcatgactggagtctggggctcctaactcataaacataaaggtatgtgccaataagttaatttcagataaaaaagatggatgagtctatgcttttttttctttgtttttattttattctaatctctgatgattcattactgtattagatatcattgctattgcatgagcaaaaaattctgtgtttccacagtaaatggaaaaggatgtataacctcattattgatataatgccattaaattagttgaaatgcaatgatcacacagtgcctttggcaaggctgggcaccctcatgggaactgaaacttgatgtgaaatcaacatgttgtattagttaatgcacaatgtagtgacacatcataggtaaatggctaataggcagcagcaatagctgattgtccatataactgacccttgtctattataatttttaaaaatgatgtttttataaaagaaaagcaaattacaaagaacctgaaaaattaaggccccagactgttactttgaacaagtccttgacatcattctatcccactatattcttatactggtttaagaatttagagctaaaagttttgatatataaaacaatgataaatcaggctactatggtgtttttttaaaagacttgctattattttagctcagaagagacaaactcatggaatgatattttgttaacacaaactccctgtttgcttgagtttgcacttgttaaattttgactgagggctagtccacagaaagagctaaaaagagaaatctctcatagaatcgctgccaggcctataacaaaagccaccctactggttgtagctctaataataaactctcttttatacaggcctttcaaagttacagggtcacaaagtgccttgaaataaatttcaaagggaacagcaaattctggaatcacacccaaactctttatgttcatgactgtaacagagttaataaattgtgggcataaatgaataactgcaatgtcctgcttggaaacccagtggtgagtgtgttcatcagataaaaatgaccaggtgttgacaggcaatagaaaggaattatgagcagcaggggtttagtatcgatacctcaggaatttaacttatgtgtcagaaacaaggctagggccctgggagaggaaggcgcagagatatatgtactttgcagactattactgcaaagcttggtataaagagaaacaggagaccaagctgattatcatattcatgagcttgtcaacaataattggccagatccttgttaaaatagaaacagtaagagtcttgaccgttcattttctgggattatctcctatgcaaagcctgagggagcccaactatctcctacttcacataaagatgattaattttcttccttgtctttttttcttcctcccatcagtattgagaaagaacaaataatttgaatggaagacttagcatattttggatccaagacagagactctgtagtctcagttcttttccacacctaaggggactgcagacatttgaaatttcatgaaggaaagtggagtggagcctctaccacatgttagcacctggttctcttaaaagggagacattttcttccctctttaaactcccaaagtatcccacttctttgagatctagcattttctactttgtgttagactttacataaatgtcatttttaactatatgttctctcctctggtcacctctaaccacctttaagagaaatctgtacactaatttctcatctcattgactagtattttgtatattgtacagtatcagtaaatattcctcattttctctatttttatctccatggtaagaaattccaagatatgctttgttagtttcctaatttgttattttttattagtcagcaaaggcttttttatgtctagcttactgtatatgtacttgctaaagtctatatttatttttgttaattcttcaaggcagtgaagaattcttctctgatttctactaacctataaatcacatatatgattttcatgtattggcatttacgaaattgcctttattgttagcacactgtaaaatctattgtaggtaaaatttaacttctcaaggcaacttggaatgatgttaatatgtcatatctctgattatgtcaataagtaactattgatttggaattaggtaccatttcctgctttactacagattcccttgacccaaagaaagattattagtcactaaagccaaaactttcatttaatgctaaaaattttgccaatattttaccaaattacaatcttgaatcttgaacataacacttccagggactggaggtcgaaatcatcctgttccatctatgggcatcttttctgacgtaaagtgcttcctgaactaaaagcaatatgtacttaacttttcttcagtggtctttgtcacagaccttgtagggaaaaaaaaaaaaaaaaaaggaaatatcttatccatagacagtcaaaactattttaaagtagttccattctctcactgaattttcctcatttagtgtagtttggagactattcactgatgtaaaccctgcctgctaactgggtttgtttgtgttgctgagagtgctctgcaagtaggccaacagtgccaggagtgggacagggcattttttgtgctgaagttatggtctctgtgaagctgaggttcacagtaggacttttttaaaattccactactctgttgaataatattgagcttacaactgaaaacctcgtttgtttgtttttaatctatgcatttattcattccttgaaatattggggcccctgtaaatacactggtgaattaggtcaacacagacctcgctctcacagatcttaaaatctagaaggcaaaaaatcaattaactcagtgatatttagttgcacaaaacataatatgataggagtagcgtggggacctggaactacagagaaggtgtgcatatcccagttaaaggccagttatgctgactcagaggactggggaagaactggaggcttgggtactggaaatggtggtctcctgcagaagttggtggtagagcagagagaagtgggatcagaaaatagatatttaggaggcagatttagcaggatttagtgattgatcatatgtggagcagtaaaggaaaggagaaatgcaagatgatgtcagatttgtgggttgggcacaaggctattcatggaaacaaggaaggagaggggagaggcaggattgggagagtagagaggcagcattgggtagtacctgaaatcacacttgaacagggtaatgaaaatagaagaggcctcaaacacagacacaatcaaaatagaaaggatgatcccaagttcaacattcaatgattccaacacattggctagaaatgcggaagaaaaagtctggtttcagggaaaccaaggggcgaggagtttaatacagaaggagagagtcaacaatgtcagaaagtacacaaaattcaaagataccaaagccttataaaattaatttcatccattgataagaaagctattcatgacttaaaaaaatgattttggtgaaatggtggaggcagaatataatatatctaaaggtcaggggaaagcaaagaagacaagaaagtgactttggcaacaaagtttagagatcagatcagattgagtagcagggcctgtgaggggaagggtatttttaagattaagagattgggatactgattaaaggggcctggcacaaaaggagatactaacagcctgtgagagaagaggaagtcagttgaattctcccaagggaaatgttctccataaagcttcttcttttaaaaaaaattaaacagctttgttgaagtataattttcatatcataaaattacctcactgtaagtgtgcaatttagttataatagtcatttatagagctgtgcaactatctctgaaattcagtttcagaacatttctgtaatctccaaatgttttctcatgcaggcttgcaggtcttccttgctcccatccccagcaaccaccaatctcctttttgtcttaacaaatgtggctgtgctaggcaatttatgtaaacggaatcatagaatatgtaccgtctgtgtctgtgttctctcacttagtataatgtttgtagactcatctgtgctctagcatgtattcttttatttactgaatagttttccatttagtggacatactacacttttatctatctcttcaactgttgatggatattcagattgttttcagttttaaggtgttactaataatgatgttgtgaaaatacatgcatattttcatacagacgtgttttcagttctgttggataaattcctgggagtctaattgctggttatatgataagtttatgtttcatgttttaagaaaatgccagcctgttttcagagtggctgtatcattttatattcccatcagcactgtataagtgttcttagtcctctatattttgtcaataattggtactgtctgtcttttaaaattatagctaatcttagtggatgttcaatgttacttcatcttgtttcaattttgtcttctaatgactaataatgttaagcatctatatgcttatttaccattcctatattttccatgatgaaatatctgttcaaattttgtgtccatttgtaattgaggtgtttgtttttattaaaagatatgagttatttgcaatccctttagtaaatacatgatttacagatttttattccagtttgtggcttgtctttcattttcttaatgatgtcttttgaaggacaaagttttaagttttttggttcaatttgtccatctgtcctttttagaaataatgtttttggtgttctatttacaaactttgtgctcaaaacaaagtaataaagatttttcttctgttttcttctaaaagtttaaaattttaacacttaaatttatttttataatgaatgttgaattaatttttgtatataatatgaggtagagatctatgtttattattttgttctggatattcaattgttctcacactatttatttgtgaaaaaacaaacaaacaaacaaaaaacactattctttacccattaaatttccttggaatctttgccaaaagccaaataaccataaaagttctctttatacttttttaaaataattattaaaactaattgcagcatgtaacactgattactgctaaattttatcaaaattgattcagttgtttaagaattaaaagttgaacaaattagaaataaagctttttgaaaatacttggaataaaatattaacaaattttaaggacacatttatcttcaaaaatgaataaagtatatatgggggattttgaagtacacagaaaagctttccaatgataaattatccatagatattgttataccattacagtaagtataaacttgaaatatgttcttagacagaaatctcaggaagctaacaaaggttggggaacagaatattccccttaaaaacaataagtcaagtccacacagaaagtaaagcagttaagtccaggtgcggtggctcacgcctgtaatgccagcatttgggaggccgaaacgggtgggtcacttgaggtcaggagtttgagagacaacatggtgaaaccctatctctacaaaaatacaaaaatacaaaaattagctgggcatggtggtgcacacctgcaatcccagctacttgggaggctgaggcaggagaattgcttgaacccgggaggcgaaggttgcagtgagctgagattgtgccactgcactccagcctgggtgtcagagcgagactccatctcaaaaaaaaaaaaaaagaaaagaaaagaaagtgaggcagttaaaagtggagcttctttagtttacaggctgtatgtggaatcggtttatggcatctgcccagtacatgcctgatgggtgaatcaggcagtgattggtcatggggccaaatatcagagccaagagaagaaagcacaactcagtaataagtggacaagaaatgtgataaaagggtcagttgagacaaaaactcagtattaaagaccaaagctaaacagttattctcaattaggctttcctgaattttgagattaaagaagcaagaatagtttttgcaaaatatgaaagaatcctattgaataatattttgctatagtctaatcctaaaataggacatagaaacattttttttcttgagtgcctaccatatgttggtactgttctgagtgttttcatgcagatttccttcatctgtttttagataccatattgtgttcgtccattttgtgttgccataaaggaatacctgatgctgtgtaatttataaagaaaagaagtttatttggctcaagccttttcaggctatgcaatcatggtgccagcatctgctagtgagttctcaggaagccaacaatcatgggggaaggtaaaaggggagaaggcatgtcacatgatgaaagagggagaaagagagaggaggaggctccttttaacaaccagcttttatgtgaataatagagtgagaactcactcattaccatgggtagagcatcaaaccattcatgagggatccatacccatgacctaaacaccccaccaggccccacctccaacattgaggttcacatttcaacatgagatttggaggggacaaacatgcaaactatatatgaataataatttttaaaaaaagtgaaagaaaattgctcaaggcacaaaggacctgagtccagatttaagaacaatcttctttccttttatttatttcagcctgaaaactaaaaaaaaagtaagatttttttgcactttcctctaactttcaaagtttacacacccagcccctgtgaaattaaagaatgatccatcaaaatgtgatgacacttaagatgcattgactgtaattttcgccagtagtccaccactataactcccatttaaagaacatggtctcaggccttgtgtgcatgaagttcacatgggaaaaattttaaacacgtgttcctggtgagtttaataaccaacaattctggtttaatagatcagggatgggaccccatgtaagtggttaaataaattttttataacaaagaaaaaaaaagtagtgatttatgcatgtggtcacagatgaaattttgaaatttttctctgtgcttcatgtttattttacatgtgggtaatggaatatattatgaattgtttcaaggatttagatatcgtaggtctggttgcagttatcacaggtaatgttaatggaaatccagacaattagacgatgataaccacagctaagtctcaggaaaaacaggtcagattagacaaccactcactgcggggagcccagatatgcatctagtctgattacccactggggaagaaagagttaaagcagttagcttttcatccatttcttccctgaaaagtagactaatgatctagtcttactctttgtaaacataagttgataatttgacctcttggcaataagagaaatgatagttaattaaaggaaaatcattatctagaatgctaatggttgggtgtccctgttttagcattgtttatagaaaccaacaatctgtgggttttagagggctgactctccaaaaaatgtcatataagatctataactctctggctctataaaatggagatgcttcctattacaaatactcatcactctgtgaggtgacccacaaatctctgttagagacctcatttcagcctgggacagagagcctgtgtccaatgtgaggaaggaaagatttagagagccacatggaatgcccccagttttctaggctttgcttttgttcttgattgtctgggtccttgaaactattagtaaagcttgattctgggcaagatctctgattaatttgatttgatttgacaacccaatcatttatgttagatcaattagtcttcataatgttgtcagagatggtctcattggttaaaacattccaccacagtaccctgtaacacactgatttacccattaattaaatgatatcatggaagcatgaaaactcactacagttccaaactttcttggactagtcaaaggacatagttggtatgcttatacaagctaggtccttaagcacaattgttcattgtaagaaaagaaaccaaaattatagttttgatgttataatacagatttaaaacttaaatattttgaatattttacttctaacatatttacaatggtaaaaaaataatatttttcagttgtggttaatgttaggcctctgagtccaagcctgctcatatacttccagatggcctcaagcaatggaagaatcacaagtgaaaatggcgagttcctgcctcaacagatgacattacattgtgaaattccttctcctggctcagaggctccccaactgagcaccttgtgaccccccgcccctgcctgcaagagaacaaccccctttgactcgttttccactacctacccaaatcctataaaactgccccacccctaactccctttgctaactctcttttgggactcagtccacctgcacccaggtgattaaaaagctttattgctcacacaaagcctgattggtggtctcttcacagggatgctcatgacagttaatacaaaaatagatactccaaaaaaagtgttggaggaataaaattactttataattatccggcttgtcaatgttgtgcaaagctgcactccacatggtgggtactatatatatacagttttaattattttacatttagtacttgcttgaccttggacaactctcttaatctgtttgagtcagttttttgatctgtaaaatgaaaaacatgaaggaccagaggaagtggaaaacaagaatgaaagagataaggaaagagaaagaggaagaatgaaggatgaagaagaggaggaggattaaataagggaaagaagaatgtatgtgacggcacttagaatagactctgacaccttataagtactatgtaaatgttaacaagtataatttttaattttaaaaaatttttagctacatactatttttagacaaaaatttaaaaatttttaggcatagttctacatatttatggagaacagtattctacatatgtatgtacatgtaagtatacatatataaatatatatatatatataaatcaatgtgttttatccctttttttttttttcagaaaacaagcatacaaatatctacatgcagtaccatgggtattctaaatttcatcctttaccgaattattggaaaagactgtatgtaacatttcttaataaatgtataaataattgtcttataaatgcctagattgttaaaatataggaagatagaagtttgctgacagtgttggaaaataattaaaagcaaaatatcctgctatctcagaaagtctctccataaatgaagcagagttttgctattgaataaacattaaagaaggtagtaatgcccatcacaggcagttcctaaagggagcacaaaatcagaaagaaatctgacccttttatatagctaggaagatacaatccaatacatatattttcacaggataaacaactagtactcaagtaagaggaggtaacagcaccatttgcaatatactgttgattctaaattcacctagtaatagaagtggctatctgtgttagttaattgcctttatccagaagaaaaatggaacttcttatatcttcttgacaagcaggtagttttacaactagaaatcaaacacctaaattaaagtctcactctcctgcctaggaggggagatagaggcactaatgtccttgacatttacatttcaaagagatggctcccaagcccctgaggaaaacatttctggttataaaactggagaggggcttatttagcgtttaaacaggtttacataccactcaactggacatggaaaggattacaattaccagtttcctaagggaaatgctctaagaaaagaggggaggtctctttctccttttcaccagggaaattttcaaaatttcttttcagattcttatttgcccttatggtagcataggcttctgacaaaaatgagattttattagagtttagaataaaacagatgttctacaaatgaggttgttgctggtttaatatttcctcacattcatttacttattcttcccagcttttgattccacaagggcttgttaataaatctccagggagctgtttgcctgtgtcaccaaaagtctatagaatattctgtgattaacaaaaacagacacacagaaatcttctgaatagaaattcagaatcctagcttgtcccttcttttaagatattttagatgttgctaagcatgaaggctatgggcttatcaccacttcatgttttgtttttgatatgaaataactctcttttacaaaattatacatttctaaaaaatgggtccaatggaagagattagattgatgtgacacaactggagtttttaaaaaatgagcagagagactgttccaatgtcaacattaacagtggtgtcctgatcatttcccctgttaatgttaaaatgaacattaatttcttccttctttatataccagcatttctatcatttgccagagaatagtaatcgctggcttcatagaaggctgtaggaagagtaagtgctctccacaagtccagtctggttgctctgagtattcacagacaaatgaagtccaactgcttattctcactgtgcaataacaagatgcagacaaactgggaaagaaaggagtttatgtctgcaatggttacagggagaaggttggagtaactcaccagaccaactaaaacttacaacttttttttttagcttatatatacaattcaggtttatgcctatgtgccggagtctttcttttctttcttttctttctctctttctccttccttccttccttcctctctttctttctctccctccctctctccctccctccttcgttccttccttccttcttcctttcttcctttctctctctctcactttctctctctttctttcctttttccttcctttcttcctttctttctttctttttctctctctctctccccctccctccctccatccctcccttccttccttccctctttcttcctttcttcctttctttctctctctcactttctctttctttctttttgtttgagacatagtttcactcttgtctcccaggttggagtgcaatggcttgattttagctcactgcaacctccacctcccgggttcaagtgattctcctgcctcagcctcccaggtaactgggattacaggtgtgtgccaccatgcctggctaatgattgtatttttagcagaaatgggctttcaccgtgttggccaggctggtctcgaactcctgacctcaggcaattcacccatatcggcctcccacagagtatttcttaatcaatctaatcttaactaaaggtctgcatgtaggaaggttttttagatttgttcttggactagattaaagaggttgagaaagtccaggtgtggttttaatgggtttgtttttgcattccagcccttgtactcaggcaccaatttctccagttctttaatatttatcttatacattcattattacagcaaagggtttacgcagacttacctgcttgtggagctctggcctgccacaagaggactgagcccagaaagagtacctctgccaaaggacagggcccctgaaggcctctcccaaaggtgatgcctcatatagatactgaagagtaatttgccaagtgggaaagcaggataaggcatttcagtcaaaccaaagttataaagacttgaaaaaagatatttatttggaaataagtatttgtgtgtatatttgtgtatgtgtgtatgtgtgtggtggtggtagtgattatttagtgtgttagaggagaagtgtcaagaaaatggctagaatgtgagtcaagagctatgtcctcctgaccttaagcaatagtatgctatgtaaggcattttgcatttcatcctgaagaaggttctgacagatttcagcagagatggaaaatcattagttgcattgttgtaataaaatcttctcttttaacagcttgagataggtagaggaggcagcaccaaagaagttgtgcaatacgaggccggcaggatggcagggcttgtgccaccagcagattcaatggagggaggaatttagaggagcttgtcaaagatgagaggttgaaggacatcacatttgagaattaggtcttatagttgtgaatttagccttaatcaagcaaatttgtagctgattgctgttaaaacttgcactactgaatgtaggattccttcggtgtttcttatctgttaaaaaacaacaacaacaaaaaaacaaacaaaaaaaaacagtgactattttatagccagccttctctcttgagaatgtgtgccaggagagtgaatgaggaacaggcagctgtcaggtggctgaagaggacccaggaggtcacctcaatgagtggctaatttggcactgaggctgatgggaaaggcacattgctgtagtcctttttgtgcctcttaattaaatgcattaaatttcaattttcttaaaatgcaggaattgaatagatgaccactaaagacgctttcagccgtcgtggtctaagactcttgattgacatcatctaatttggagctcatggcatagttttccatttttaaaccttctatttttgattttcatgagaaaacctttctatgtctggtcacatctactttatgtgagtgaattaactagagagaaatatattatagaatacctttcctccttttgttattagaataatctttttcatgtcaaaaaacagtgcagattgtctgtgaaatggaaatggtattctgaaacttgtgtagataattaaaaaaaaaaaaagaacatgatgtgattttgcctaactggtaaggtgccactttgcaaggcacaggatggcgtccacagtgaaagcttccaccttcctatgctctgcctcagatggtcccattggcgtgctccacttcagttttcaaagctaattagaatatattcacttttgtctgttatatattcagggagaaaccctatatctgtacaaatgaggtagccttatattgccagttgagtttactaaaggtctcagacagatgagggactgtcagagagatttccccaaggaaagtgcagagcagagatgggcgccctgtgcatgggcccctactctgtatgctggagggtatgctggagcctgcttaacagtccttcgataattataacagttatataaagatttattccaaggtttaggaaaatcagtctcataaaaatgaaataacttagcccacattatgaactggtaaaaactagtattttggggagccggaatgggaacacaagtttgattctcaagccattacctttcaatctcactctgattcaaaataaaacaatccatcacccctcctctggaagcaaccataggaggaaattcacccccgatatttcatgtggatccttttctattttccctaagtgtcggctggtctgagaaataaagggaaagagtacaaaagagagaaattttaaagctgggtgtctgggggagacatcacatgtcagcaggttccgtgatgctccccaagctgcaaaaccagcaagtttttattagtgattttcaaaaggggagggagtgtacaaataggatgtgggtcagagagatcacatgcttcacaaggtaataaaatatcacaaggcaaatggaggcagggcgagaccacaggaccacaggaccggggtgaaattaaaattgctaatgaagttttgggcacacattgtcattgataacatcttatcagaaaacagggtttgagagcagacaactggtctgaccaaaatttattagatgggaatttcctcatcctaataagcctgggagtgctactggagaccggggctcatttcatcccttatcttcaaccgtaaaagacagctgtccccaaagcggccatttcagaggcctccccttagggacgcattctctttctcagggatgttccttgctgagaaaaagaattcagcgatatttctcctacttgcttttgaaagaagagaaatatggttcttttctgcctggcccacaggcagccagacttttaggttttctcccttgttccctgaacattgctgttatcctgttcttaaggtgcccagatttgatattattcaaacacacatgctctacaaacaatttgtgcaatcatcacagtgtcccgaggtgacatacatcctcctcagcttacgaagatgatgggattaagagattaaagtaaagacaggcataggaaattacaagagtattgattggggaagtgataaatgcccatgaaatcttcacaatttatgttcagagattgcagtaaagacaggcgtaagaaattataaaagtattaatttggggaactaataaatgtccatgaaatcttcagaatttatgttcttctgccgtggcttcagccagtccctctgttcagggtccctgacttcccacaacaagcaacaccacaaaacaataaataactactccacccttgacccagagcaatgggagaaaggcctggccaggagaaactaactttgttaaaagtctaatactgtaggccctgccagcctcttgtatttattcatcagatttaattatcaaaagaatactcatgaaatagtaatatcatcactttatggatgaatagtaaatggtgaatcttacatcaaatatgagtatgctcaacttcaaagccacttctacacctggagttttggatatacagaactgttgtgacaaacaactgtatgagttgatattttctctgccttctaattgaggaaacaaaggtatggggagattacatgtgtcaaacacatttactaagttggaacatcccaagtggggatttgaacccaattctcccacttttctccagtgatctgtctctacctgatttctaaagtcaccaggaatgctgtcctctacacttttatgtaggattttgtttcagtccaaaatgcccttccctacatgctagcaaacttaatcttcaagatcttggatctttaattgaaaaacccaaaaatctttaggaacctgcagtacacctgggtgttgtgctacatgccaaagaaactccagagagaaattctgttgcctttgtaaaagttgtcaaaatcaaaatggagtcaatagtgtcagggcaaaaacaaacaaacaaacaaaccaaaacaataacaaaaaattcccaactttgacaaatagagttacagaaggccatagaataaaaagagggggaaccatgtgtgtatgcctactaacagaaactatcaaaaaaaaaaaaactgcaaaagccacaaccttgcacaaaagccatcactgctttacacaaaagttacttctgcaaggatatcttcccagcaactgcctgtccaatcttggactggcatcatctttgttattgaatgtcagattgttcttgcattgctataaagaaataactgagattgagtaatttataagaaaaaggggttgaattggcttatgattctgcaggctttacagaaagcattgtgctgatatctgctcagcttctggagaggccccaggaagcttacattcaagtcaaatgggaagcaaacatctcacatggcaagagcaggagtgagagagagagggaatggaaatgccgcactttcaaactctagatcttgtgaagacagcactaagggaataagtgttaaactatttgtggaaacccacctccatgagccaatcacctcccctcaggccccatctccaacattggggattacatttcaacatgaggtttggggtaacaaatatccaaaccctatcattctgccccttggaccccaaatctcatgttcttctcacattaaaaaatacactcatgcctttcaaatagttccccagtcttaatgcatttcagtattaactcaaagtccaaagtctaaagtcccatctggagctgagtttcttccacctatgagcctgtaaaactaaaacaaacgttttatttcaaagatacaatgcaaattcaagcattgggtaaatattctcattccaaaagggagaaatcggccaaaagaaagggcaatgaaccccatgcaagtctgaaagagtacaaagagaggaattttacagctaggcctccgggggtgacatgacatatcggtaggaccgtgttgcccacttgagtcttaaagccagcaagttttattagggatttcaaaaggggagggggtgcaaaaacagggagtatctcacaagattacatgcttcaaaggcaaaaaggagaaccacaatcacgtgcttctgaggaaacaggacaagggcaaaacagaactactgataagggtctatgttcagctgtgcacatattgtcttgataaacatcttaaacaacagaaaacagggttcaagagcagagaaccggtctgacttcaaatttaccagggtggagtctcccaatcctagtaagcatgagggtactgcaagagaccagggtgtatttcagtccttatctcaaccgcatgagacagacactcccagagtgatcatttatagacctcccgccaggaatgtattcctttcccagggtcttaattattaatattccttgcaaggaaaagaatttagtgatatcttccctacttgcacgtccatttataggctctctgcaagtagaaaaatatggctctattctgcctgaccctgcaggcagtcagacctcatggttgtcttcccttgttccctgagaattgctgttactctgttctttttcagggtgcactgatttcatattgttcaaacacacatgttttacaatcaatttgtgcagttaacacaatagtggtcctgaggtgatgtacattctcagcttacgaagataacaggattaagagattaaagacaggcataagaaattataaaagtattaattttgggaactgataaatgtccatattaaaatgaaatcttcacaatttatgttcagagattgaagtaaagacaggcataagaaatcataaaagtattatttgggaactgatatatgtccatattaagatgaaatcttcacaatttatgttcttctgccgcgactcaagccggtccctccatctggggtccctgacttcctgcaacagcctccaatttcatatttccccttggcactgttctagtagaggttctatgtgagggtgccacccctgtggcaagcttctgcctgggaacccaggatttctgatacatcctgtgaaatctaggtagacactcccaagcctccttcagtcttgcactctgcatgcctaccaggcttaacaccacatagaagacagcaaagcttatggttgtgccctttggagttgtgtcccacgctgtatatgaggcccttccagacttagctggagccagagcagccaggatgtgaggagcagttacctgtggtggaacagggcagtggtacctcaggcctggccctcaaaaccattcagtcctcctaggcctctgggtatgtaatgggaggggcttcttagaagatctctgaaatgccttctaggccttttctccattgccttggaaatttgcacttggctcatttttcattttgtgactatctctagcaagtggttgctccacagctttcttggattcttactctgataaagcgttttctttgccacatggctaggttgcagattttctaaacttttatgatctgcttcctctgtaaatataactttcaactttaagtcatttgtttgctcccccatctgatctaggctgttagaaatagccacattacatctttatcacctgctgcttagaaacttctccgaccagataccctaggacatcacttttaagttcaaatctctgcagatttctagggcataaaaacaatgcagtcaagctctttgctaaggcattacgaggatgacctttgctccaattcccaatacgttcctcatttccatttgagacctcatcagcctggacttcaacgttcatattgctatcagcattttgttcacaaccacttagtggtctctaagaagttccaaacattccctcatattcctgtcttcttctgtgccctccaatcttttccaaactctggccattatccagtttcaaagctgcatccacaccatcaggtacctttatagcaatgccccacacttccgtaacaattttctatgttaggctgatctggaagtgctataaaaaatctgacactgaataatttataaagaataaaggttcaattggcttatggttctgcaggcttcacagaatacatggtgcccgtggcatctgctcaacttctggggaagcctcagaaagcttacagtcatggtggaaggcaaaggggaagtcaactcacattgagagggcaggagcaaaggagagatgaaaagtgccacatactttgaaacaacaaggtcttgccaggataggaccaatgggacggtattaagtcattcatgagaaattcatattcatgatccaatcacctcccaccaggccccacctctaatattggagattacattttaacatgaggtttggaagggaaatatccaagctttatcatttatctttgtagccaagggtatttgttgtaaacaattttgtaattctcagtttattctttataagcctgtgtcttcctttaccccacagaatatgcacatatttttattatggcatgtgtattcccattgtattgctttattcacaaataaccttttattctagagcctctctttatgttattaatattgacatcttgatcagtctaatagagaattacctcggatcatggtcaaatcttacacctcttcagaagcccttttatgtttctccagaaaaagtaacgtctgcctttttttcaccttcccagctgttttcctgtgtctctgttttgacgtttatcaaagctgtccttttattctacctatatataaggctgtgatatctgcaaaaatttgaatcctgaggggcaaaaaaatgctatttttggcatctgtccccttcagtcttttgtatgggaatcaataaatatttgtgcaatttggaaagtggggtaaaaattcccatggctgggtgcggtggctcacacctgtaatcccagcactttgggaggctgatgtgggcagatcacaaggtcaggaatttgagatcagcctggccaacatggcaaaatcccgtctttactaaaaatacaaaaattagccaggcatggtggctggtgcctgtaatgccagctactcaggaggctcaggcaggagaaatgcttgaacccaggaggtggactttgcagtgagccaagattgtgcctttgcactccagcctgggcaacaagagcaactccatctcaaaaaataaataaaaaaataaaattaaaaaaaaatatatcccttgatacagagtggaaagaagaaaaagaaaatcaaaggctcattaaccagaaagaataatccatggttaattgctcagtatggtataatgattctccaatggcagatggtatttgggtagtatgtgttaaacttttggcccagtaattttttctctgttcttctctttcatcacctttcagaagtttcataaaaacagcttggaagttcagatgctttctgggctgtcatgctttcactatgacaattactctgctaatcaccaacaccttgcagattaatggagattagcagtgggcctgaggagtgagaaggcacactgactccgaggcagcatttgcaaaaaccctcaaaggattccaggtgaacaggctagtagataagaactaaacaaaatattttgaattatttctcaggaggatctgtagaagccactgcactctatgaatcaatggaggggtatgaagattgaccctgtagttcttcaagtagtgtctcaaaagagaaaacatgggacatactttcaccagaaattagaaaaatgagatgagaagaaaatattccaagtctcagttagtttgggattctcaggattaaataaagtaattgggattttgttacctgggaatttttcagagccctcaataagccaggaagcatggtgagttttaagtataaaatcaggtacttagaattaccctgccttatttgaccacatactcatcttcttttcatagcatagaggttctgcagaggactgtgggaaattctgacttaaatgcggaattataaacagaaggtaaattgtccttctttgagaatccattagtacccactaatgagtgttacatgctttcatatacatttttcattgaatctaccaaactcatcgatatagaaaacactattttctttccacagatgtggaatcaaaagttcaaagagcttaagtggcatactgaagctcagcagagttatgatttaaatcaaagtctggctgattatatccctaaattgacagtgatggcacatctccttgacaagaagaaggaggtctccaatgagcttgaaggcaacagaggatctccaccatgattagattccattgactgggtgacaggtatacaaaatagttttagcagttactgtagtcatattaaaatggaatataagattaagttgaagatggggcaaggaatcttggaaattgaaatactattctagatagctttgcctcttttttagttgcctgcaggaaatatttgccctggagacaatggaaagctttagatacttggttagaatcaagaaggggaaaagaaaaagacaaaacaaaaaacaaaaaaacagaaaccacttctcattgacgcccaaattaaagcaggtaaatttttccacccaaaactctctaaggtaaaacaccagtttctttatctagtttatcttgttggactgtggaagaggaagggtccttctgattccctctctccaccgccactctcagagcactgaaagtgcagcatccataggctggcatttcatggcagatctgagccagtgtaaacaccggcccctaagaccccagctcattaaaattttcctgttctttgctgcatggaaaatcctcacttctttaggatgcagttaaggtgaacaggggagaggcatttctgtaaatacaaagtttccaggaaaaagtgtcaggtgacctgtaaaggattgcaagcacttagtcttaaaaactgcaatgtctagaatatggaagagtggtgtggtttttgttaagatggaatactgatatttcactttatctttcctactgattgcaactaagagtcctgaatggaaatcattaaaaaaaacctctcagggtggtccattttgtgtgtgtgtgtgtgcatgtattgctgtatgtgtgtgcatattgctgtgtgagatttttcctcatatatatcttgaattagactgaagaaagcctgaatccctgaactgtgcaacaggcagaacaggaaaagtctgagagaaacccactattatcagttcaaggactggcttccctagagaatggagttagagagaggaatacttcctcttcttgtttgtttctgtgtgtgttattttaatgttttcccagctcagcccctaggtaagtctcagttccaaaagtacccttcagcggaggcagtggcagcagccactgctcagacacttaaaactccgagagaaaaagccaattccctgacaacagtaacaggagcaagcttcccctgtaatgggaacagtgttggggaggaatctctgccacacgctacttctctctttcttcctgctgctttgccccagaggtagatccagtttaaaagtatgtaacagcacaagagtacagtagcagatacatatatattgtttggaaataataaaaattaactagaaatcaataacagaaaaatgactaggaaatcttctaagtatttgggaattacacagcaaatgtccatagttttctacccggaatactagagaaaaagctcctgtgtactggagagtgaaagaaatcacaaggactggggatctcaagagaggggtcctacaaagctgtgtctgaagtcctgggcccagcctagagctacagatgcgtaggattgattggaaacggcacaccaaagtgactgagaaagaagccatgatgtagaccaacaacgaggaagcagactgcgctccccaaaggagcacagatagagccaatttggatatccctgcaaaggctttaaggctgaactgacatcgggactatagaaagtgagtcagactggcatcttgatcctaactagggtcaatggtagattaagaaaagcaaaaggatgggaagaaaatctaccatgcaaacactaatgaaaagaaggttgtattggtatggtaatatcagacaaggtagacttcagaacaggaaaaataatcagagataaagagggacattaaacattacaaaagcgacaattcaccaggaagctataatacacctacatgagtatgtgcttcataacagagctttaacatctgtgaagtaaaaactgtcaaaataggaaggagaaataaacaatatcccatttaatgataaaataaacagaaagaaaatcagcaagggcagagaaaacgttaaacaacttcaactaaaagactgagttgatcaatgggaacacaccacacagctacagcaggatgcacatacttttccagttctcattaaacatgtatctagttagacatatcctggatcataaaagaaaccttcacagattcaaaataatacaagcctgggcaacatggtgaaatcccatctctacaaaaaatacaaaaaattagccagctgtggtggtgtgcatctgtagtcccagctactcaggaggctgaggtgagagaattgattgagcccagaggtcaaggcttcagtgagctatgattgtaccactgaccactgcagcactccagcctgggtgacagagcaagaccctgtctcaaaaaaaaaaaaaaaaagaataaaataatagaaattttagtatacgtatattccttgaaaataatgaaaattaactgagaatcaataacaaagagaactagaaaatctatcaatgatttggaagttaaacaacaaactttcaaatagtccaaattatccatagtaattcaaccaagaaatctcaaaggaaagtataaaatattttggagtgatttaaagtgaaaataaaatgaaatgttgggggaatgagctaaagcaaagcttagctctatctccatatggaggacccatatggaggatttgtagagtgtttctgtgttaacaccctcccttatgcactaattctgtgaaagtaagaggatatgtttttattgcctgaatattcaaaaaaataaagaggtctaaagattttgaaatatattaaaattggatatgttgagaaaaactaaatccagcaataaacaattgatatatgtaagacagaggcagcaggaaaaagtgaagtagactggagcttta

SEQ ID NO: 407 - DNA, 9447 bp, Homo sapiens
tcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaattctctcttacatataaaagttattaaaaaatgtatctcaaaggaaatgaatgctagaaattaaacttaggcaaaatgctaataaccgaaagagaaaataatgtgtatgtccagttaaaataaatcttgacataaacagtatcccaattatgatatatgcaggaggatattactacatagaaattagataagcaaaaaatacatttatagaattaacaaacttttgtaatactatataattccttttacataaagctcaaaaacaggcacaatcatactaaagtgatagaattaccctttggcataaaaaattttataagagctctgtcagaagtaaactggaagtttacttcttcaaagtgagcaggataatctgttttgattaatttaaaggcaactgattagcgttcttaatgagatctgtaaaatgtcttcacctttgtcatatgacgtagtttaattgtgggagtgacagtgtgtattcagggtctcactcacactcaaggggaggggattgtacatgggtttgagtcattgggggccactttagacttcttcctaccaaaacagtattataacaagctaaactgaatttccgcaacttgagcctctcttcatatttattagccatttgcattttctctttggtaacaatgtttttccttacctttacatataaattacatatttatttaagaatagtgttctaaatttattttcactaacataaactgcatacatcttatagtaaatggcacagatgttaattgtacaaccagatggatttttccatggtacatacctgcgtaaccaccacccagattgagctagaactttcccagtacttcagcaggcaccctcacatcctctccaggtcaaatccctcctcacaagggtaattgaattactttagaataattgtgcctgtttctgaactttatataaaaggaatcatacagtatatatagaagtctgtgtttttttctaagtattattttgtctctgaaattcatctatgtaattgcttgtgtaatttctatgtagtaatattccctgcatatatcataattggtctctacattctaccgtttatgtcaaaatttatttaaactggacatacacattatttcttttttgattattagcattttgcctaaaggtttaatttctgagcattcagttttaaaaaatattagttaacttttatatgtaagatcgaatttaatgaaactatgattattaggttctcataaacattttgttatcgtgagaagttagaataatttatgttgaagatgtattgcctatatatatcctctatataggatatatatatcctctttattatgcttatacatctgttttagaaacgataattttatgttctgaatttggagaacattattaaaaaacccatgtaaataatttggaaataaaacacgtgcaataaaagctaatgctatatgaaaaagagtgatgttttgaatttaagaaagaaccctgaagaaagaaaacttatgtttttattgccattataaaatatgacataaaaatgtaattttagttatcattcaaattataaatctgggaactgaaatgtatattatttaagaatcaatttaagtatttcattaccaaataagaagtaagtctaggatgcattaaaacaaatttgatatgagattgcctacatttgccaattttattatattcttcaaattcctcctataaaactccacatgaggcctcaacctaagtccagtttatgttacttagtagatgtaacttaatcacaacattagctcaggatattggacacagtgtgcattaatgtcttctaagtaaagtgatttagttgctttttgtgttgtgtgtgtatgtgatctacactagagaaattcaatttctagaatagccatttacaaaagcctttctcctcctattggtgccctcaaagattactcttttgttattgattcctactcctgggctgcacctgcctatgggcaccccttctctctacagatgccatatgtcttcagaaatagttttttaagggatagctctgaaataactcactccttgcttttctgagggattgatgaagacaaaataaaatataaaatatatactttttaatcatagggaccctagtagctccgtagaaatgagttatgaagaccgatgcctgcaactgcacttttgtccttgtctctgcaccgcagagtgtggaagtcacttcttcatggagaaagaaactatttattagctgcctgaagtggatcggacactatgataggcactttacatgatttggattttctcacttcatcattacaaccagtttgcaaacagactttcatatctctgttactggatgttatagagatgtgatttggatttctgggcagtgttgagagccctgttactaagaatctactatagagactgcgaactctaaatgataaaaatgctaaccttactgcgaaaaaaatgaaaactgtgcgatgagtaacaacaaattagcatggtgaaacctacaaaagaactgtgtgctaaatgttggaggaacatgtagcacagagtaaataactgctcagaagagctgagaggcttccagaggagagactgtgtaaacagaggctgtgtgagtgctgtaccatggccagtgcccatggggccagcttttactctagatcaagtcaagtggcatgaacacacagagtgtcccatcccactgccgagctgctgggttgaggaatcaaccagtcaaactctcacgttgcccatgtgtaagcgcttcaagaaaatgacttccccagttgtattatgacttccccaagttgtagttgtattggcagcttgggctgccaaactgccacagactgagcggcttaaacaacagacattcatttctcacagttattttctaaacctctaaactgaggtttagagatgttatctgatttgcccaaaccctcacgaggttcagcatgaaactctcatccaggcacaatgcctatatttatcctctttcttatggttatacatctgccattgcagtccctttgggtccttttttaaaataattttaataatttttattttttgaaaaggcttttccaaggctcaatatacataaatcattgaatttataatgtttagtatatattaactgcttagtgtaatgtttagaatatacataaatcactgaattaactagtcagcttcctgagaaatttagtgatctcacaactgaatgatgacctggagagtttgttacaacacagattattgggtttcacccccaaatcttctgactcaggaggtccaggatggggcctgagaacttgcatttctaacgagttctcaggagacgctgctagtccatgcatcacatctggagatacactgc

SEQ ID NO: 408 - DNA, 3129 bp, Homo sapiens
cccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtag

SEQ ID NO: 409 - DNA, 16799 bp, Homo sapiens
gagcataaataaacccccatactttcagcaatttaacagtctaatgcaggtattccttgccagtggacagctttcctccatgtggtttctactatttctgactctgctatctcccagggcctcagaatcctttgcctccagcctgtcaaatgagagaggatgaagaggcacactcacttcttaactgcctttgtctggaagtgacccacatcattcttctcatagtctggagaactagtcatatgaccacacctaggtgcaaagaaagctagaaaacatggtacctggctgggtggttactttccagggctgcctccatcctatgggaggaagagcgtaaatttagatggatcattagccttctctgccacatagattgttcatgaaggaatgctgatgcaaaagcaggtatctcagtgcagactactgtgatggatcaggaaaggtaggaatccgggtctttttaacacagatgccagtctcttagcctcatcagttcattattattaagatgcttgctagttccagaataggaagaaactagaatcagaatagtctgtgtttgtttgcttgcttgcttatttatttatttccaagaacaggtttttggggaaaaaaaaagaaacactaacacattaaaatgtacacattaactgtaagatgcattgctatttcagtaacattataatgcgagaggaaacacaatagcatatcttagaattgacgaaatctagtaattgtcactgtgaattattggtttagtaatttttcacaaatccttttgctagcttcataaagtcctttaatagtgctcataggggatagccatgtgttggcacttggatctggtaggttctgcctgaccattttaatcaaaatgctgttaaccagggtaggcaccgcctgttgaatagcacaccttcttggtgaatttgtctcatggagcctcatttctggatgtgtcttaggcaaactaggagccctcaagatcatctagacccacgctggaaagaggtctaccttggagatgcatttatattcccccctgagatgctggtgattttgcaagtagtaataatcagagacctggaaaacttcaagagttctgtaggaaatatgtcctggtcagttctcatcagctcaacaaactgatgtggctcttgagggaaccagctgcaggaggcaggaaagcaagttagcatcaacacaagtgggccagcaccatagtcccaattctcctctttcatctgcttctcctccaccctagtagacaccttgggaagacaaggtagagacagtggcttgaaattcctagtgtcttcctttgatgggtatgtgctcctgcagagttaagggagtagatgaggttaactgtcatctaaacaaaggcagtggctgtaaatatattccttggagcttgggagccccatggctatgttccaggccagagagtccaaagaaaatcaaagactgccacctaacagcttttttggccatcctgaaagtccccaccttctcccaggtagctccagagaaagacaactcccagccaggctctgacagctgaatcgaatggcccagtggtggcacattccccagagggcttcaggttcaggatgcagccaagtttcctgctttatcctgagttaagcagagatcatcacctgcctggatgttgttttgtctgtgtcacctcatcactggagaaaacagattaccatctcctgcagtttttttcacaaaacagagcatggcatggaggaaataagatagtcagcatggcatcttggtgggtcaaaaataatatcatctgtatactttgattacattttaaattcagtttgcacacaattggggttcatttaattaactctaagctgtaatctcagtctgggtttgaatggatctgaattttaatagctttttcctccaaaatattatttctatggcaaataagcagcccttccttataatgctgaaatcatagaagttagttgttttcccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttatttacccctaccgagttttctaaatcagtgaatcagtattttaaggaataaatcttaggcacataaaatgataggaataaaatatgtattataaagcttctttaatcaatacaagctattcttataagtctattggttaatgtctagattgccgtgcccacttaaaatgggaaaacattccagttggcactttgtggatgttgagttgctacttggacacagttactggccttttggtctgatcagaggccaattttgagctaggagtttcccatgcatatgcatgatgtcctactatctgtgatacatgctgggcatctgagcctgcctggtatgctaatgatcagaccagggaaatgcacatcactgtgagtcacaagggtagcacgtctaatctaaaaaattcaaacccctataattagagttcagatgtcttcatagctctattcctcagatttttttgatctgaaaaacaaaagcaaacaacaaacaattgtgtaaaaatagacagtctaggcttgtgtaaatttgcagtggaaatctgcctctctgatgagccatacagtgtctatgggttgaaaaacgaaattcagaaagcaaatagttggtcaccttagagcccagagggatgctcagaattccctaacctcacagcggtgactactgaaagtttcattctgttttatgacttgacttgcagcgaggaaggtagcacagctgtaaaccagctgtattttatttacgcttggaaacagggcccctttgttccaaatgttcctggccccctccctcaatttcatggatttaggttgttagtggaaaagtagttgttgaaatatcagttcactcttggaacctgccactcaccaggacttctggcaaccagtgagcctttttgtgatatgcagcaaggtaaagaagtcgttaagtggatctcccacatgttcctctgtgacttcattcatagaaatgcgctgataactgagttacattaagcgcagtcttcccagctgtctgaggacataagggatgtagcgcctcctagtggagggaatttcttagcatgtgttcaaccccgcacatatttttggaatgaggcaaggtatttaaaaatagtgtacgctaatgaatgtatttattatatctgggtagcagcgaaacagaaaaggtataaataagcctttcgaaaaatgtacttgctacacaatctctttttttttgacaagtcagcccttgaatacaaataatcttttaatggtgaaaaaaatgactgaatcatagcatcttataaacataggagctatgggtatcaataacatggaaactgaagctgtggttatttttgagtggaagaagagggattaaaattggcgtggggcacatggagaggcttctggaagtggctagcaatttctatttatttttaactgggtggtgattacaaaggtgtttgccttataaaaattcatttagctaaacattggttttatgatgcttctgtatctgtattgataagaaggtaaaaaacataaaaacttttcattaaacatactacctgctaaatttgctttttaaggaaaaacctcaaaaatgctaagccatgtatactttttatttttagagatggagtctcactgtgttgcccaggctgaactcaaactcctgggattaagggtttctcttgagtagttgggactacgggcgtgcctggcatggttttgacactttatttcactgtactttcgaaataagacttaggtaccagtgaacacctacattgacaggcctggtaatatcattaaaacttgagcttttatgttgtctgtggcacagactctcttctttctagttcttcagagaactccaaattcagtatttcacttggaacatccagttgccatagaaatgaccatgtaggttacaagttcatttttgtaaccagtcaaaaggagaaactaagaatgacacgaaggcatctttccattggaaaaaaatcctttgcagagtcccaatttgagaaaaaatacattttgctttagaagtgagaggcgaacagatgaattagtaatgctgaaatatttgactccttcccccacaggtgaaaactcctgcagagcatcttataagaaaaattattttagagcaatataggtgatggcaaattgacattgggttgtaatattctatccaacatagtttaattctgagttattcaatcataactaaatttattcaagacatagaatacatttaaaaattcatcttaa

SEQ ID NO: 410 - DNA, 7395 bp, Homo sapiens
cccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtagtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttctt

SEQ ID NO: 411 - DNA, 9407 bp, Homo sapiens
gtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatatacttaatgcacaagtgtcaatgatatagttttcacctgaagaaaatctagagccatcaaagtacagggcgagacatactatatgagcctgaacgattgtggcaggattctaagaatctggatgatgaatctgaagaactctgtaacaaacagatgcaaagatgccatatttagacctcagaggaagtgagcctcctgtcactgggagaatccattcattctcctgattcactcatatgcagaataagtgttgatggccttctgtgtgctagggattcaaggacagtgcagtggaaaagatgggctagtacggaggatttagaaggtggtgtgggacaataagtactctgatagagaagcatgtggtgctctcagaagtaacttgtccatgatcacaaaccagtaagtggcaatttaattttgaacacatgtatatctgacaccaagactcatctatcaaccattaagctatatcattgcataagcagttccctgtaactggattggaaggtttgagataatggtgagaatggtgagaaagaatgatggagagatggactgtcttgtatgccattttaggtagagtttggattttatcctgtgggtcatgggaatctctcaggaagtgatctagttggatatgcatttttgagagagtactccactgtagtatatgaagtaatttgaattgggagggatggggagtgggcagtaagaccactcagaggtggctatcttgatactgatccaagaatgaaatagggatagactgacatgagagagtggctgtggagatggtgaagaaggcatggatttgatagttatgtggttgaattgctggaacttggtactgattgagtaaagggtgagaggtatggagaaataaagttgatagccatgtttccagcatagacaaggggatggttgatgttgaacatggaaagagggacatattttggggaaaagtgatgagtttattttggacatgttgagatcataataccttcggaatatacatgtgagatgcctgataggaaataacatgtaggtatggaattcaggaaggagatctggttttggggacttcagtaaatctgcatcaaatagtaactttagccatggatgtgaatgaggctatccagggaaagaatgcaaaatataaggtcaacctggtgactcactgtgctgagggaagccagggaagcagaaggggagtcagggtagacagaaacaggggggtaggtgaagatgaaagaactttccaggaaggagggagtgatgcatggtgccaaatgccactgacaggcaatggtacacattctaaaaagtgtccattgaacataccaactagaaggtaactggtggccctcacaagaatggaaaagcaggttcagtgaggttgtggagtgtggagttcagctgagaggaagttggggattaaatgaagtctttgtctccctaagtggtgtggctgtgaaggaaagaagagaagtaagtcttagctagagagggcataggatttgcatggattgttttaagaagaggaagtctaaattcttaggtgaaggagttaggagaaaatagtgaaagaggtgaaatgcaggtgagtggaggataaatgatggtatggggtccctgagaggtcagggcatgatggaattcaaggtactggttattagcctttttatgtacaaacaaaaaagatattgatgttctatttatgctaagtatgggcttgtcctggggagaaagtatctttaactgaagctagagagttgacaaggaacatgtacaaagatccctggacagtgttgagagctcagataaggttggagaccacagatttgtagtgtcgttctcctacactccagggcaccttatgtaggtgtttgatcttgggaaatgagactgtgcttagctctcatttgggatttttgccagatacctggatgtagccaaaggacgaggaggcaagattgttgaggatataggaagacagtgcagtgattggaatggattgttcacatgatcttaggcgaaaagacataaaaatgaagacaggagggctatgatggactgggataagatagaggaagctggagattagaagatttgaaaagacccaagagcagaggtgtgaggacaagccagtgagagacagggaaagaggcgaggctgtggttggagtctgggccgctgcacctaaacagttccacatttagtgatgaggccagatttcagccctgagtgcagatcgttgaggagagtgaagatcaaggtcatcagagttgaggttttcaggaaactgtgggaatagggttgaatgagtcatgaacacaaacactgaagtcaccccggatgatggtgggatttcatatagctcctgtgagccaaggaatgaagtcatcagtggatgtacggaagtgaccagaagatcagctggggacagagttaaggagagagggaacaagggaacagatgagactttttccatgagggcagaggagtcatggtctggaaatgacatgaaggagaaagaaaagtgccaaacccacttcctgatcctaatgccatctggcttaagagcccatattcattgagtctgaaatgcaacggacaactaccagtttgtctggaggcggtacaaatactcttctaatatttttttaaaaactataggatgtagtctattttcaactttattcaaccagatttattta

SEQ ID NO: 412 - DNA, 6689 bp, Homo sapiens
gtgctttaatctattgggaaaaggatgaattatttaatcactagcaatgacatggagggagaaaatcaatatgaaccaatggagcctcttttataaaggcactaattcaccccctgatatggtttagctatgtcccgacccaaatctcatcttgaattgtagttcccataatccccacatattgtgggaaggactatgtgggagatgactgaatcatgggggtggttacccctgtgctgctgttctcattatagtgagtgagttctcacaagatctgatgattttataaggggctttttcctgttttgctgggcactcctccttcctgccaccatatgaagaaggacatgtttgcttgcccttctgccatgattgtgaggcctccgcagccatatggaactgtgattcaattaaatgtctttcctttataaattacccagtctcaggtacgtctttattagcagtgtgtgaacaaactaatacagtaaattggtactggtagagtgaggtgctactgtaaagatacctgaaaatgtggaagcaactttggaactggtgaacagggagaggctggaacagtttggagtgctcagaagaagtcaggaagatgtgggaaagtttggaacttcctagagacttgttgaatggctttgaccaaaatgctgatagtgatatggacaataaagtccaggctgacgtggtctcagagggagatgaggagcaaaggagactcttgttatgttttagcaaagagactggtggcattttgctcctgccctagagatttgtggaactttgaacttgagagagacgattttggggcatctggcagaagaactttctaagcagcaaagtgttaaagaggtgacttgggtgctgttaaatgcattcagttttatatattcacaaatatatggtttggaattataacttatctttaaaagggaagcagagcataaaagttcaaaaaatttaaagcctgatgttgcgatagaaaagaaaatctcattttctgaagagaaattcaagccagctgcagaaatttgcataagtaacaagaaagccaaatgttaatcaccaaaacaatggggaaaatatctccacggcatgtcagaggtcttcatggcagcccctccaatcacaggcccagagggcctatgaggaaaaggtgtttttttgggctgggcccagggccttgctgctttgtgcagtcttgagacttggtgccctgtgtcccagccatggctaaaagaggccaatgtagagttcaggccattgcttcagagggtgcaagccccaagccttggaggcttccacatggtgttgagcctgcaggtgcacagaagtcaagaattgaggtttgggaacctccccctggatttcagagtatgtatggaaatgcctggatgtgcaggtagaggtgtgctgcaggggtggggccctcatggagaacctctgctagggcagtgtggaaaggaaatgtgggattgtagcctccacacagtgtccccactagggcactgcctagtggagctgtgagaagaaggccattgctctccagactccagaatggtagatctactgacagctttcatcgtgcaactagaaatgccacagactttcaatgctagtccatgaaagcaactgggaggggagctttaccctgcaaagccaaaggagcagagctgcccaaggccatgggaacccacctcttgcatcagcgtgacctggatgtgagacatggagatcaaggagataattttggaactttaaggtttaatgactgtccactagattttggacttgcatggagcctgtagccccttggttttggccaatttctcccatttggaatgggtatatttacctaatgcctgtacccccattgtatctaggaaataactaacttgcttttgattttacaggttcataggtggaagggacttgccttgtctcagatgagactttggactgtggacttttgagttaatgctgaaatgagttaagactttgggggactattgggaaggcatgtttgtgctttgacatgtgaggacctgagatttgggagaggccaggagtggactgatatggtttggctgtgtccccacctaaatctcatcttgaattgtagttcccataatccctgtgtgggatcatgtgggagatgactgaatcacaggggtggttaccccatgttgctgttctcattatagtgagtgagttggttttataaggggcttgtcctctttttgctgggcacttcttcctgccgccatatgaagaaggacatgtttgcttccccttctgccaggattgtgaggcctccccagccatgtggaactgtgagtcaattaaacctctttcctttttaaattacccagtcagctatgtctttatcagcagtgggagaatgaactaatacacccccgaaggccctacctaatataatcacattgataattaggttttcaacatataaatttggctggtggtggtggggaggtcataaacattcagtccatagcatgcagataaatttaggagtctagaattcaaaagagacgtctgggctggctgtataaagatgggaatcatcaatgtttagatggtacttcaagctaggaggttggatgaaatcaccatgggagttaaggtaggtagagaagaggtctgagaatagagctctggactgttacaggagatggtgaggcactaggaaatgaaaataagaagggctggccagtgaattaggagaggactaagagaactagggacctagaatttaagaaagtatttctagaaaggggcagtgaccatccttatgaaaagctgctgatatgccacgaaatctgaggccagaggattgtccactggatttagtagcaaggaggttactggtgccctgaactggagctgtttagatggagaggtggaggtgaacactgggaggtctggatttaagtgagaatgagatgaggcagcaggagtgttgactccttcaaggagttttgctgtaaagaggaatagaaaatggagtagtagatgagggagattgtgggcttggaaggggatacttttagagatatgacagtatgtttgagggctgcagagaatgatctagagcctgagaaacattgatgagggaggagagagatgagacaactgctagaaggaagcacttgagttgggaaatgaggaaggcatcgagtgcacaaatagagaggctgttcttgtgcaggagtgatagcagagcccacagaatgagtgcaggtgtgcgggagcctgtggtggcttggtctgtggatgaaccttctgactgcttccgttttctcagtgaaatgggaagcaaggtcatcagctggcagggaggaagggggaagaggtgttggaaatttgaggagagaagagaaggtgtgaaataatcctctcagacagttcaggagtaattgatctaaggcaatgcagtcagatttctggatacctccaacggctcccctgtgattagggatcttgaatttaaataagagcagacagtagaaatcaggtcttgggtgtgtctccagtgttttcaactcaataggtgcaagtacaggtaggcaaagtattggatttaatctgagttgggcttttgccagctgagtatgacagagagagaggggtgcaagggaattgagggtgtggactgtgggtatgatgatggttattgatcatagaatctgaaagctggtcagagagggacatgaggtgggtgcggggcagtgaaggggtggtagaaagagtgctatgctttatttgacttaacaaactggactccttattataaattcaatcacatttctaatgcatggtggaaagttagtatgttaaaaaaaatagtacatttttatatgttaaatatcctatataatagtaataattatctgctgtgttgctgtttttattatattctttttctttatgtttttagagatggagtcttgctctgttgtccaggctggaatgcagtaccatgatcatagctcactgcagccttgaagtcctgggctcaagcaatcctcctgcctcagccaactaagtagctgtgactacaggtgtgtgccaccatgcctggctaattaaaaaaaattattttagagacggtggcttgctatgttgctgaagctggtctcaaactcctggcctcaagccatcctcctacctcagcctcccaaatagctgagattataggcatgagccactgtacccaggtatattgtattttcttaaagcaagtcatggtatacctgaaagaaaccaaatataaggcactgtagatgaatcccagtgctgttggcagaagggacagggaggccacatgtgaaccaggggtcactggccctgccccaaaggctggacttgaatatgcagctggtgccactggctaacagagccacagtctcggtcacaataatagaactgttgacccatgaggtttctggtcataggggcagaaactgccaacagggagagggcagctggccatctgaagccaggatctgtcccatccaggaaaggagaattggcaggagttggggacatcttgccatgggtgaatactcctctgagaagggagaagggaggaggcagcttacagacagaaccatgagggagggacaacatggagcccaaagccctgctcctgagttgctgggtctggatctcggggtcagggttgtttgtgagattggagaggcagcagaagtagcccagatgaaagggaagaacctgggttggtctctttgctgggcaaactctttgcaccacagtctgggctggctcaggcattggataggagtgagcctgagggtgggggtactgacccatccagcggcacaatttgggaaaggaaggggcagaagaagcaaggcgcggctgatgaggaacatctgctctcttcccacagtgcagatggaaggcctaaatgccagcacaccgtttatttcactttggcaaaatccatgtttatttcatccctcacctcattgtctagacttaacataaatcaggacagtgcaaatggaaaccacaggtccttctcttggccttgccagctttattcttccctagggcaggtgcgcatgttgcattagtgtcataaggtggcatgagactgtaccaggccattagtcctgattctgatccagcagcatcactgccttgctccgtgatcttcccatgtttgagtcacctcatccttgatatggaaggggcagtacctgttctctcagtagcataagataagaggtagggaagtgcttgggaaaatgcaataaaagacactgctggaagccttcagcagtaggttgggttacagaggtcttggccttgcaaaatgaagtgaggtcagcacagattaagcagaccaaatcaaatctttgatggttgagtgatttttaaaaatgattgcaggtctgcacaatttaacaagactgcccatagcagctgaaaacatttccagagcagatcagataaagccaagttagaaattggtcattgctgtaaatcaagtggcagactatcaatgacctagattaccccagttttcccacaggaagtgaaaggaaaaccactgtgtggctgctgaggcttgatttgtcaagagctgagagagctacacaacattaaaagattgcccatttctcagcttgccctaatgaattgggactcatttaattcagaagctgatgagatgtctaaatcacatctatagaataagtggtcagatttaaactccagttgccaacaatctgtaacggcctctggttgcgttgttcatctcttagttaataaatgcttggctttttgctgaagctgccgctttttaatgtctaacaccatgacgtcagcatttttcccattttctgccctccctttaaggaggtagggatgagaaatggtaagaagatagggcttgttatgggtcttgacttggaagacccagagcatgggtcttgaagtagaaccttgatggctcttttctgtctgtgctgcaggtttaggggcctgcatttagactggcccataactatgggagctgctcccagccatcctagacttctcaagaagcccataactcttaggaagaactaagagcctaactcgtgttgtcctggacttttcaagaagccgataactcctaggtagaaccaggaacccaactctactcgtctgtcctacgtagggtctacaaggcagtgtaacacaccacgccctgcaccctaactgatcatagtcagccgtggtgaccacaggatggttcatccttcttgctggttcccagcatccttcttgctggttcgcatgtgctcttttggcacttatcactcccacattctggactcctggccctgcagttgactttgaccctacctttggccctttgaatttgtgcaaataccactgctgagctgacttgactcattctccagctcccactaccgtttgcagtgaaggtttgtaatgcccttgatgagaatgaagctcccagtttcacattgggacacagtgggtaagcaaatgccacacaaaagaaggcacatagtgcacacttgtaccatcatctaacgtctgcatggttctattgcagggctatactttcttatcggtagatacatggaaatggaaatgcacctgcttttaaatatata

SEQ ID NO: 413 - DNA, 6149 bp, Homo sapiens
ctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttaggtaagattaaatttaaaaaataataaatttgggtgagggaggaatttattttcagaagttatctagaaatatgtatcatgaactttataatgctattaaaatgtacatgggaaatggcagcataaatcaattcaacaaatatttactgagtgtgtactgtgcaccaggcaactggatttggcactaaggatacaatgggaaggaagacatatggtgctgctgtccatgcagcttatgttttggcagagaagacagacaaaaaaaaaaacaaaaacaaagtaacaggggaaccctctttgtggcatagaggaatggctttctgagggagtgacatttaacccgaaagcaaagagaagagagggttagccatgtgaagaatggcagtaaggggagggagcagcttgttctttgaggctcaaaagaccctgtgagtttaaggaagtgaaagaagattagagttaaacgtccctgactgacagctttgaagagagtagtggttctcccagcacggagtttgagatctgagaatggacagactgcctcctcaagtgggtccctgacccccgagtagcctaactgggaggcatctcccagtaggggctggctgatagtgcccctctgagacgaagcttccagaggaacaatcaggcagcaacatttgccgttctgcaatatatgccgttctgcagcctccactggtgatacccaggcaaacagggtctggagtggacctccagcgaactccaacagacctgcagctcagggtcctgactgttagaaggaaaactaacaaacagaaaggatatccacaccaaaaccctatctgtacgtcaccatcatcaaagaccaaaggtagataaaaccacaaagatggggagaaaccagagcagaaaagctgaaaattctaaaaatcagagcgcctgttctcctccaaaggaatgcagctcctcaccagcaatggaacaaagatggatggagaatgactttaacgagttgaaagaagaaggcttcagaagatcggtaataacaaacttctccgagctaaaggaggatgtttgaacccatcgcaaagaaagtaaaagccttgaaaaaagatggcacgaatgtctaactagaataaacagcatagagaagaccttaaatgacctgacagagctgaaaaccgtggcacgagaactacgtgacacatgcacaagcttcagtagctgattcgatcaactggaagaaagaatatcagtgattgaagatcaagtgaatgaaatgaagccagaagagaagtttagagaaaaaagagtaaaaaaaaatgaacaaagcctctaagaaatatgggactatgtgaaaagaccaaatctacgattgaatggtgtacctgaaagtgacagggagaatggaaccaatttggaaaacactcttcaggatattatccaggagaacttccccaacctagcaaggcaggccaacattcaaattcaggaaatacagagaatgccacgaagatactcctcgagaatagcaactccaagacacgtaattgtcagattcatcaaagttgaaatgaaggaaaaaatgttaagggcaggcagagagaaaggtcgggttacccacaagggaagcccatcagactaacagccgatctcttggcagaaactctgcaagccagaagagagtaggggccaatattcaacattcttaaagaaaataattttcaacccagaatctcatatccaaccaaactaagcttcataagtgaaggagaaataaaatcctttacagacaagcaaatgctgagagattttgtcaccaccaggcctgccttacaagagctcctgaaggaagcactaaacatggaaaggaacaactggtaccagccactgcaaaaacatgccaaattgtaaagaccatcaatgcaaggaagaaactgcatcaagtaatgagcaaaataaccagctaacatcataatgaaaggaccaaattcacacataacaatattaaccttaaatgtaaatgggctaaatgcccccaattaaaagacgcagactggcaaattggataaagagtcaagacccatctgtgtgctgtattcaggagacccatctcatgtgcagagacacacataggctcaaaataaagggatggaggaagatctaccaagcaaatggaaagcaaaaaaaggcaggggttgcattcctagtctctgataaaacagactttaaaccaacaaagatcaaaagagacaaagaaggccattacataatggtaaagggatcaattcaacaggaagagctaactatcctaaatatatatgcacccaatacaggagaatccagattcataaagcaagtccttagagacctacaaagagacttagactcccacacaataataatgggagactttaacaccccccactgtcaatgttagatccacaagagagaaagttaacaaggatatccaggaattgaactcagctctgcaccaagcagacctaatacagaactctccaccccaaatcaacagaacatacattcttctcagcaccacattgcacttattccaaaattgaccacatagttggaagtaaagctctcctcagcaaatgtaaaagaacagaaattataacaaactgtctctcagaccccagtgcaatcaaactagaactcaggattaagaaactcactcaaaaccgctcaactacatggaaactgaacaacctgctcttgaatgactactgggtacttaatgaaatgaaggcagaaataaagatgttctttgaaaccaatgagaacaaagacacaacataccagaatctctaggacacgtttaaagcagtgtgtagagggaaatgtatagcactaaatgcccacaagagacagcagaaaagatctaaaatcgacatcctaacatcacaattaaaagaactagagaagcaagagcaaacacattcaaaagctagcagaaggcaagatacaactaaaatcagagccaaactgaaggagatagagccacaaaaaacccttcaaaaaaatcagtgaatccaggagctggttttttgaaagatcaacaaaataggtagacccctagcaagactaacaaagaagaaaagagagaagaatcaaatagacacaataaaaaatgataaaggagatatcaccaccaatcccacagagatacaaactatcatcagacaatactgtaaacacctctacgcaaataagctagaaaatctagaagaattggataaattcctggacacatacaccctcccaagactaaaccaggaagaagttgaatctctgaatagaccaataacaggctctgaaattgatgcaataattaagagcctgccaacccaaaaaagtccaggatcagacggagtcacagctgaattctaccagaggtacaaagaggagctggtaccattccttctgaaactcttcaatgaatagaaaaagagggaatccaccctaactcattttatgaggccagcatcatcctgacaccaaagcctggcagagacacaacaaaaaaagagaattttagaccaatatccctgatgaacatcgatgtgaaaattctcaataaaatactggcaaaccgaatccagcagcacatcaaaaagcttatccaccatgatcaagtgggcttcatccctggcatgcaaggctggttcaacatacacaaattgataaacataatccatcgtataaacagaaccaaagacaaaaccatattattatctcaatagatggagaaaaggcctttgacaaacttcaacagcccttcatgctaaaaactcaataaattaggtattgatgggatgtatctcaaaataataagagctatttatgagaaacccacagccaatatcatactgaatgggcaaaaactggaagcattccctttgaaaactggcacaagacagggatgccctctctcaccactcctattcaacatagtgttggaaattctggccagggcaatcaggcaggagaaagaaataaaggatgttcacttaggaaaagaggaagtcaaattgtccctgtttgcagatgacgtgattgtatatttagaaaaccccattgtctcagcccaaaatctccttaagctgatacgcaacttcagcaaactctcaggatacaaaatcaatgtgcaaaaatcacaagcattcctatacaccaatgatagacagacagagagcagaatcatgagtgaactcccattcacaattgcttcaaagagaataaaatacctaggaatccagcttaaaagggatgtgaaggacctcttcaaggagaattacaaaccactgctcaacgaaataaaagaggacacaaacaaatggaggaacattccatgctcgtggataggaagaatcaatatcatgaaaatggccatactgcccaaggtaatttatagattcaatgccatccccatcaagctaccaatgactttcttcacagaattcgaaaaaactactttaaagttcatatggaaccaaaaaagagcctgcattgccaagacaatcctaagcaaaaagaacaaagctggaggcatcacactacctgacttcaaactatactacaaggctacagtaaacaaaacagcatggtactggtaccaaaacagagatatagaccaatggaacagaacagagccctcagaaataacaccacacatctataaccatctgatctttgacaaacctgacaaaaacaagcaatggggaagggattccctatttaataaatggtgatgggaaaactggctagccatatgtagaaagctgaaactggatctcttccttacaccttatacaaaaattaattcaagatggattaaagacttaaatgtcagacctaaaaccataaaaaccctagaagaaaacctaggcaatactattcaggacataggcatgggcaaggacttcatgtctaaaacaccaaaagcaatggcaacaaaagccaaaattgacagatgggatctaattaaactaaagagcttctgcacagcaaaagaaactaccatcagagtgaacaggcaacctacagaatgggagaaaatttttgcaatgcacccatctgacaaagggctaatatccagaatctacaaagaacttaaatttacaagaaaaaaagcagccccatcaaaaagtgggcgaaggatatgaacagacacatctcaaaagaagacatttatgaaaaaatgctcatcatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggagtgtaaactagttcaacctttgtggaagactgtgtgtgattcctcaaggatctagaactagaaataccatttgacccagccatcccattactgggtatatacccaaaggattgtaaatcatgccactataaagacacacgcacacatatgtttattgcggcactattcacaatagcgaagacttggaaccaacctgaatgtccatcaatgatagactggattaagaaaatgtggcacatatacaccatggaatactatgcagccataaaaaaggatgagttcatgtcctttgtagggacatggttgaagctggaaaccatcattctttgcaaactgtcacaaggacagaaaaccaaacaccgcatgttctcactcataggtgggaactgaacaatgagaacacttggacacagggtgggtaacaccacacactggggcctgtcatggggtggggctagaggggagggatagcattaggagaaatacctaatgtaaatgacgagttaatgggtgcagcacaccaacatggcacgtgtatacatatgtaacctgcacgttgtgcacatgtaccctagaacttaaagtataattaaaaaaaagaaaa

SEQ ID NO: 414 - DNA, 5932 bp, Homo sapiens
gggtgagggaggaatttattttcagaagttatctagaaatatgtatcatgaactttataatgctattaaaatgtacatgggaaatggcagcataaatcaattcaacaaatatttactgagtgtgtactgtgcaccaggcaactggatttggcactaaggatacaatgggaaggaagacatatggtgctgctgtccatgcagcttatgttttggcagagaagacagacaaaaaaaaaaacaaaaacaaagtaacaggggaaccctctttgtggcatagaggaatggctttctgagggagtgacatttaacccgaaagcaaagagaagagagggttagccatgtgaagaatggcagtaaggggagggagcagcttgttctttgaggctcaaaagaccctgtgagtttaaggaagtgaaagaagattagagttaaacgtccctgactgacagctttgaagagagtagtggttctcccagcacggagtttgagatctgagaatggacagactgcctcctcaagtgggtccctgacccccgagtagcctaactgggaggcatctcccagtaggggctggctgatagtgcccctctgagacgaagcttccagaggaacaatcaggcagcaacatttgccgttctgcaatatatgccgttctgcagcctccactggtgatacccaggcaaacagggtctggagtggacctccagcgaactccaacagacctgcagctcagggtcctgactgttagaaggaaaactaacaaacagaaaggatatccacaccaaaaccctatctgtacgtcaccatcatcaaagaccaaaggtagataaaaccacaaagatggggagaaaccagagcagaaaagctgaaaattctaaaaatcagagcgcctgttctcctccaaaggaatgcagctcctcaccagcaatggaacaaagatggatggagaatgactttaacgagttgaaagaagaaggcttcagaagatcggtaataacaaacttctccgagctaaaggaggatgtttgaacccatcgcaaagaaagtaaaagccttgaaaaaagatggcacgaatgtctaactagaataaacagcatagagaagaccttaaatgacctgacagagctgaaaaccgtggcacgagaactacgtgacacatgcacaagcttcagtagctgattcgatcaactggaagaaagaatatcagtgattgaagatcaagtgaatgaaatgaagccagaagagaagtttagagaaaaaagagtaaaaaaaaatgaacaaagcctctaagaaatatgggactatgtgaaaagaccaaatctacgattgaatggtgtacctgaaagtgacagggagaatggaaccaatttggaaaacactcttcaggatattatccaggagaacttccccaacctagcaaggcaggccaacattcaaattcaggaaatacagagaatgccacgaagatactcctcgagaatagcaactccaagacacgtaattgtcagattcatcaaagttgaaatgaaggaaaaaatgttaagggcaggcagagagaaaggtcgggttacccacaagggaagcccatcagactaacagccgatctcttggcagaaactctgcaagccagaagagagtaggggccaatattcaacattcttaaagaaaataattttcaacccagaatctcatatccaaccaaactaagcttcataagtgaaggagaaataaaatcctttacagacaagcaaatgctgagagattttgtcaccaccaggcctgccttacaagagctcctgaaggaagcactaaacatggaaaggaacaactggtaccagccactgcaaaaacatgccaaattgtaaagaccatcaatgcaaggaagaaactgcatcaagtaatgagcaaaataaccagctaacatcataatgaaaggaccaaattcacacataacaatattaaccttaaatgtaaatgggctaaatgcccccaattaaaagacgcagactggcaaattggataaagagtcaagacccatctgtgtgctgtattcaggagacccatctcatgtgcagagacacacataggctcaaaataaagggatggaggaagatctaccaagcaaatggaaagcaaaaaaaggcaggggttgcattcctagtctctgataaaacagactttaaaccaacaaagatcaaaagagacaaagaaggccattacataatggtaaagggatcaattcaacaggaagagctaactatcctaaatatatatgcacccaatacaggagaatccagattcataaagcaagtccttagagacctacaaagagacttagactcccacacaataataatgggagactttaacaccccccactgtcaatgttagatccacaagagagaaagttaacaaggatatccaggaattgaactcagctctgcaccaagcagacctaatacagaactctccaccccaaatcaacagaacatacattcttctcagcaccacattgcacttattccaaaattgaccacatagttggaagtaaagctctcctcagcaaatgtaaaagaacagaaattataacaaactgtctctcagaccccagtgcaatcaaactagaactcaggattaagaaactcactcaaaaccgctcaactacatggaaactgaacaacctgctcttgaatgactactgggtacttaatgaaatgaaggcagaaataaagatgttctttgaaaccaatgagaacaaagacacaacataccagaatctctaggacacgtttaaagcagtgtgtagagggaaatgtatagcactaaatgcccacaagagacagcagaaaagatctaaaatcgacatcctaacatcacaattaaaagaactagagaagcaagagcaaacacattcaaaagctagcagaaggcaagatacaactaaaatcagagccaaactgaaggagatagagccacaaaaaacccttcaaaaaaatcagtgaatccaggagctggttttttgaaagatcaacaaaataggtagacccctagcaagactaacaaagaagaaaagagagaagaatcaaatagacacaataaaaaatgataaaggagatatcaccaccaatcccacagagatacaaactatcatcagacaatactgtaaacacctctacgcaaataagctagaaaatctagaagaattggataaattcctggacacatacaccctcccaagactaaaccaggaagaagttgaatctctgaatagaccaataacaggctctgaaattgatgcaataattaagagcctgccaacccaaaaaagtccaggatcagacggagtcacagctgaattctaccagaggtacaaagaggagctggtaccattccttctgaaactcttcaatgaatagaaaaagagggaatccaccctaactcattttatgaggccagcatcatcctgacaccaaagcctggcagagacacaacaaaaaaagagaattttagaccaatatccctgatgaacatcgatgtgaaaattctcaataaaatactggcaaaccgaatccagcagcacatcaaaaagcttatccaccatgatcaagtgggcttcatccctggcatgcaaggctggttcaacatacacaaattgataaacataatccatcgtataaacagaaccaaagacaaaaccatattattatctcaatagatggagaaaaggcctttgacaaacttcaacagcccttcatgctaaaaactcaataaattaggtattgatgggatgtatctcaaaataataagagctatttatgagaaacccacagccaatatcatactgaatgggcaaaaactggaagcattccctttgaaaactggcacaagacagggatgccctctctcaccactcctattcaacatagtgttggaaattctggccagggcaatcaggcaggagaaagaaataaaggatgttcacttaggaaaagaggaagtcaaattgtccctgtttgcagatgacgtgattgtatatttagaaaaccccattgtctcagcccaaaatctccttaagctgatacgcaacttcagcaaactctcaggatacaaaatcaatgtgcaaaaatcacaagcattcctatacaccaatgatagacagacagagagcagaatcatgagtgaactcccattcacaattgcttcaaagagaataaaatacctaggaatccagcttaaaagggatgtgaaggacctcttcaaggagaattacaaaccactgctcaacgaaataaaagaggacacaaacaaatggaggaacattccatgctcgtggataggaagaatcaatatcatgaaaatggccatactgcccaaggtaatttatagattcaatgccatccccatcaagctaccaatgactttcttcacagaattcgaaaaaactactttaaagttcatatggaaccaaaaaagagcctgcattgccaagacaatcctaagcaaaaagaacaaagctggaggcatcacactacctgacttcaaactatactacaaggctacagtaaacaaaacagcatggtactggtaccaaaacagagatatagaccaatggaacagaacagagccctcagaaataacaccacacatctataaccatctgatctttgacaaacctgacaaaaacaagcaatggggaagggattccctatttaataaatggtgatgggaaaactggctagccatatgtagaaagctgaaactggatctcttccttacaccttatacaaaaattaattcaagatggattaaagacttaaatgtcagacctaaaaccataaaaaccctagaagaaaacctaggcaatactattcaggacataggcatgggcaaggacttcatgtctaaaacaccaaaagcaatggcaacaaaagccaaaattgacagatgggatctaattaaactaaagagcttctgcacagcaaaagaaactaccatcagagtgaacaggcaacctacagaatgggagaaaatttttgcaatgcacccatctgacaaagggctaatatccagaatctacaaagaacttaaatttacaagaaaaaaagcagccccatcaaaaagtgggcgaaggatatgaacagacacatctcaaaagaagacatttatgaaaaaatgctcatcatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggagtgtaaactagttcaacctttgtggaagactgtgtgtgattcctcaaggatctagaactagaaataccatttgacccagccatcccattactgggtatatacccaaaggattgtaaatcatgccactataaagacacacgcacacatatgtttattgcggcactattcacaatagcgaagacttggaaccaacctgaatgtccatcaatgatagactggattaagaaaatgtggcacatatacaccatggaatactatgcagccataaaaaaggatgagttcatgtcctttgtagggacatggttgaagctggaaaccatcattctttgcaaactgtcacaaggacagaaaaccaaacaccgcatgttctcactcataggtgggaactgaacaatgagaacacttggacacagggtgggtaacaccacacactggggcctgtcatggggtggggctagaggggagggatagcattaggagaaatacctaatgtaaatgacgagttaatgggtgcagcacaccaacatggcacgtgtatacatatgtaacctgcacgttgtgcacatgtaccctagaacttaaagtataattaaaaaaaagaaaa

SEQ ID NO: 415 - DNA, 2883973 bp, Homo sapiens (residues 1-1,441,987 of 2,883,973)
  misc_feature (1300925)..(1400924): n is a, c, g, or t
  misc_feature (1735004)..(1835003): n is a, c, g, or t
  misc_feature (2703741)..(2753740): n is a, c, g, or t
tcttaatgatcattaaattataattgcgattcagaccttgctacgtctctgagtcaaaaattagatctttgtttaggaatcagtggtactctgcaacttggaaataggaagattttagaagactcaaacattgactttcttgtgtgcaaaaaaaaagacgtattgagataagacaagtctttccttgcaaggatacctctatgctcatacaacacctcccctaacgttactatagcttccaggtcactaaccagtgtcagagagcagcctatgcaactacaaattcaaaagatgtggaacatagggtcaagcctagaataagaagtcttagctaattaagtatgctttttcccccaaattcatattaacaaaaacttggatatgtcagagaatgcattctaagttcactcaacctaggagggagaaacataattttaaattaagagctgaaacattgttctcctaacaaaaagcaaggaaaatgatatatcacaccacaggagggatttcacaaattagtgtcaatatcaaaaccttaaaatacgcaaggaaaatgcagattcacaatgaactcttgtacttgttttgttcagaaaagagatggttctgagagaacgacagtgaactaaccccagctggtttagttggtgctttcaactgctgcttctgatcaactcctttagctagaataaattgatgaggattctggcatgtggtattagagatggttattaattttttcctcttatttgcgttgttcaatgtagtaaatactagctgtatatggctacttcaattcaaattattacaatgaaatatacttcaatattgaattttttagtcactcttggttcattattgaatatcttcagctaagatttcccatctaaatacactaagaggtggcttagttaactggtcgttcacaaatattgacgatgttgttaactcctgatatattctctgcaaagagaatattcatgagcctcctcctgaaatcagcagcctagagatagttttataaattggatacaagttggaaatctatatactctttaagtttttgaaatattagcttcccagggaagaaaatcaaattcataagatatgttaggacaatttaactccagatgttcaaaactgaaatgacatattctacaatatgtgataaaaccaccccctaacaacttaaagcaaaacagggattgaccttaaagacctgccttttcctcatctctcagccaatcagttttcaaatcttgcattttattttgaaatgtacttatccccctagtctgttgtttctagacttggcacatatttaagtttgtttcctctatctactgactttcctctcttcaaacagtatctatgcctgccaaatgtgaacatacaaaaaactaatcagaatatgccattctgatttaaactgattattagttaatactctcaagataacatctgggttcttagctgcactgaatcaagcctacttacatcttttttttttgtcttcggctgcacttttcctatcacatcacaccccagcaatgacaagctgtgcgggccttctaccccatttccactattttgcccctgccgccatggctttttccgcgctcccgcggctttttgccccgccgcggcgggtttttgccgccgtggctttttgcccgcgccaccgctgctttttgcacctttttgcccccgccgccgcgacattatatggttttttgctcccactgctttttgcccccgcctccgcggctttttgcctccccggctttttgcccccgccgccgcgactttttgcccccgtcgcctccgctttttgcccccgccgcagcggctttttgtccccgccaccgaggatttttgtccccgccgccgcggctctgagggggggagcagcagactcggctgccagctctactggtgtcttggcaagggcagcgccgaggggcgctcctggtccagctctcctggctcagggggttccttgcctaggcgctggcaccccgggctccctgcctaggcccctgtggcctgcatagagcggcgctgcacgcggaggcgatgggagagaagaaggagggcggtggcaggggtgaagcggagggtggtgcaggggctgcggccagccgggcgctgcagcagtgcgggcagctccagaagctcatcgtcatcttcattggcagcctgtgggggctgtgcagcaagtgcgctgtgtccaacgacctcacccagcaggagatagggaccctggaggtaaggggttcggggacccgggctgggctccaggagcggcccggacacctccttcagggccccagttcactcctggcagagttgcatccttgagcccgagtcacccccttggaggcttcccctccctcctgcactcgctgatgcggcagccagaggacccgggaccaaccctcaccttgggcaggatttgtggagcgggtgcgtggtgggaaatgggatggaggctccagggtcccatgggggtgggggtgggctgcgcgcggacatcctcttaccccctgaatttccatctggtccagccctctcatcttgtaggtgaggaaaccaaaggcctgagggagaactgacttgccaggaacccctgttaaggagaattaacaaagtgtgtttattaaagaagaactaagttgggagtcagacctggaggcctgcgcccttggttaagacattacaccaccttgagtctggcctgttgactgagggtgagccactccatcctcgtctgattgtggggtcttgaccccaaggggtttcctgcaggaagaagcaaatgggtttgctttcctagctctgtccagtaccttagggactctgaggactgaagagattcttggagagccatctggtgtatgtcatgggtgggccttttttgaaggtcagtctacccagtgggctggctcagcccgaatgaactgtcttgaatctttggagttgtctgtgtacttttaagggcttctcagccttgcaccaaaagatccccctggaaattaggtgggaaaaccttaacttttgtggggccttgtgtttgtcttaaaagttcatgcacatggccaggtgtggtggctcccacctgttatcctgtcctggatcccttaagtcaaggagtttgagaccaacctggacaatatagtgagaccccatctctacaaaaaataaaatattagccaggggtggttgtgcgcatctgtagtcccagctactactgtggctgaggtgggaggagcacttgatcctgcactgagctgtgatctcaccagtgtactccagcctgggccacagagcaagaccgtgactcaaaaaaaaaaaaaaaaaagacaagaaaaattcttgaagattttgcattctgtcccactatctgttggttttcatgtcaagataatgtcagaaattctttacaattgcttccagaaggagtagccttttgatctagtgcacaggtgtccagtcttttggcttctcagggccacattggaagaagaatgctcctgggccacacacaaaatacactaatgctgacaacagctgatgagcttaaaaaaaaaaaaaggtttatgcataattttcatgatacccaccaccacagataggcagaaaagtccttgtagtcaaagggttggacacagctgatctagtatcttgtcgtccgttttgctttctccctgattccagaatgcaggtagagatgtagagacatgctctcaggacagttgttgagataaaaaaattcgttgtcatttattcccaagcacaactggttctcattgcattgaaaaattctccgttcaaactgctgtcacatataaaatctatttatgtaagtctgtatttttctgttgtcttggtctttgtaggcagtagtgtgttttaaccgagcaaactgtccttccaaataatgaagccgaagtcagcctacctgcttgccatttttcttccccttccatttttgtaacctcagaataattgtaagaatgaattaagatttgtgtttaaggccaggcacagtgtctcaggcctgtaatctcagcactttgggaggcggagacggatgtaccgcttgagctcaggagttgaagaccagcctgggcaacatactgagactccgtcttgtataatttaattaaaatttaaaaaaagaagagaaaaagacctgtgtttaaaatttaaaaaaaggggggaaagtgtaatgcaaaatgtggactatgccagctatgattgggaaaactagtttctcatacagcattatctgtagacttgtattagcagcatactggtcataagcgttttgctttcctcaaatatgatgaggtaagctaatttaaagtgtgttgaggctttctgccgcgtggctcctggaggtgttgagtcccaatttagccaattaatttgggtttagttttgatatggataagggagaccagcttcattcatggtgtacacacagttttgccaataaggaaaaaaaaagccacctgaatattcctactcattagatgctagctggagagctcctaccccacccccaccaaggcccgggccattaaaaagactcaatgcagcctttctgtatctcatactgtattctgcaagatactcctgtgaaagaaagttgtgctgcatcagccatctccctcctgaagatccctgcggatgaggatttgtgttttgaaggttctgagaattcctgcaacaacaattctcaaacttatttgtccaggggatcttttcttccactgaatgtagttggggagacacggccttaagccttgagcagagaaagagacgagaaactgttggctcacttacaaccaagtgttgtgtttatgttttaggtttttatgaaactgaggtgctgtttgaggttctaagtgaaattgggtggttgaagagaggctggtatccctgtagacttagccagccatgagaagttgccttttgttgaaggaggtgttttacaaagggaaatagggtgtctcctgggcattgcattagcacttaaatacatgtatcactgaaatgaaatgaaatgatgaaatgatgaaatgaagaaatgaaatgatgaaatgaagaaatgaaatatgagatgaaatgatgaaaggatgaaatgaaatgaaatgatgaaatggaatgatgaaatgaaatgatgaaatgatgacatgaaatggtgaaatgaaatgaaattgaaataatgaaatgaaatgatgaaatgatgaaatgaaatgaaaagatgaaatgatgaattgaggaaatgatatgaaatgatgaaatgaaatgatgaaatgaagtgaatgatgaaatgatgaaataatgaaatgaaatgatgaattgatgaaatgaaatgatgaaatgagatgaaaaggtgaaatgaaatgaaatgattaaatgaaatgaggacatgaaaagatgaaatgaaatgatgagatgaaatgaaatcacgagatgaaatgatgaaatgaaatcatgagatgaaatgatgagatgaagtgaaatgatgaaatgaaatgatgagatgaaatgaaataatgcaatgaaagatgaaatgatgagatgaagtgaaatgatgaaatgatgaaatgtaatgaaatgatgaaatggaatgatgaaatgaaatgatgaaatgaaatggtgaaatgaaatgaaatgaaaagatcaaatggtgaaatgaagaaatgatatgaaatgatgaaatggaatgatgaaatgaagtgaaatgattaaatgatgaaataatgaaatgaaatgatgaaatgatgaattgatgaaatgaaatgatcaaatgaaatgacgagatgaaaagatgaaatgaaatgaaatgatgaaatgaaatgacgagatgaaaagatgaaatgagatgaaatgataagatgaaatgaaatcatgagatgatgaaatgatgagatgaagtgaaatgatgaaatgaaatgacaaaatgcaacaatgagaagaaatgatgaaatgaaataatgaaatgaaaggatgaaatgatgagatgaaatgaaaggatgaaatgaaatgatgaaatgaggaaatgaaatgaagtgaaatgatgaaatgatggaataaaagatgaaatgatgaaatgatatgaaatgatgaaatgatgacatgaagttaaatgatgaaatgatgaaataaatgaaatgagatgaaaagatgaaatgatgaaatgatgagatgaaatgaaatgagatggaatcatgagatgaaatgatgaaatgacgaaatgaaatgttgagatgaagtgatgaaatgaaatgatgaaatgatgaaatgaaatgttgagatgaagtgatgaaatgaaatgaaacaatgaaatgaagtgaaatgaaatgagatgaaatgatgaattgatgaaatgaaatgagatgaaaagacgaaatgatgaaatgatgagatgaaaagatgaaatgatgagatgaaatgaaatcatgagatgaaatgatgagatgaagtgaaatgatgaaatgaaacgaaatgttgagatgaaatgatgaaatgaaatgaaagaatgaaatgaaatgataaaatgatgagatgaaatgatgaaatgaaaggatgaaatgaaatgataaaacgaggaaatgagatgaaatgatgaaatgaaaggatgaaatcaaatgatgaaatgaggaaatgaaatgaaacgaggaaatgaaatgaaataatgaaatgaaatgatgaaatagatgaaccaaaaatacttattcattttttttctttgcatccttctaagagtattttagtgaggttaatttctaaaaataaattgctattcaatgactatacagttggcctttgcaccacaggggtttgaactgtgcacgtccacttagcaaaaccaacaattctacatccttctccacaccctgcccatgaaaaggatgaggatgaagacctgtttgatcatctacttccatttaataactagtaaatatattttccttatgattttcttttttcttttctctggcatgtttgttaagaatacagtatataagacatataacatattaaatatgtgttaattgactgtgttatttgtaaggcttacagtaggctattagtagttaagttttgggggagtcaaagttatagtggactttctactgtgcaggggggccagcaccccaacctccatgttgcttaagggtcaactgtacatgttatttcctttcctgtaagagaaaaatgatgagaaggtcttttctccaataagtgtattcaaaatgtagcagatttgaaatgtgttggcgccaccattttgcgtctcactttgaaaacttattatttaaaatcatactaaagcctacctaacttttccaaccttagaaaaaatgttacaaagaaaaggggtgaaaccatgctagtttgccctgaaatttgaaattatcttttaaaaatatatttttacattaattacttccaaaatagagatcagttgcatacaaatggcaggtcaccctaatccaccctatgactgcacttagatccatgaggaattgtgccatctagaaagggcagagaagaggaatagagtgctctgcgtcttgaaatataaacatgcgcatagccacatgcttagattctgttgtcactgtgtacttactgctaggaagagggcatgtttgtgtatttttatgctaattattatccaagttgttaatgatttgcgctttcagaaccatataaagatttttttcctttcagatataaactatcttgcattgttcttctgatcatatgagggataaatttgcctaaatattcttcagaccataatagtatgtccatataaatgccagtagcaagagtagaatcaaccacaactgcctttgtaattatttaaagcatgtctgcctataagtaattggcattttatataatcaagaatctttgatataataatctctcaactatttgaaacatggctcacatgtattaattttttatgcaaatatatatataatatcagtgtatatgaaactaaattttggactttagaacagcttcttagaatcctgacttaaatgtctacagtaatagttggcttacaaaaatttagcacactgtcactatgatgaaaaaaattactataaatttattttaaaaattgttccaccctaacatttagaatattctcacatttgtggttagatgtgattgttcttagaatttagataaaaaatgttccagaaagtttgaagagaagcactttagtcaatttttagttgttgaagcatgaagaaatggcatttcattgacattttaaaaattattcagattccctctttgaattcaagtgtttcaaagatatcttattttaaaataccaaaataggaatagaatatgaagggctggttatgagtaatatgatacacttttatgagaggatgagattacaataacaatacctcctctcatagaatagccagcaagtctccactaaataagagtgccttgattttatagatgtttaatcatggatattgagttaatgtgaaccatttgtagacacgggagtttattaaagaattatataatatctttcaagtatttagaatagtgttgaaattaagcctgcatccccatgattttcagcggtgctgatgcctaataaactcaaccccttgcatgccaaaattggcttaaagcccatctgttacccaagctacacttcaagcatcaaggttcaaaaatgtgattttaaatatgcaagagtttgaggaattcactactcacactttcttgaacagtctatccaagtgcatcaagcaaaacgtaagtaaagaaattttgaccaaaggattgatagtaatgttgaatacatttaatagtagatctaagattaaaaggtgaaattgagggtgagaagagtgtatgaatgctttgtgttctgacaaagagaatgtagcacccaggtcctacctgcttggatgcattgccagtgcccacggtaggccattttatccaggtttttaggttttgatttgttttgttttgttttgtttttttcttttcaggatagttagtccaagaccaataactccataactggtagatttggaagactttaatagtgcttaacattttgtacatagctttataacagttttctttttctttttttctgagagattcttttcaatataccccatcatggttgaactcaaaaatcattgcttatttaaaatctacaactgctgacgttttgtaacgttcgcattccaggtaattggttttttgtgcattttctgtatttttctccatcagtctacctagatatttgttagatttaatattttaatatttttctgaaaaagtgagcttttgcctttttaaatatatacccagttgctttaattttgctttttcgtgtactatttcctcgttttttgttttttgttttttgtttttttttgacaagaagtcttgctctgtcgcccaagctggagtgcagtcacgtgatctctacttactgcaacttccacccccacgttcaagcaattctctcacctcagcctcccgagtagctgggattacagatgcatgccaccatgccaggctaatttttgtatatttagtagagagtgggtttcaccatgttataccaggctggtctcgaactcctgacctcaggtgatccacctgcctcagcctcccaaagtgctgggattacaggcatgaacaatggcgcctggctatctccttcattctttatgtttattttactggttttatctctctctctctcactgtttctctccttctcacattcactttgcagttgtcaaatagcccaggtgatgttacagatttactccttataaaaggaggcattacacattacacatgcatcttagtggccttacaaaagtgtttggtttatttgtattgactattcacctttaaaatatttcaatattcattaaaatagcttccaaccaatattattagacttatgtttctagctttcatttttgtattgatatctgccttcattgctgtttgtttaggaaatatattctgtgtcacgttatttccgtgaaaattgtttgaatttgtggcatggtctagaaaatgttaatttttgtaagtattctgtatgaacatgaaaataacatgaattataatattcatgttccttatataatatttgccctttttaaaatccactagcttcttttaaaacttactcttttaattttttcttttatctattactcaaagatgtgtgtttgaaatgtctataatatttgggggcttatccatttctacttactttctgatatttttgctttatataatttgactctctctctaaatacctgtgtgtctatgtgtgtgtgagagagtgtgtggtttgtgtgtatacatatatgtatgtatcaggctaatgcacatttaagtcatcacatcttcttaataacttaaaacttttatcacactggttagacttattttaataaatgtttctaacattctattttgtctacatagcaactttttaaaagattatattcatgtagtatgtttgtatgtatatcatatatacacagtatctgtattgtttgaacttcaaagtttctgtaaatttatatattagttgcctctcttgtaactatgatagagacggatgttttaaattttgccaatctttgtattttaacaaaaacgttgtctacttaggtttaagttaatctttgatcatttacacttaattttgtattattaatttgttgtgtatatatatatataatgtctcattttctcctatcagtttctgtcttcttgttttaaaattatgacttttatttttattgttttcatagacgcaacagagaaatgcataatgtccagtcaatttattaaagttccaaagtcggtcgcgtgcggtggctcacgcctgtaatctcaacacttcgggaggccgaggcgtgtggatcacgaggtcaggagttggagactagcctgaccaacatggtgaaaccccgtctctactaaaaatacaaaaattagccaggcatggttgcacgcggctgtaatccccgctactcaggaggctgaggcaggagaattgcttgaaccagggacgcagaggttgcagtgagcagagatggcgccaccacactccagcctgggagaaagagtgagactgcttctcaaaaaaagaaaaagttgcaaagtcatacctttctgctcttgtcaggcaattaaggggtttttgaatacttcagccctaacaatttgcttcctaacatacatattgcagtgcttatctaattttaaatatctttttgtttcaacacctaattttttatttagatctatctgtatgtttacaatatattttgctctgtgttcattctttgatttcagaacttcaatctttctgaagcatgttttcagagtttctttttagtttcattagtggaattctgctggtggcgttttgttttttgtctctaaatatgttatttagccataggttgatgaatatttttcttggttgagaatttcagaatggcattattattcttaacaaataatattgtttattttacctttcatgctttcagatttcaatatgattaaaggtaatttgatttttctagtgctcattgaaatatttttcccttcctgattgtttactatttctctacgagatatgtagatgtaggtttatctccattgtagcttgcttagcatgcatagaatttttgaatacacggattagtgtcttacaaaagtctagagaaatttcagccaaaataccatcacatattgtcccttcccggttcccttcttctatgagaacactcactaaacacatgctacactttctcactgtatcttccatgtctcttcatgattctgtccacattgtgcatttttaaaaattttctgtaatgcattctgaaatatttatgaactctcaccatggccatgtctaatctgatgagttcatttttgagtttttaatttaaaatactatatacaaactacttttcaaatttgcaacatcaattttttagtctcctaaaaatatattcattttttaaaaaattttttgaaagcaaatgtgctttataatctaacagtgatatttctactaatgaacctttgtggatctgtttgtactctttttctattttcctttcaaatggtggaatatcatttccttgtgtacttagatgcctttgaatgacaaagatttatttttctctgaaaattattattgtgcacttttgcatattagtaagaagaaaatttgccaaagagaatttgaattttttgtgagtctactaaaggcaccaccattctgggaccacattatattaattcttggcctaaaggtgtttggacgtatgtttggacagcacatttaaacaatttttaaattaattgctgtaaatcattaatgattgagtttctttaaatctgtccaatctcaagtcatttttatttgccatttccagggaatgtgaaatcggactaatttacctctgattcttctttatactgaggatgtaaattttggtcctagctttagggaggagctcctgtgtgatgccctatcttgggaaaaactatgtatttctttactgtcctatgtgatgtatgacagtaggaatctgcactcattcattttgctacatgtccctagggcaaaatcagtttcagtgtttaggtgtattttgtctgctccctgcattcccatggttttgaccttatattttactttttttttttgtgaacatatcactgcttcaactttttccagtaatataatcaattatactataagaaagagaaaaattttgataaaacacaaatttcatgttttcctactctaaatggcttttacgtaaaaatacaggtaaaatttatttgtgcttttttgctatttctgttttgctattctctgtttgtctatgtcttcgccacatagacacaattagggaattttgtacactcttgtgccaactgctttgatagtaacaaaatgtatttctcgaactcctaggtataaaactcaagtatccacaatttaaatacttttttgctcacttctattatgtttccagtctcaatagaaatcgatgccaatccagaaatacaagcattattctaatacttctcacacattactgatatagattaaattttctagatctccttaaatactatcatttttcacttattgtatcttaactgttaagttcaacattttctataatattaatatatgtgaaaatttccttactttcttatttgtcccaggttcaatgttttgcagtctctacctcaccctgtgaagcataaacattgtacatgctgtacaaataatacatcgttcatgtacttagagattgcacaatttttatttggttgacaatagctaatgttttcttcttcattttctatttcctgatttttctttatttagtatatactacactatcataaaaataaggacgttttacaaactaaagcaatagcaaccctaggaataaaatgcacaaataaaatatataaacatacatttagatgtaccacgtaaccttgtaatttatttagacatttaattttagtaaaattttaattaaagtctgtgtattatgtgtcatcgtcttagtattttttatataacaaattttgtaaatcaaaaagtctcaatgtcattataaactatcttggcagaggatgatctcaaaggaataatttctctcccaaattacgccaatcagaatttcagtctaccataattcttttaatcagtttcagaggaataataaatttcaaaattgttcaaggtacttcttttatttcaagtaccttttgacttgtaaattctacaggtgtaaaactgtagacagactgatacaaacatattctaattcactcaaaattatatggacctattttaaaatctagattttaaaatgtcgtgtcaacatacacatgttctccttgtgaaataattgctttttattctctggatagaataatttaatctttaaacaattcactgttagaaatgaaatattacataaggatatgcttataaaaataattcccaactagcttttcaattcagaaatatatgtgaaaaatcgtcaaacatctaatggatttcaaggagaaatgggttagtaatttattccatatgtctcaatttttcctagactcaaggcttcctttaaaataattgtaggcatttaagaaaccatgtaaactaagaagaaattgtgacactgccgcttaggctttttaaatctttggacatgattcaatatattttttaaattgtatcttaattagacatggtgagttcaccatcttcctgtcagtatagcatccaagctgattatgatagattagaagttcaactatcaactgtgttctgagagtctaaaaaaataaatgaacatatttgtttgggtattcttaaagcaggagtgaggacacagtgaaagtgagacaaggaaaagagaacaaaataaaacaggaaagatagaaaagccaataacacacgtgttaagaggtaagttcctgtgttagatatctgggcttaattgtatgggaagctatgtgaagcatgcctcagaattacatcactgaatccagggagattcttcttatttaccctcaccttttcttcacacttcatgcccagtaacaagctcccgtgctgctagagaaagtcctcagctagaaactggtgcaaattctggagatgagaccttgtagagtgttaagaatggttttcttcccagcagctacaggtaaggaataggggctgggctattaatacatctgctacaaaccaataaagcccttatgctccttttggtgatcgacaatgtatttaaaaatattagatgatcaagaagggctgcagaaaagaggaaacagaaacaaacagcacacctcttggtttatttttattcatttcatcagtttcaaggaaaatgtgttgggagttcctggcatagacaatgtcacaaagacatattttcaatagtagtgctatccctagggcagagaagacccagagaaagcccaagtggctgctggaacaaagtcagacaccgtgccacctgtccacactccttggctctgccatcatactgaagatcgctttaaaggactggcttccctccccccaaaattaaacgagcacagactgagaaactgaatgtaggagacagcagtggattatgctgttctcaggggtcacctcaggtttggaagcattctttcaaattaacccatctcaggccatctgcagagaagaaaggtggtacctaactttttttcttgtcagcatttggtaggggtgttttattgaccaaatatgttcccacaacttagttttttgtgactaactaaatatggtagatttttaaattttatcatcaaaatctatagaccatttttgattaaaatagacttcatatctatgtcctgcttttcttcttcttattaattacattgctgtataaaggaacaagacttcagaatcaagaatatcttgtctcttggcattgaatttatacaaggtgctctttctttaatgctgtctcaaaggacatatttttactcattaaaaaggaagatcggaatctagttgtatgcactgctccaacatattaataattaaaattaggaggtaaatgtggtcaaagctatagaaagactgagatgtcatttatattgattactgtatagcactctacaaacagaaattgttaaataatagtttatataaatattttgtagcatttcaaatatttgagtgcttgaagtttctcctcttatatagttcaaattatcaatttaaagacttactccgctagttaatatgtttttagtctcgtttgagtgattatataaaagcaattttcagttaaatgtgttccgcttacataaaacattacaaattattgaggatttaattattcatgttcctgtaatgtctttagaagattttcttattattacctatcaatatatgtatgctttgtcaaagaaaaatcaaacatatatatcattgaaattgaaactttttaaaagtacttattaactctattgaaaaaccacatccataggaacaattacaatataatattgtgaacatgtaaacatataccctatgtctattttatgtataagcatatatgattaaaaatatagttaagaatttttaaacctagtattataaagtaaaaattagttaacttctgatgattatttgttaattaagataaaattattttgatttgtgtgattttaaataaagaaaaatattaaattacatgacaaaaattatttagaagtgtttatgatttttacattggttttatcactttattccactactttattttaagatgacctgccttgtttaaaacactgtattcatcttaattaaattaaattccatttataaaaaaattaacaaatgatttgctctattgtacagtgcggttataaactgagtcagtctctcaagatttgatccccattatcatcatgtgtggccctatttgttttataaatgtattgtctttttccttgcctgtcacatctctattgctctttcatttttctctttgtcccttatagggagcattgcctatctctagattaagcaaaagttgcatcgtaaaaaagcacaataacctgctcaatctttctcatacagagaaatgtttgtaaagtaattaaagtgtagatgatgatacaaaaagcttgattaaattagatgccagagtacccttgtgattcagaatatgaaaggtatttaatttccttgaaatcattaattgctgagtgacattaattaatgccaatattccagaagttgttctagttagtgaaatgtatgcaacatgcaaaagatttagaactctgaagggcaacattattctataattaagaattaagaattaattcacattaattattggggagaaataattattaaaaattaatgactgagaaaatgtttttattttttatttagaaaattattttgtgcatgagcattaccgcaagttttgcaagaaacataaatttaaagaaacaattatgtgcacaagatgaatttaataacatcttgatattttccacgattacagttttatttggtaaatatttaaatgcacatcatctacagataataaatgaatcttggaaatcttgtaggtaagggtaaatattaggatgcatccagttacatttacacacacatacagttacatttacacacacatacatgcatacagactgatacccgtgtgtatatatatatatgaatttactaattgattttaactaatatttatgagagccagttggattgatatatattgttgaacctgaaaaatattatatatgtgtttaaaatacacacagaaataaatagtaattgcactaggcatttgaaactgtactaaaatataagctgtgaatattttgtgatcattacaaattcttacactgaatatttttatttttacaatattaatatgtttgatacctgtgtacattttttacaatgtgttattttattttttgtcatacattcatgtcatgcataataacatttctgtcaaagatggattacatatacaaaagtggtcccatgagattataatacatatttacatacttttctacgtttaagtatgtgtagatacataacctcttaccactgtgttcttattgcctgcagtattcagtacagtaatgtagtacacaggtttgtagcctgggagagagaggatctaccatataacctagacgtggtaggctgtacaatctagatgtttgtaatattctctgtgatgtttgcaaaatgatgaaattgcctctggatacatctgttagaacgtatccctatcattcagtgatgtgtgactgtactaaaatgctcaatgtaagtttcaatgccctccataaaattgttgtactgtgaaatacaaatctctcacccatggcctgaatatgtttgcaaactaagcagatcatgggaagaagaatgtgctggcatcgctgggatgattttctcacactacatgaataatatctacagacttcgtgaatatgagccacttgcatagagttaaagtaggcatctctttgctgggaaatttatcaaatgggagtatgaagtgtttttaaaagatacttgtttgtttgtagctggtaggtctacagtggctcatggcaatggttgaggttgctaagatttggtggaagaaggcaaaatgaaatggccacttatatggtatatggtatatggatcacttgtttctgttgagttacagactcagctggctatttctcccaatgttagttatttggagaaaaaaatgtgatggtaattttggggtaacaaatacaatatttgatgaaagcaaatttattgagggttagacaaactacaagatactttaggctgcaaagtcaacacgagacttctggcccaaattgtgcagagtttgcgtccagctgcaaagttcaaaggaagaggccatataagatgattctcacttctgacaccaactgccagttcagggttttccccctgaacaccctcagtttcaagaatttactagaaagactcaccgaactcattgaatgccattgtactcatggtttataatagagaaaggtagaaattaggaccaattgaagagacatatcatataaggtggaatctaggagattttgaatgttaagtttccattgtcttcaggacatattacctgtcattgttgtacagcaataaacatggagtactaccaacctggggagctcacctgatgctaaaaagacactattttgaaaatgaaaagacaaatgaaaggatgagataagatgaccttccacattaaggcactggaaataatagcaaactaaacctaaagcaagcagaaggaagaaaataaaaatttgagaaattaataatttataataataatatttgttagtattgaataattgatattaattcttgactagcttttttaaaaaagagaaatattcacttcccaatttattctgtggggccagtgttaccttgatacaaaaattagtccaaatagcatagaaaaataaatgcaaaattccttaaaaaatactaacaaatcggatctagcaacatataaaagaattatacactatgacaaagttaaatttatacaggtaatcccaggttggtttaacagcccaaaatccattaaggtaatacatcttatccatagaataagaaacgagaattgcatgatcatctcgatagatttggaaaagacatttaacagaatccaaattctttaatgattaaaaataaaaataaaaactcaatgaaccaggaatagagaactttctacaccagatacatggcacctgtgaaaagccaacagcaagcatgcaacttaatggtaaaggatgctttcctgctatggtcagagataagaataggatatatactttgacctcttctagtcaacactgtactaaagattgtatgcagggcaaatcagcaactaaaaaaataagagtcatccatattgaacaggaagaaataaaactttatttgaaaataacattcttgtatatagaaaattttaaggaatccactgaacgatagaactagtaaattatttcagcaatattacagcatacaagataaatttacaaaaatcaattgcggacatctacaatgaaaaccccaaaatgaaattaagaaaacacttcaatttaaaatagcatcaaaaaaagaaataataattaatttggaaaatgtgatacaagagtttactctgaaaattaaaaattattgtttagagaatatctaaataattagcaaacatctaacagccatgaattggaagatttaatattgtagtactttacaatttaaactacagatttgatgaaatccctgcaagtatcccaacagacttctgtctagaaactgacaagctgattctaaaatacacatggacttgtaaaggactcaaaatagccaaaataatcttgaaaaaagaaaacatattaggataattcacacccccatgatccaaaccttactgaaaagtatcagtaatcaagacaacccaatactgatgaaggaaaaatatacacattgatggaagagaattgagagtccatatataaaactatgtgtctatagtcaatggattcttacagtggtgccatgtgcaattcaatgaggaagagacagtctttgaacaaactgggtcaacaacgtacacgtggatcaccacttgcaaaataataaattcgaacccttaccccaaagcatacaaaaatattaactcaaatgaattaaagacacacatgcgagagctagaataaagcatatgggaaaatcttcaggattttggatctagcaaagaaatagctgtaacgccgaaaacatgagcaacaaaataaaaattagatatttaaaatttcttaaaaattaaagacattggtgtttcaaaggacaaccaagcaagtcaaaaggcagctcaaaaattgtgagaagatatttgaaaaacacgtatctatatgtctgtgtatatatatatatatatatatatatatatatatcttgaatatagaaaaattgcttcaactcagtaacaaatatcccaactcaaaactgataaatgagaggaatagatgtgtttcccaagaagatacacgaacggtcaataatcccataaaaagatactcaatagcatcactcatcaggcaactacaaatcaaaaccacagttagatactctatggctagaactggccactttggaaaataatttgatggcttctaaatatattaaacatagagttgtcatatgacccagaaatttattcctaggtatacacccagattattggaaagaggtgttcaaacacaaattgtacacaagtatttttagcagcagtattgaaaatagccaaaggctgaacacaactcaaatgtcaataaaaatattattggataaacaaaatgttttatccatgaaattgaatgttatacagttataaaaagaagtaaagtaccaatacgtacatgaaccttgatagcattatgccaactgaaagaagccaggcagaaaaggccacctattgtatgattctatttagatgaaaacagaataggaaaatctacagagacagaaaacagatttgtggttgcttaggattgagtaggggatgggtgcataggaggttaacagctagagaaggtggggtttctttttgaagtgatgaaaatgctctaaaattcattgtgatgatggctccacttatctatgcatatactaaaagccactgacttgtagatattaatgtgtgcactctacactatgtaaattatatctcaataaatcctttcaaaaatatacagaagagtaaggggttttggaatgttgctacggggaggcagtttgaaatactgaataggcctcatcgagaatgtgaagtttcagtaaagacttgaagttgaatgagctgatgaatggatatatggagggctatctttccaagccaagaaattaactagagtcttggtcataaggcagcagcctgttagcatgtccagaggacagtgaggtggccaggaccactggtaagatcaagggtgaagacataaaagaattttggcggttaacatgcggcagatcataatgggcttgcagaccattgtaagaattgttgtttttagtgtacatgacatggggagacaagtcattatcccattatcaatattttaataaattggatccatgaaccaaatccaatgagattaaatcaattaataataatatgcaaatttgtattaaaattataagaattactttcacatttgagaacaggagagtcatgattgtttatcagcaataataaacattattaattttaattgtgatcagctaattgagattagttgcaatatatcatgctttataatgtgactgtcaaaaggaaaatatgattgtaatcttacattacatctatcaatgtctttgattcataagactatagagtaagcccctacttttcaaagccaacttatgaggcagtgacatcttatgcaagtttgctgctttctgccacagtgatcctttgtcagctggcacaaattgtttcacaaacgcccctaggtctaaaaatagtttggatcgcaatgatcacagaaacaccttcatcccttcagaaatacctatcaattacttccaatacagaatgaaaaattgacaaaggaaatatgtggattgtaaaaacaccagttagcttgcatctacatgaaagaaaaatgccatttttattatattagatcactgttttacatgagttttggcacagcacaatgttgaaccaagggcaaagagagatgaattaatgaagtcttaagatatcaagaatttgaaagaaaaggcaggtcatctttgaaggttagtgacatagcattcatcttctgttgtcaccttttccgtcattccctgtatgcctgagggacaggtttcactcaagttcagagaacagcatgaaaaattagataccaattaatctttatgaagtgagctgcatttctagccagactgagcttgcgttttagcaggaagcatttttgggaaatgtttatgttagagtttgcccttcttgacaaggtgatacataaatgtctactttatagacatgaattaagatgggaagatatttgggggaatcatttactcaaacgctaaataataaaggtacacaaagggcaaattatactagatttctttcccacttgttttctatgtctcatgcaattcaccttgattcacttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttaaattcagtttaaaaaagagaatttattgaacatctaacacatacataaaaggcagtaaagacaaatcagaagagggcaggatattgaagtatacagacttcaatgctgagttttatatcttagaaagttactccaccttacagaggctcaatttcccctgatttaggaaggcgatgctaatgggtattgcataggtgcaagcataaaagtgttgtatttaagagaatcccacaagcttggtataaggcagaaaataaatagatgtgacatgaataagtagtttattacatttgtatgctacctgcggactagaggaagcaagaaacacagccactatgcttgattagcattacagagatggtacaatgatggttgccagaagctgggggtaggaagaaatggggaagtattgtttaatgggtatagagtttcagttttacaagatgaaatgaattatggagatggatagtagggacggctgcacaatgttatgactatgtttagtaccactgaactgtacacttaaagtggttaacagggtacattttatgttatgtgtattttaccacaataaaaaaataaaataccttaggaacattttcatgaaaaatcccacataaaattcattttaatgcacgtgtttatgcatagctttctatttttctcttttctctttatattccaaattctaatcagagaagggaaacccctctgtacctccaggatattcagtaaagaccactggaggttcatgccctagtgacagtgctcatttagctccaaattacagattgctctaaacaaactccacaaagtttaaagagaagatttaaaacaacaacagacaaatactcatcctgaatttactgaactgcctgccataacattgttcaaaggtagtcaataaaatctagatattcaatagcataaaatcaaaataccaaaaaaaaactctgacatgcaaagaagccgtaagatatatataattaagatatacattaacaggataaaaataagtcatttataaatgacagaaaagaaggaaatttcaaggtccttaaagtaaatatattttataaatacatatagataaatacatacatatgtcaaggtacttaaatgaaaattgaacataggagaaaaatagaagttataaaatgaaaaatgtgacatgtatagatgaaaaataaatatttgaaataaaaattccatgagatagaataagtcatggattttaccctaacatcagaaaatttatagaaaaaaatagaagctttacaaactaaaggacaaagggtaaactaaaataagaaagccagaaactcaccgatacatcagacaatatgcagcagtgtaacatacatgtaattaatatctcaaagaggatgggtgggggaattataggtgaataaagaatggtacactcattcctgagggcaccgaggagggaggatagctttagatttctaagggagggtattatccattcatgaaggtccaacccatgaccaaacacctcccagtaagccccacctgcaacattggggatcaaattttaacatgagattggaaggggcaagcattcaaaccatagcaagagttaaatttcctttttaaaaaaatcactgatatgattccatttcaccatagataaaagctagtatttcagcctaccatcgagtgtgcttatagctcaccaaatgggcactctgtctcgggaatacagatttgcctagaggtatcctagtgcagtcaaagaaagagcaatgagggatagaaaaggttagtgatggagacaccagcgctgcattttgcaacaaacaatgtaaaaattttatggattggttctgctaacttactacagtttactttcctctcaggtgggagaattgttgcgttttttctcaagatagaaaagcaattcagataatctgaaatctccacaagaaggataagaagcatagcagaaattattctaggcaggaagtcaatcctttcaactgtctgtgctccatagaaacaattgtctgcactgggagtcatatgaggtacagacaacagccagacctctgatcctctcattagtgatttcagaagaaattaccagtcaactgagtaattcactgagtaaagtaaacctttggcactgaaagaggttagacggataactatttgtatcaccatattcatgaagctggaatattttccattactggtatcacatccgaatggaagatgttaaaaggtctctcatcttgtaagatggatatgaaagaacattttctgagaaatgaaattattaatacaccagcgaggtggatggaagagaaaaaaaagaataatcagcttgagttcttctccttgataagacaactcactaaaaacataaagagaaaaatacaagtttaaaataattaaccagaagacgactctagagtttttaaattgcttataagattttaatttgctccaagttgaaaataattatattgcttgtgttttaaggcacataatgagcaagtatatcacacatgatagtttcagcagtaaaatgttatccgttaacagctggaactcataaaagcatagcacaatgtgaagacggaatttgctaaaataaaccatctgctgaaaactactattctgcaaatttaaaaataaagtttaaatgttatttgtcttatttaataggtctgtgaaaaaaatgcgctctttgaaaagtagctgctaccttaattaattctttatgttagacggctggttacagtaatgcacagtaaggtgctacatagatatattgctaaattttctgcatgtgctatgtatttggcttaaatgatttgaaattttatagataaaataacaaatgtatatttaaatgttttgacacaaattgcaaatatacctttaaaaagcgtcttacactctaaatattatttgtcacctatatatttgtcttttctctataggaaagtttaaatttttcccttgaagctttaattatttgagtctataaaacaaactgataatgtacaaattaacaggaaaaaaaggtttacacatatgtgcacaagtatgcacttggagtttacataatatatataaacatacctatacaaatatttgtatattataaatagatatacaaatatatactatatatataaaaaatccaggaaaggcaaggtagtcaagacgcctatgctgtcttgaagttacagaaaacacagagctgtaggttggtaaatcaggctttgtggaagacaggtgacgaaaaggaagaaagaggagcctggcagcagaggtggtcttgttacatggatgaaagctcacagggagcagccctcctcttgggaagtatagataggaaatggtttttagaaatgtaaacgtgccaggttcagttaatttttcctaaacccagacaagggagtatctcagggaaagcctgtctatatcaatgcagattttctctacaaatgcaaatctccccaactaacacagcttttcagctattcttgtagaagaagctacctccagtcttccgagtagccatcttgaaatatgtcaaaaagctgcccaggcacacgcctgtaatcccagcactttgggaggctgaagtgggtagatcacctgaagtcaggagttggagaccagcctgatcaacatggtgaaaccccgtctctactaaatacaaaaaattagccgagtgtggtggtgcatgcctgtaatctcagctacttgggaggctgagctaggagaattacttgaacctgggaggctgaggttgcagtgagccaagattgtggcattgcactctagcctgggcaataaaagcaaaactccatctcaaaaaaaaatgtattttagggtaatattttgagtatctttacctccatatgtacaataaatatgattgtgctttttaatcttttctgtggagaaaacacaggtgtgatttctagtgtagctgaacatcgtttatttgacaatattgcacttgtgtgtgggtgtgtgcgtgtgtagctactctttaattttgttctcacataatgattagatattaacaattaatacagtaaaatgtatgttttgcaatatttctccatgttatcatgctttaaattagtttaatcatgcccctataatgtgtacattttaacctttgactatagatctcaatcttactttggttcctgaatttgaatttatgctaataaagtcctacagctaaaaaagattatataaacttatctacatttttactagtattctggtgtcattttaaattatgtaatgaaatcaaattttaatttggattattgttatctgagttaaggatataaatttttaattttcttataaatattacataattatttctgaaccatatattgactaatcttccctttatatgatgtgcattataagagcttgggattttttcatttgcaaagatgaatgcttgagaagtagatatttaatcataacatttaaaaatctactggataacctagaattgaaaaatagcctataggttgaaatactcctgtagtgaagaaaggaaataactaatatacagtgataatataaatattataagtatttattttattatcgccctgaaatttgacaatacaaacatgtaatatctacttatcatccatatatcaggtcataaaaaatcaatacgttcttcaaaaatttagcataacagaaaatgcactctctttccttgatggaattaagttacaaataaaagtaaaaataagtagataagtagatggaagtagatgtttaaaaacaaagtatttgttttggataacataaaatctcaattgacaattccaatatttccagaactttgcctgtcaactggtggagagttttccccaggagacatttgtcaatgtctagggttattgtggggatgtcaagactggtggaggtgtgaaatttagaggtcaaacgaaacacctagtattgctagggcagcctcccacaacaaagaatcctctggtcctaaaggtaagtagcaccaaggttgagaaaccataatctagacagtaaacactacgtagctattccaagtgctcaggaaaacacatcagtgccctcgaggggaaaagtgtaaacattttaattgctgtacatggtgacacaaatccatgttgttaatctaagtggaaggggctgaagcacaaaacgtaattcaaagagtttacttgagccaaaatgaggacagctgcctggaagaaacagacgcaagtatccttggatatgaactccctttggagctttgcaacaagcagtttcttaaaggcaaaaacgagtccagaagtgggatgatgcaaagaggtttgtcagaaattctcattggcttatggaaataacatttattagtgactggctatacactgttacactattattgggtgtggattatagtgtctggtgtggcattattggttaatttatagctactgtggcaacagcaagcagcctagatgaacacacagctcaaagaggagcaggacagaactgctgtctcatttgaatatctctctgggcctgattatttaaaaggacttgcatttctcacatgaaagttattttcttttctcaatgtccataaatgagaataaatagatgtaaaatagatcttttcgaggatgaagtaaatggaatgaaaaacaaaacccaagctgaccagaaatcatagagggaaagaaaaggttataaatatatggatttttcaaagtgcttttaagctatcaggaatcagttaaatgttaggggattttgtctgagaatgggctaaaggagaatgtcccttttgccttctgaagtttccctgaaaatcactaataggaggcagataaatagtagaaaaggcatacaggtttctgcaatgtgtgtacactggagcccttagaacaaagatccagacacacgatgcgtgcagaagcttatctaccacatgaagtttacagaaagaatggggtcttggttcacagggggaaaaaaaaaggttatgagagaaaacgaccctggctagcaacagtggacttattacataggtggaacctcactgggagcagtcctcagagagaatagacagaaaatgtttctttcagacctttggagacctcagactctcagttaacctttcctatatccagacaagggagcagacctcagagaaagccttgctgcatcaaggcagattctctaccgatgcaaatctccccaagaaagatttgcagctaagtttgcgtttccagcccttctcaatagccattttgaaatatatgaaggaaatatatttaggggtaaaatatattagtttccttcatacagctataaaacatacaggaataatttttgtcaatctctactacaaatccaatatagcagtaattataaaacccaacagatattgaagaaaaaacatgtagagtacatcaattacaaatgttgatactaaaatgccaaataaaataaaaataatatctaacaatgtttgaaacagtaagacaagaaattggcaaaaaaaataaaacaaatatccaccttggggatggaagtgtgtttccaaatttggtaatccaataatattaataatcatattgattagcccaaattaaaaataaataggggattctcagtacatgctaaaatatatttgttaaaaggcaatattcatgtctttaaagattttaaatgctataaagagtctgatattctatatgcaaacatgtgtatgtccattagaagaagagaggcctgattttcatatgttactacatagagatagagaagtgggtagattaatttgcatatgcatagagaaagcataaaatagaaatttactatcatattaaaggaactttaattcaacaataaaataattcaaaggtaaaattttaaatatttttaacaggtacattattaatattagataatatttataataattgtgaaaatattcaatgctaaaataagatagaatgtctaaacatcagcactaaaactagtataaatatttgcttgtttatacaaggaaaattcaagctcgacctaaaattatataagaaataaaagaaaaattttaagggagatctttaataacataaacatatatatacacacacacacacacatataacatgtatatatgttatatgggatatagatttaacatgttatatctatatttgtatctataactacagctgtacgtatctacatttctatatatttactcagtgatataaatatagactggaataaatatagagacacatatgattcttggataaaaaggatttaggatcataaagacaaattctttccaaattcacttatgaattcacaacaatatacagtttcattagtataatttaaaatttttaaataaattccaagattcatttaaaggaatataaatgtatacaagcagtcaagaaagaagcaacagtgcactaaactaacttgctattaaaatacatttttaaacttagtaactgaaactgagtagtactgatttggagtactggaatttaggtatatggaatctcaaaagcacagagctcaaagcagacccctgtatgcacgagagcttaggatgtgctttagaaggcattaccaaaccacgggcaaagttacttcagtgtcttagtcttactaggtttgaaaagccagagaaaagactcaaggccaccatataagagcaaaacaaaaggacagggaaagaacgtgaagatactgaaacattttacataaagttgtataaaacaccctttaaagaaaatataaagtttaggatatacatcaaaatcagcagagccactaaataaataaataggcattgtaaaatagcaagagaaaatttaaatggatttctaaaaaatattgacacctatgatttttaaaatatgtttaagaaatcccgtatttcacagggcagcctttcacaacacagatatgttaggacataaaggtccttctgtttttaatttattagtgtttatagggttacaaatgtcttctacccttgtcttttgtctgatggtgcaaaaaattttcataagcatgtatttctgaatgcctgatggattgacatataaaatatgctgctagtattaaaatatgtgacggaaaacgcatccaatcttctcactgtttacataaattctaggtttctatttacctcaagcacgtatggagcgaattcttaccttttaatattgccatggcattcacattgaacataagttgaactctctcatatggtagctgggttcagattctcttgacaatttccagttctaaccctcacagttcctcagtgtggctggcccagatattgaccctacacagttgcctcctcctggtgactaccagctatggaaccgttggatacaacctacctgactcaccccacagacctcacagtgcacatggacagcccccacacgccagagtgacctgctcggttgcagcgggagtcaagaaatgtgcctgctggcactcaccccaccgactagtgccccgtggaaaacttatttgggtaatgttctgggcccaataaaggctggagtcccacagaccccttttctctctcctgctccccactcatcttccccattttgttcagccctatgaggtgtgctactgtattagtccgttttcacaccgccggtaaagacatgcccaagactgggtaatttccagaagaaagaggtttaatagatgcacagttccacatggctgggtaggcctcacaatcatggtgcaaggtgaaaggcacgtctcacatggcagcagacaagagagcttgtgcagggaaactcccctttataaaaccatcagatattgtgagacttattcactatcagaagaacagcatgggaaagacctgcccccatgattcaattacctcccacctgttccctcccacaacatgtgggaattcaaaatgagatttggctggggacacagctaaaccctcttctcagctaccctcttctctctggatctgtgagtaataaacttacttctgtgatttcccatgtttggttctgtggcctccatgggtctgagctgatctacactggaacctaactctcctcctggccagggtctctgagagtggctcttgtcagaaatacacaggacacaggtcaggcaacattcaccaggcgtctcctagtctcaacagatgttctgtgagagggaggcctggtcgtgggatgcacacctggccactgctggggtaaggaagtgtactgtgaaaggcacatgttaagcatccacaaccccctgaccagaaccccagaaaggcagggctccaattgacagtcactctccagagacaaacctcaagccctaactggaggaaaagaaaacaatgtaaaaagttgaatttatcttactatttcaatgatccagtaaagacattctatgcctgtacaccacatattttcttcgactgtggatttattttagatagaattttatgtctggcttttgctttagcctggtccctacctcaagcataaggtaaagattttccatgggttcttttctggtactactacctgccagggtggggtcatgtcctagtctatcttgagggaatccccctgttcattattgtcagagtgagaatgttaagtcttgatttccctggacaacttcactgcatgacttttaatatgattttttaatacaccctttactggacaataaattatatagttatctgagtaagagatatggtctggaaaaggcattgcctcattcagcttttctctttggtgaactcgcatatgttctcctcacccgccagtcacctctaaatcgtattgttccaagacaacaaacagaactcgagtctgtatctttcaccactggatttgtgtttgctccataaatcttcatgcttaatagggtttctgttagcattttctctatttattttcccataaaatatcacaggccttcttcatatggaattatgggtgatttccttcaatctgcatcatatcaagttgaggttcatgttgatgaaaagtaaaacatacgttgaaaatatcagtaatgatgttttcccctcctttttagcatctgtgcttgtgatacaagcacattttaatacaattgtagtctcatgctttgatcattcctatgatgaaaataacatttttagataaaatatctgagttttatgaggcctttagtatgtgatgtgatagaatatcagaagaccatacttttctctagttttccatgcaattctaccattgtttcatctttactcctacgagagtaattttccaaaatagatatcttgtcactcttcctgttgttatcagtaaataagtgaaatgaaaagttagattatataatttatgtagaaaaagaaagtagaattgaatctatattcattaatgagactaaccagtcaatttcacagataggcattttacattttgaagatcatatggacccattgtcagaaatattattatttatgtctatatggacatcacctgtgcatatttacatagaaatcaatgagagctgattttaatttttattatatgtattttttgagatagggtcttgctttgttgcccaggctggagtgcagtggtgcaatcactgctcactgcagcctcagcctcccaagctcaagcgatccttccaccttggcctcccaaatagctaggacaacaggtgcacatcaccatgcctacttttttttttaaacttttggtagagactgggtcttgctatgttgcccaggttgcttttgaactcctgggctcaaggaatcctctcatttcagcctcttcaactgctggtattacaagcatgaaccaccatatgggctggaagctgatttttaaaatactgagataatatagatgacagcacctgaaaaatagacaacaccaatctttatgttaaaaggtgtgagggtatcaatattgttgtggctattggggaggaaaacattagtaaaaccagtaagttaaagctcttgctttaaactttggctttaatttaacaaatgttctacggagtgacagtatgtatgtaaccatgctatgcccattcacagatgcagtagagggaagaatttctcaaagacaactgttctaagactcaaattaaaccgtactgggtttgaaaagagaaagtccaggaactaccaaatattttagatatcagatacaagagaatgccaggtatgcgatgataatcagcaatggttgttcacacaatacatcaaatcagtatttgaattagcttttgaattacaaggacaaatggatcaactctagactctttagtagataaatcttattaggctgagatatgttttcccctggttttccacaaggagattacaaatttgcaaacctcagctgctctcattttatgctctcaccaagccaaaagctgaagttcatcaatcagtgtgtctaagtgttcactggttatataccattttgtagtttcagctctctttccagcttcctaaatcatcaccttcatttgatcttgtttttttacactatcacttctttattgaccatataaagaatataagtaagttcttattttgttattgttcattctagtctaatttcatcaaaatatcacaatgttttaatttcattttaatttcaaatattaaatgaaacctacatagaaatgtgtgtaagatttgcatttgcattactttggcatcaatttgctatcctccctcatgcacatagagatcatttccatgtacgtgatttcaaacatccaagtgcagtattaaaagcagttgtaaattatggttctcattttcatgatacaattacaatataaacttcctcttactgctgtaaccaattaccacaaacttcatatcttacaataaagtgaccgttaatcctacagttctgtagttcagaagccttaaatgaaactcacagggctaacatcaagttttgggctgggctgcagtctttctgagggctatgtggcagaatctattacttgatttttttcagcatccagaggccacctttattctttggaacatgacctcattcttatatcctatttttcttatttttttttttttgatatggagtctccttctgtcacccaggctggagtgcagtggcacgatctcagctcactgcaacctctgcctcccgggttcaagtgattcatctgcctcagtttcctgagtagcttggactacaggcacttgccaccatgcccagttaattttttgtatttttagtagggatggggtttcaccatgttagccaggatggtctcgatctcctgacctcgtgataaacccaccccagcctcccaaagtgctgggattaggcgtgagccatcgcgctgggtcctcattcttgtatcttaaaagtcagtgatgttgagtaatttctcatgccaccacctccaaggttgcctttcttctgccttcttctttcccttataaggaagtttgtcatttcattgatcccacccatttaagacaatctctctatcatttttccgcaaccttaatttcacttgaaatctaatttcacactgccgtgcaacctaacatatttgtatgttagactctgggaattaggacatgaaaattttggggaggccattcttttgcctacagcagacataatctatttacctgcagattaaagcattctttatttttctgtctccctctcttaatttttcttgaaataatatgaattgtagtaaagagaaagaaagaaaagaaaacaaagaaagaaaaagaaggaaggaaagaaggaaggaaggaaggaaagaagaaagaaaagaaggaggaaatgagggaaggaagggagggagggagggaggaagggagaaaggcaggaagggagaaaaaagaaagcatgaacacaagaaagaaggaaagaaagaatgaaagaaagagaaagaagagagaaacagagaaagaaagaaaggaggaagggaggaaggaaaggaggaagagagaatggtaaaagggaggaaggcaaagaaacaaagaaaataaagaagcgaaggaaggaaggaaaaagaggaaaggaagggagggaggaaggaagaaaaggagggcaggaggaagggagaaaaaaggatagaaagcaagaacgtgagaaagaaagaatacgagaaaagaaggaagaaaagggagggagaaagaagggagggaggagggaaggaagaataaggggaaagaaagaaagaaggaaagaaggaaggaaggagaaaaaagaaagaatagaaagaaaggaaagaaaaaagaaaaggaagaggaaaagaagaaaggaaggaagaaggcaagggaagggaagagaagagaagagaaaggaagatggaaagaaggaaggaataacgcaaatattagaaattctgggtttgttagagaatatgccatactgtttttttttttcacttgaaaggaaagagtatctgccattgaagatcggatgtcttgttggtgatattgcttttcttatcttccacatgattactgagtttgtgcctagtctttccattactaagacaaaagtgttgaagcctgcaaatataattttggatttttctagttcacctttgatttccttcatgttttacctcatgtatttggaggttctgttgttagctgcatatcctaattagtaggatgtttacatattcttgagaattgattattctattatctatcatctctcatctctgatactatttcttgttccgaactctgttgtgtctaatatcaatgtagtccttccacagccttattttactgtttccatgatatggctttctccatatcttgatgataacctatttatatctctatatatttggagcaagatataaaatttagacttggttttttaaagatttttcaagatggaattgttatttctttttgttctatttgacattctctgagtttcctatatttgaagtttgattttctgtcacttattttagaatatttttggcagttattttgaaaaatatttcttttgctccattatatttccctcttttctttttgggatttcaatcataactagagtaggtaatttcatctcagtcttatgcaggtactttttctcagggtctcaggaatgtagccttctcacacttctgttcttctcctggctgtgttggtgagctcagtgatattcctccttcaccttcaagagcagttttgttttgtttttcctgttttcatacttccagcatcaggagtattctaagtgtggcagtttttgttgccttcccctacatattaagtggaatatcttggtctatttggactcttataacaaaataacataaaccgcgtgactaaaaaacaacagatatttcttttttcacacttcttgaggctgtaagatctcaggtcaagatgctcacaaattcagtgttgatgagagcccatttcatgattcatagatggtgcgttctttctatgtcctcacatagtggaaggcacacaagaactccattgagcttcttttataaaggcactaatcccattcataagggctcggcccccaagacctggtcacctcccaagtgttctgctctccctgatctgtgtcatatacagactctcttagattccttaccaattgcttgagagatcgcagtgggtttgtggggaaaaagttttcaagatgatggatctttcccaacttctgcagctgtcagcagtctcccaatctcacaagccccactttgtctttagaaatttattgattattccagctttacttgtcatagtggcgtctatttgcatctgtcctatgtaagtgcatctgtcttctttctccttgcaggtgcttgttttccctcacattttgactcagttcttggcatcgtcgttgctataaaaataaaatcatgactttgaagttagtttggttctttcattgttgtcaggttaggaaccctattctatcccagatctccaaaacccagactttttggggggttgaaattttaggctttctctttgaattgtagttttatcttctttcagttaccatttgcattttcataatgattaatgagactaaggtttttttgcatagttgactgtacctttggatttttttcccaaatacctttttatttcttcttttctttatggttttagaaaatgtagtttatgtaattgcagcttgattttttactcagttaatggcatgcttaatggagagaaaaaatattaaatatatttccctttttaattactgtgcttttttcttttttaaggaaatgtttcattatgttcaatttcagtgttattctacttagctattccttaaatattatagtattttggatttcacatgtacatttataacatatcttgagtttattatgtatagagtaagactattttctcttttttgttttttaaggtaaaaatcacataatataaaattaataacagccattttaaagcatacagtgcacttgcttttagtatattcacaatgttccagggcaatttcatcatgtcccttgcaaaaacccattatgcataaagttgttacaccctattcttcttccctgagccctaatgaccactaatctgatttatatcccaattgatttgccagttcctgatgtttcatgtgaataaaatcaagtaatatttgtccttttgtgcacttaacataatgctttcaaatttcaccaatattataccatatataggtacttcattctttgttatagctgaaaagtgggtgtccatttatgagtcaacaagcatatggattgtttacactttttgactgtatgaatattactgctgtaaatattcatgcacgtttattttttgagcacctatgttttgtaagattaacagctgacttaagagaaacaatggaaggcaagaggcagtagaataatatattcaaaagatgcaaagaaaaaaaaactctcagtcacaaattccttatccagcaattatttttcataaatgaagataacacaaagacttacccagataaacagaaatactaactgaagttgttgctggcagacctaccatataaaaaaaaactctaaaacaaattcctaaggctaaaaggaagttacagaagacagtcacttgaatccacatttttaagaaagcactggtataggtaatattgacattataaaaggcagtaaaaatgcattttttctctttatcataaattgtttattaaataacatgtgtataatggccgggcacgatggctcacacctgtaatctcagcactttgggaggccaaggcaggcatattacgaggccaggagatcgagaccatcctggctaacacagtgaatccccgtttctactaaaaatacaaaaaatgagccgggcatgatggcgggtgcctgtagtcccagctactcgggaggctgaagcagaaaaatggcatgaagccgggagatggagcttgcagtgagcggagattgtgccactgcactccagccaaggtgacagagggagagtccatctcaatgataataataatatgtgcataatgtattgctgagtatttgacatgtagaaatgtaatacgtctataacatattttccagtaacatcaaaaaggaggtagttggaagaaaaatgtattgtgataaggtaataactctagatggtaaagtaataattactaaaatgtattgttggctttgtaactttaatagatgtaatgtgtaaagtgataatactttaaaatggaggaaataagagagatttatataagaatgatgtttctatgtattactaaaagtttactagtataaattagaagatgatttgaataattaattttccacatacctatatggtaaacttacaacaacaaaaattctcaaaaatatataataaaataattcattagtaatctaaagttccctattttagaaaatattctttcattgcaaaataaagcaataaagaaaaatatttgagaaatatataaaacaaatggtaaaatggcagacataaatagaattataccaattataatcttaaatgtgagcagattaaaatccattccagaggcagagattgtcagactggattaaaacaagtgatcccaatatacgctgagatgcaaggatactaatggattgaaagtaaaaagatgacaaaaaatatcatgcaaagagcaatcataaggacactgaactcattatactcataacacacaatatcgactattaaaaatgtgaataggattttaaaaatttatattgtagtaaaaagggggtcaacgctttaggaagacatagctattacaatcatgtatgcacagatatgagctaaattgtttcctctatatagatgctgaaattctaaccactgaatatgacctcattaggaaataggttctttgcagctgatcaagttaagatacaatcagatgagcctgaattcaatatgactgatgtccttattaaaagaagaaatttgagtagagggagacatacacacagggagagtaccatgtgattatgagggcagagattagccaaggaatgccaaagactgccactaaaccaccagaagcgagaaacaaggcagagaacaggctttctctcatagcccttgaagggaccatccctgctgacacctcaatctcagacttttagcttccaggactataagactataaatgtatgtagttcaaggcacccagtttgtgttacttggttatggcagccctagaaaactaatgcatgaactaatgacaaagcataataacatgaagcaaaaattcacaaaagaggagcatcagcaaaatggcagtggagacagctgcaatctttcatttccccacagaaacatcacacatctaagagaaactgtccgaaaaaagtttgccaaaactctggaaaatggtcaaaagattacaacaaccaagtgaaagcagactcaagaaaaagacaacttgaaaactttatgacatttttaacctgcctttgccccagcaaattggcagttttgaagtgtcagaggcccacgttcccagtgaggaagcctcgtccatggtccaaaggaacaggagaagatcttacccgcaaattattctgtgtctgttctgactagtctgggggatacctaaaggactcatgaaaggcttcttttttctgtgttgctagaatacagaacagataaggaatggacattattaagaaactctgcaaggagacctaacaaaccacagatgcttagggcaaaaattaaagtttacacatatagtagatcaccctcagcacagcaagaaaagttggagaagagtatttcaaaaagtaagacatacaaaatcattcacgtacgtgggacggtctagaaagtcacatgtattcataggttaagccacatgctgacaaatgtcataagaagaccctacacttttaccttggctgatcccttccctcagtgcaagctctgtgcaagagtcaacttgaacttcactcagtgcaagagtgaacacacactttgtcccggctttaaagaacccagcacaaagccagtctgcatggcctagagacatattttgctggacaatgattacttttttttctttttgtttttcttgtatttgcctgtttgattggttcctgacatacaagaaaatcactgtcaaaatattagcttaacatttgttaaggaaacaaaaagacttcggtgaccacaccttataaagcaaacagttttgtaaatcactttggaaaatttcactcaaaaaaaaaaaatccttaacaatataataaataaagaaaatttaaaaccacaaaacattactgtgtttgtagggggggtctgatttaccaagtaaccacatagtaattataattattagaatgtccagttttcaaaaaacgttacaaggcatacaaagaatgggaaagtgtggctcattcaaaggaacaaaacaaattgacagaaaatatccctaaggaaacccagacatcaaacttactagacaaagactttaaaacaactctcttcattatacttaaatgtcaaaaggaaaacataaacaaagaaataaaggaatcagaaaaaatattaaaaagtaggaatatcagcaaagagataacagaaattctggagtggaaaactataatgataaaaatttaaaaatcaccagagggatttaagagtatatttgcacacacagaagaagccatgaacttgaagagaagaaaatggaaaatactgactctgagaaacagaaagaataaaaaataaacaaggagcagagactaatgaatctgtgggacatcatcaaatagaccaaaattcatattctagaaggataaattatgttgttaaaaagtttaccattctttcttttcacctttcttccttcctccttccccctcctcctcttttacttttcttcctcttcctttctcttctttctctccttcattatcccttccactgtttctctttctctctttctcttttttcttttctttcaattttctcaattactaagagatgtttaagtacccttaccatattagtagatacggttatttctcactttagttctattttgagatttatagtcactctaagtaaagagataacccaaacataagcgtcacaaacaggctttcataccattcttaatttggtcctgtcattcttcattgctgtattaactttctgatgcttttaaggatgtttttataacaaattgtttagttttttccaatggaatgtttattctgaattatctaattcatattgtaagtatagagggagtttaatataaaattattaaactaatatttgtgaaagaatgtatttgtgcatttaacaaatatgttaatcctcagactgttattgggcagctgcgcatacaggaataaaaataacataatttttatgtgtacaatatttatggaatacgttactggaccaaataaataatttagttaataacatgacaaagaacagaaattgtatacactatagagcatagtaatggaataatgaatgattaaagttattaatattaggtagataatgaagggtatctttgagagcagaactcaaggaagcaagcaattcgccttatgaggaaagagttacctgtggataaaggagaaactgaaaaatttacaagtcaagactttttgagcaaaaacaaaaatatgactattagtcaccaattcagtacagtgaaaaaaaagttgaagagatatcttggaagtaaaccatgttgtggaagagcatgtagggttttgataatcatgggatgattctgaagtaattttaaatgcgataggaatatatgagataatttcaccagagaataacatgatagtgtttccatttcaaaggggtgtatctggtgcactgtgtagaataaataggttatgtgagcaaataaatggggacgctactctaatccagagaaaaaaggtagtgacttaggtgagaatgctgtcaggatgagtggtagtagtggtgagaagtcattaggccatggatgtatttcataggactggacaagagaactgcagctaaattggagtgtagggagtgaaatggagaactcaaagatgactctcagcactggaaggtgacagctgtcactgaagcatgctgatgcctcttattaagagagttagttgggaatggcaagatcaaaacttctcactttcaaatttatgaaaaatattgttttcagaacgaatgactttgggatcagaaagccaccattctaattgatggttccacaactacacgggctcacacgcccaagagcaaaagtaaatcatcacaaaggtgcttcttgataattctagagaatggagaattactgtaacatctttctgattttaggagaggcagcagttccctttttagcctaaacactatttttttaaaagctcagccaagagactccattataattttcaaatgtgtgtaacttaaattctcataagaaataccactatgcttaaattagtcaaaacattttccccatctacaactctatcttgtcattgcaatcattttcacaaaagtgactgcagctcacagaccctaaaaggagaaaatccagggtaggttatctgatctagttagtttcaaagacaggatctagagattatttaatatgaaataggtcacctgaaatgaagtgtttactgaaaacagcttggatcagcccagttttctaccactgaaccatgcatttggtttaaaaaacacaacaactctggggaatatcggctgcttccaactgtgttgaaggtgttaaagaaaagaacataaaattaaaaatgatcatctgaggcctttatattctctgctcaagagactagagtcttccatttttaacgaaacacccaaatatcttaataattgggcaaaatctaaatatcagagataattttatcttgaagattgttacattataatggtgattcactacctcgccacgtctctgagtcaaaaattaggtctttgtttaggaatcagtggtactctgcaacttggaaatgggaagattttagaagactcaaactttgactttcttgtgtgcaaaaaaaaagacgtattgacatacgacaagtctttccttgcaaggatacctctaatgctcatacaccacctcccctaacattaatacagcttccaggtcactaaccagtgtcagagagcagcccatgcaactagaaattcaaaagatgtcgaacatagggtcaagcctagaataataagtcttagctaattaagtatgcttttttcccaaaattcatattaacaaaaacttggatatgtcagagaatgcattctaagttcactcaacctagaagggagaaacataattttaaattaagagctgaagcattcttgtcctaacagaaagcaaggaaaacgaaatatcacaccacaggaggatttcacaaattagtgtcaacatcaaaaccttaaaatacgcaaggagaatgcagattcacaatgaactcttgtacttgttttgttcagagaagagagggttctgagagaatgacagtgaactaaccccagctggtttagttggtgctttcaactgctgcttctgatcaactcctttagctagaataaattgatgaggattttggcatgtggtattagagatggttattaattttttcctcttatttgcattgttcaatgtagtaaatactagctgtatatggctacttcaattcaaattaattacaatgaaatatacttcaatattgaattttttagtcactcttggttcattattgaatatcttcagctaagatttcccatctaaatacactaagaggtggcttagttaactggtcgtccacaaatattgaagctgttgttaactcctgatatattctctgcaaagagaatattcatgagcctcctcctgaaatcagcagcctagagatagtttcataaattggatacaagttggaaatctatatactctttaagtttttgaaatattagcttcccagggaagaaaatcaaattcataagatatgttaggacaatttaactccagatgttcaaaactgaaatgacatattctacaatatgtgataaaaccaccccctaacaacttaaagcaaaacagggattgaccttaaagacctgccttttcctcatcccccagccaatcagttttcaaatcttgcattttattttgaaaggtccttaaccccctggtctcttgtttctagacttgacacatattgaagtttgttacgtctctctactgacttttctttcttcaaacagtatctatgcctgccaaatgtgaacatacaaaaaacaaatcagaatgtgccattctgatttaaactgcttattagttaataccctcaagataacatctgggttcttagctgcaatgagtcaagcctacttacatcttttttttgtctttggctgcacatttcccatcacatcacactccagcaatgccaagctgtgccagccttctatcccatctccactattttgtccgccgccgccgcggctttctacccgccgcggcattttgcccccaccccgcctcggctttttgcccgccacggctttttgacccctcgccgctgcgaattttgccgccgcagctttttgccccccgccccccccgccgtggctttttcccccctgccgcggcttcttacccgccacggctttttgccccccgccgccgcgactttttacccgccgccaccagtggctttttgccccaccgccgccgcggctttttgctcccaccctgactaggctttttgcccgctgcgggtttgtgcccccgtcgccgccgcggctttctgcccgcccccccccaacccccccgcggccgcggctttttgcctccgcggcttttcagccgccgcggcttttcgccccccgccgccgcgactttttgcccgctcaggcttttgcccccccgccgcggctttttgccccccgccgccgctttccccgccgtggctttttacaccctgcccccgcagctttttgcccccaccccgccttggctttttccccgccacggttttttggcccgccgccgccgccgccgccgccgccgcgactttttatccccagccgccgcggctttttgcccccaccccgccgcggctttctgcccagcccccgtcgccgcggctttttgccccccgccgtcgcgactttttaccagccgcggctttttgaccccgccgccctggcttgccggccgcggctttttgcccgctccggctttttgccgccccggctttttgcccgccgcggctttgcagtcgcggattttggcccgctctgggtttttgccaccccgccgccgcggctttttacccccaccccgactcagctttttacccccgtggctttttgctccccgccgccgcggctttttgcccgcctcgtctttttgcctccccgccgccgcggctttttgccccctccgccaccgccgctttatccccgccgtggctttttgcctcccatcgccccggatttttgcccgccccggctttttgtccccccgccaccgcgggttgttccccgccccggctttttgccccccctgccgccgcgggtttttgcccgtcgcagctttttgaccccctgccactgcggctttttgcccccccgccgcggctttttgcccccgccgctaaggctttttggcgtcgcgtctttttccccccgccgccgcggctttttgtggttttttgccccagctcccgctgattttgcccccaccaccgcggctttttgcggctgtttgcgcccgccacggtggctttttgccgccgcggctttttggctccgccgccgcggctttttgcaggtttttgcccccgccgttgcggctgttttccccccgtcagcgaggctttttgttgccgcggctttttgcccaggcgtttgctgcctccttatttaatcagagccttaatttgaacgtcaggtcatcaaatctggaaggtgataacaccaaaagagaacactggagctgagggagggaacaactggggaaaacaagaggactctacccaggaaaagagcaagaacacgcagaccaacatctcatctggaggaagttcagaaacactggaaagctcacacccagactcagaatcacaatatggacccaggaaaagtcgcaaaatctccctttattctattgccttcaaccaatttcactattgtcagttaaatataacattttaacccacctgaaggagctgaaagagattctctggaggagggaacaggtgatgagacaaagccaagcaggaaagaaaaacaaggtatcactggaggatctgaagtctctggtggacacagaacagacttcaactctgatgtccactgcaaaagtaaatgtcaaatgtagctgtgagaagattcacggacatttccacaataattgcctggcgaagataaagtgtggtcaaatacaggcagaaaatggataaaatgaaataagccagtattaactgtcaaacccaacatgtctggttatcaacaacgattattatatatattaatgagaaatgccaaagtcacaataaagaaataatcagaaagggatttataaaagatacaggtattataactaattaaataagatatataatgtaactataattcatatgtaaaaatctcttgaagaaactgtggacataatgcaggactagatagggaactgagagatgaaaatactaagaagtaatcaaatggaaatgcatgagaaatcaaaagcaatgcagtataaacattgagcaatctttgggcacacccctcattagagctggctcagcttttaaatgaaaccatgcacttaaaatgtcactagaaatttaacaagtaaattgcaaaggaaaagagtgaagaaactaaacaatatcaaaagtgtagtaaatgtatactttaattctgaaaagtagaaattatagatacagagaaagtatttgaaaaaataatggttaagaatgttcccaattttgtgaaacacactgaactacagatcccagaatcacagagaacctcaagcagagtaaacacagacacagacacacaccgcacatccaacatggacagcgtggttaaagaaaaagcgctcacatcacacaccacacacatttcatcaaccttattccttttgcttagttgttttaaatttattggcatttatagtattaagtagaagtctgtaattaaaatatattattctatgcataagtctgtctatgcttaccatgatcaaatacacagcttggtgcaaatgagtgtaactatgttgttaggaatttcactatttcaaataaaaatggtgttttttccaggctctgtgttgaatcacttgtaatgtatggcaatacaatcctttttaattaaaggattttttaggtaggcagataatgattgtttgtgtttatggggtacagtgtgatatttcaatacatctctgccatgtggtttgaccaaatcagaacaatgagaaaattcatcagctcagacattaacatttatttgtgttggtagcatacaaaatgttctcttttggctacttgtaaacgtacaatatattgttagctgtagtcaccgtactgcgctgtagaacactagagcatatccctcctgtctacctgtaattgtgcatttgttaacaagcctcttcttgtctctcagtctcctcccatttggagcatctcataaccactactctactatttacttctagaaaatcaactttcttaaacttccacattaaattgagaaaatgtggtatttatttttctatgtctgtctgctttcattcaacataagggtgtccagttccaaccatgttgcttcaaatggcagaatttcatttttaaggctgaataatatttcattgtgtaaatttacctcattttatttatccgttcatctgttcatggacacatatgttgatttcatagcttagctattgcaattagtgctgcagtaaacatgggtgtacaggtatctcttcaattttagttttttcttttaattatttaaatagataaatactcagcagttggattgctgaattatatggcagttctatttttttcccatgatggctatactaatttacatttccaccagtggtcaataagagtgtccccttctatgcagccttgctagcttttgttttccttattttggctttctgttaacagactttccagcaaagatgaaggatgaaaagatatctcattgtgaatttgcatgttcctgaatattagtgctgtctagcaacatatgtgtgcatatatacttatcatctatctattgatcctttccacgtcttcttttgacagatgttcattcatgttatttgcccattattattcacattattaattgcagttcagttaattttatatgctttatagtaatcccttgtcaaatgaacagttttcagatattgtctatcatctgcaggttctctcctcactcaactgtttcctttactgggcaggagctaaaattccttgatagaacctggacaggtgggctgtggagctgtgggacattggagaagagatggtctccacttgctgtaagctcacactctgttcttcgcttgctctctgaaccattttatgagggtagtgatgagccctcactaaatttaatttaattttcagtaaatggaaattaaatggaaattgtatatcttctcagcatgaatcccatgggcagtcatgaattattcttctggttatagtaattgatttttcttggcatgttcattactagtaatattcaaagtcatttcatttaaatctttgatgcttaatttttttgtttttactatgacattctttcttctattgaatcttccctttagcattataacatgatctagtatccaggctcagctgtcattaataataaccacatatgtcaaaagctatgtcttctttccacagcagacatgattttctcttttctggggatgaacacacactgctgagctacccccactcacaagaacatatgcacagttatgatattttcatttatttgactaataagttatattattctcccttcaagttcttcacccctcagaagtcctggacaaactcttctgcatctggtcaaactataaactcagaaaccaaaccacatggtgagtaaaagctcacttggttctggatattgggtccagctcttccccacttatgtcccacagcacctcagcccacctgtccaggttctatcaagaaaccaaaactcaggggcggttccaaaatggccgaataggaacaactccagtctacagctcacagtgtgagcgacacagaagatgaatgatttctgcatttccaactgaggtactgggttcatctcaccggggactttcggacagtgggtgcaggacagtgggtgcagcgcactgagcatgagccgaagcagggcgaggaattgcctcacccgggaagtgcaaggggtcagggaattccctttcctagccaaggaaaggggtgacagacagcacccggaaaatcgggtcactcccacactaatactgtgcttttctgacgatcttagcaaatagcacaccaggagattatatcctgtgcatatcttggagggtcctacgcccacagagcctcactcattgctagcacagcagtctgagatcaaactgcaaggcaacagcgaggctggggaaggggggcccaccattgccaaggcttcagtaaataaacaaagcggccaggaagctcgaactgggtggagcccaccgcagctcaaggaggcctgcctgcctctgtagactccacctctgggggcagggcatagccaaataaaaggcagcagaaacctctgcagacttaaatgtccctgtttgacagctttgaagacagtagtggttctcccagcatgcagcctgagatctgagaatggacagactgcctcctcaagtgggtccctgacccccaggtagcctaactgggaggcactccccagtaggggtagactgacatctcacatggctgggtactcctctgagacaaaacctccagaggaaggatcaggcagcaacatttgctgttcaccagtattcactgttctgcagcctccactgctgatacccaggcaaacagggtctggagtggacctcaggcaaactccaacagacctgcaactgaaggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactgaaaattctaaaaatcagagtgcctctccttctccaaaggaatgcagctcctcaccagcaatggaacaaagctggatggagaatgactttgatgagttgagagaagaaggcttcagactatcaaacttctccaagctaaaggaggaagctcaaacccatggcaaacaagttaaaaaccttgaaaaaagattagacgaataactaactagaataaccaatgcagagaagtccttaaaggatctgaaggagctgaaaaccatggcacaagaactacgtgatgaatgcacaagcttcagaagccgattcgatcaactggaagaaaggttatccgtgatgaaagatcaaatgaatgaaatgaagtgagaaaagaagtttagagaaaaaggaataaaaagaacaaatcctccaagaaatatgggactatgtgaaaagaccaaatctacgtctgattggtgtacctgaaagtgacagggagaatggaaccaagttgcaaaacactctgcaggatattatccaggagaacttccccaatctagaaaggcaggccaacattccaattcaggaaatacagagaatgtcacaaagataatcctcgagaacagcaactccaagacacataattgtcagattccccaaagttgaaatgaaggaaaaaatgttaagggaagccagagagaaaggttgggttacccacaaagggaagcccatcggactaacagtggatctctcatcagaaactctacaagccagaagagagtgggggccaatattcaacattcttaaagaaaagaattttcaacccagaatttcatatccagccaaactaagcttcctaagtgagggagaaatacaatcctttacagataagcaaatgatgagagattttgtcaccaccaggcctgccctaaaagagctcctgaaggaagcactaaacatggaaaggaacaatcggtaacagccactgcaaaaacatgccaaattgtaaagaccaccaaagctaggaagaaactgcatcaactaatgagccaaataaccagctaacatcacaattacaggatcaaattcacacataacaacattaaccttaaatgaaaatgggctcagtacaccaattaaagacacagactgggaaattggataaagagtcaagacccatcagtgtgctgtattcaggaaacccatctcacatgcagagacacacacaggctcaaaataaagggatgggggaagatctaccaagcaaatggaaaacaaaaaaagttaggggttgcaatcctagtctccgataaaacagactttaaaccaacaaagatcagaagagacaaagaaggccattacagaatggtaaagggatcaattcaacaagaagagttaactatcctaaatatatatgcaccaaatacaggagcacccagattcataaagcaagtccttagagacctacaaagagacttagactcccacacaataatagtgggagactttaacaccccactgtcaacattagacagatcaacgagacagaaagttaacaaggatatccaggaattgaactcagctctgcaccaagcagacataatagacatctacagaactctctatgccaaatcaacagaatatacattctttcagcaccacaccgcacttactccaaaactgaccacatagttggaagtaaagctctcctcagcaaatgtaaaagaacagaaattataacaaactgtctctcagaccacagtgaaatcaaactagaactcaggattaagaaactcactcaaaaccgttcaactacatggaaactgaacaaactgctcctgaatgactactgggtacataatgaaatgaaggtggaaataaagatgttctttgaaaccaacgagaacaaagatacaacataccagaatctctgggacacatttaaagcagtgtgtagagggaaatttatagcactaaatgcccacaagagaaagggaaagatctaaaattgacaccctaacatcacaattaaatgaactagagaagcaagagcaaacacattcaaaagctagcagaaggcaagaaataactaagatcagatcagaactgaaggagatagacacacaaaaagcccttcaaaaaatcaatgaatccaggagatggttttttgaaaagatcaacaaaatcgatagaccgctaaccagagtaataaagaagaaaagagagaagaatcaaatagatgcaataaaaaatgataaaggagatatcaccaccgatcccacagaaatacaaactaccatcacagaatagtataaacacctctgcgcaaataaactagaaaatctagaagaaatggataaattcctcgtcacatacaccctcccaagactaaaccaggaagaagctgagtccttgaatagaccaataacaggctctgaaattgaggcaataattaatagcctaccaactaaaaaatgtccaggaccagacggattcacagccgaattttaccagaggtccaaggaggagctggtaccattcctcctgaaactattccaatctatagaaaaagagggaatcctccctaactcattttatgaggccagcatcatcctgataccaaagcctggcagagacacaacaaaaaaaaaaagagaattttagacgaataaccctgatgaacatagatgcaaaaatcctcaataaaatactggccaactgaatccagcagcacatcaaaaagcttatccaccgtgatcaagtgggcttcatccctgggatgcaaggctggttcaacatacgcaaatcaataaatgcaatccagcatataaatagaaccaatgacaaaaaccacatgattatctcaatagatgacgaaaaggcctttgacaaaattcaacaacccttcatgctaaaaactctcaataagttaggtattgatgggacgtatttcaaaataataagagctatctatgacaaacccacagccaatatcatactgaatgggcaaaaactggaagcattccctttgaaaactggtacaagacagggatgccctctctcatcactcctattcaacatagtgttggaagttttggccagggcaatcaggcaggagaaggaaataaagggtattcaatgaagaaaagaggaagtcaaattgtccctgtttgcagatgacatgattgtatatctagaaaaccccattgtctcagcccaaaatctccttaagctgataagcaacttcagcaaagtctcacgatacaaaatcaatgtgcagaaatcacaagcattcttatacaccaataacagacagagagccaaatcatgagtgaactcccattcacaattgcttcaaagagaataaaatacctaggaatccaacttacaagggaggtgaaggacctattcaaggagaactacaaaccactgctcaatgaaacaaaagaagatgatataaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaatcaaaaaggaccccgcattgccaagtcaatcctaagccaaaagaacaaaactggagccatcacactacctgacttcaaactatactacaaggctacagcaaccaaaacagtatggtactggtacctaaacagagatatagactaatggaacagaacagagccctcagaaatattgccacatatctacaactatctgatctttgacaaacctgaccaaaacaaaatatggggaaaagattccctatttaataaacggtgctgggaaaactggctagccatatgtagaaagctgaaactggatcccttccttacaccttataaaaaaattaaattaagatggatcaaagacttaaacgttagatctaaaaccataaaaaccctagaagaaaacctaggcaataccattcaggacataggcttgggcaaggacttcatgtcgaaaacacaagaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaacccaaacaaatttacaagaaaaaaacaaacaaccccatcaacaagtgggtgaaggatatgaacagacacttctcaaaagaaaacatttgtgcagccaaaagacacatgaaaaaatgctcatcttcactggccatcagagaaatgcaaatcaaaaccacgatgagataccatctcacaccagttagaatgacgatcattaaaaagtcaggaaacaacaggtgctggagaggatgtggagaaataggaatactttcacactgttggtgggactgtaaactagttcaaccattgtggaagtcagtgtggcaattccttagggatctagaactagaaataccatttgacccagccatctcattactgtgtatatacccaaaggattttaaatcttgctgctataaagacacatgcacatgtatgtttattgtggcactattcactgtagcaaagacttggaaccaacccaaatgtccaacaatgatagactggattaagaaaatgtagcacatatacaccatggaatactatgcagccataaaaaatgaatgagttcatgtcctttgtagggacatggatgaagctgggaaccatcattctcagcaaactatcaccagaacaaaaaaccaaacaccgcatgttctcactcataggtgggaattgaacaatgagaacacatggacacaggaaggggaacatcacacaccagggcctgttgtggggtgagggggtgtgggggggagggatagcattaggagatatacctaatgtaaatgatgagttaatgggtgcaacacaccaacatggcacatgtatgcatatgtaacaaacctgcacgttgtgtacatgtaccctaaaacttaaagtataattaaaaaaagaaaaaagcaatcagcacaattggaaggctactccaacagagagaatttggacctatttaattaatagactggaattcactcaaagacactctcctatgggatctcaaacttaagcagatctctgtaagctgaggaagtttcctcaacagatatttttctctagacatccaaaaatgcaaaaacccattttggatatttgtgcatgagtgatctgtagaaggccttggcctattaatgaaagttcatggatatatgataacttcatcatttactgtgcactcacacttcactggtttcaaaaattcctcacctgtgtgatggggcaatgcaggagaagacacaatagtgccatcttcctcatgaacacaactcagctttgatactgattgtcatgctttattgttggtggagaagggtcagacataaaacttgtgaggttctatctgacattgatctggcccagcctctgtcttggctgaggttaggattcctgagactgttctcctcagggaaccccactaaggttcctgtcccgaatgtgactggagaagattcaccaggttaccctcagcttcctcagggctgtgatcctagtgaccactggcagagagattgctctacatttagggcgtgtgagaaggtttcctcctggtacaacaaaactgtggtattttagagatgtagagctagacacagcatcatgaaataagagagggtccctggaggaaacatgaagatggtgaggcaaccccagaccctggcagtaaaccaacctctcatctctacccccacctgctctgggggtggccctgtgcttcctgcaacctgctcttccctggtggtcttgagtcccccctgtggtcctgagtcttcctggcggtcctgagtgccctgccagcaaggtttgtgtcagggctcacaaggacacctcctcattgagtctttcacagtaatactcagctgtgtcctgggcagccgtggagctgagcttcacagagaactggctcttggttgagtcattgttgatggggacatggacctgggtggagggagcatgatgtgtattccttggtgatcgactctagtaactgtgccccagccattccagcctgttgcccaggggatggtggattcagctcaaatagtatccatggtaaaaaagaatccagacacagcacaggtggagggcagtgtctgagggcctcatgggtcctggacctgactcctgcacctgcacatgggacaggacacctgcaataagagggaacatcctggtgagtcacacagagagctcacttgtccccatcaacccttttttaaattctagatgttcaccctgcaaagctgtcagcaaaggaagaaatataagtagttgatcttcttgagagaaagaataatgcctttcatggggaatttgttccttggctgatgacagagcgatatctggggaggagagaggctgacaacacccagcattgttgctggggtataaacagagtttgaggagaactgtgcatgtgccaggagccccgcacacggccgacctctgtcttggaacctcttcccagggatgattttcctgctcaggggtcagatgacacaaactcattcctcctctgaaagagcagccctctgctgagtgtcaaggcatccattcttaccccaagggcaggaaggcaggtgacagaaacaagcaggtttgctggacagagaggaaaggaaaggggtaggaactggggaaaaaccttgtgccaaagacctatggcctaaagtccccctgcttcttttggggtcccacctggagctggagattctccattgtgaactttcctggcacaggaaagttcttgagggaaaattgagagaaatgctgagtgagttctcctctttgctgagcacagaattctcaccctctgttgtacatggtgttttccctgcccggttgagtcaccgctcctggtcccctccctgctactccccaggttttgcttctttgctcatatgctcatccttttctagatttctcttcatggagcccccattgtagtcttgagtgacaacatcaccctagttcacaacaccttagcaggcctgaggactccttttgtaccactgtgaacacacacacacacacacacacacacacacgcacaccagtttcccacatcccctttcaatttcatacaggaaaactcatggctgtgttggggaaatcatttgcatgggccataggagccacaatgaggcatcatctgtctctgagaatacagaatctccatgtccagggaggtgagagactgcaggtgcacagaagccgaaggtttcaggatctgggagaggaatcacaggagaccaagtacagcaggactgggcaagaggaccaaagctctgatggtagactttgaatgagaaggacaaggtgcagcctgatcttatggcctttgtcctttctgttgatgtgatgtgtcacattgattgatttccatatgttggaccatccttgaatcactgggataaactgaacttggtcatgatgcatgatttttttaatgtgttgttgaattgtgtttgctaagttttccttgaggatttttgcatctgtattcatcagagatattggcctgtagtgttttttatgtttttatttggttttcatttcagggtaatactggtctcatagagcaggtttgaaagtactccctccttctctacctactttttaatattttgaggaggatagatattgtttcttctttaaatgtttgtcacaattgtgcaatgaagccattgagtcctgggttttttttctttcctggaagaccttttattaatgcttcaattttgtgacttgttattgccctgttcaggggttagtttcctgctgggcaacaccagagccaaaggggatcttgggtctaggctttgtgcagccagtattgtggcctttacccacttgtgtgtttgatggaatggaaacagaggcccagtgtggagacatgcaatgactactgccccaaagaagggcaccctccagaagtgtctctggtctcaaagttgtgacaggctatagcattttggctaatgggatgggtggtgggcaaggagtacagattttgctccgaatcttgtgcagtacagatgcatgaattccttccagctctccaagttgagctcagggtttgcaagccctgtgaatttattttgtagtaaggattgttgatatgtgtgattgcagtagggcctgatgtgcttcttctacttaactttcctcaccagggataattccatgtgaatctcgagtatgaagctgcagacacagggtgctttcacacagcactactgggcttctaataaccacagggacctctcctctcccctgctatcctctacatctccctttcatcagcccagtctagtcttagctgtttattcaattctgtcattctgtcatatgggattgacaaatgtcaggcacatctattcagctgtcatgctgattttttttttaacttttacttacatatttatagctaacatggacactaaaattggtaattcaaatttataacaaaatagattgaattatgattaccttagcatcaatagtgcatacaaatctgtgtctctacagctctatccattttcccttactgtgttattactatatattagtattttacaaattatatgtatattattcacatgtataattaatattatagtacttgattttcaaaataatggaggaatgaaacatgagactcagggcagaataaaacgctattggcgctcacatacacaaatgtaatgacatttctgggacaccttccttgttgctgttgttctttttaggtgtaagattttctgctcctctccactctcctttcagttctgtctgtgggactccatttagcatttctcataaggactgtctaggtttcatgaactccatcagcgtttgtttatttatattcaccttaatttctccttcacttttgaaggtttcttagaaagtgtataattcttgattgacagtgtatttcagccttttgatatgccacctcaatgagtttttgtcttcatgaatttggtgagaaatcagttgtttattttatgaaggttttattataggcaacgcttctttctcaggttctgacactcaaacatacttggtattttcagacatgtgacactgaggtcaagagatgaatctctggctaggtgcggtggctcatgcctgtaatcccagcactctgggaggccaaggcgggcagattacaaggtcaagagatcaagaccatcctggccaacatggtgaaatcccatctctactaaaaatacaaaaattagctgggcatggtggcacacacctgtagtcccagctactcaggaggctgaggcaggagaatcgcttgaaccccggaggcagaggttgcagtgagctgagatcacgccactgcactccagcctggcgacagagcaagactccatttaaaaataaataaataaacaaaagagcctgggcacagtggttcatgcctgtaatcccagtactttggtaggccaaggcgggaggatcacctgaggtcaagagagaccatcctggccagcatggtgaaaccccatctctaataaaagtacaaaaattagctaggcatggtggaacatgcctgtaatcccagctactcaggagcctgaggtgggagaataacttgaaccagagaggcagaggttgcagtgagctgagatcatgacactgcactccagcctgggtaacaagagtgaaactccgcctcaaaaaaaaaaagtctctaaaagcatgcatactaacaatccacatgcatataaacatgctcacagactcacacacactgtcaacaccctcatatgtagagtcacaggtaatgacccacacacacacacacggggcacacactcaccaagtaatgcaaagagcacacacacactcaaatattcctggtcacactagcatcaaatcaactatattcacttctgaaaggtaagtaaatcttgggaccctaagatcacacagctgaagagaaaagtcaagttagaaactactagggcaaacttgtctactactctattcaaagtcatccatctgctcacagagataaaagcatatctgattgagtcttttggaaaagctaatcagaaactcaaaagaatgcaaccctttgtctctcacctacatatggaaacccccttcaagttttcacacctttctggaatgaatcaatgtattttttttcttaagacagagtcttgctctgtcacccagtctggagtgcagtggcacgatctcggctcactgcaatctccacctcccaggttcaagcaattctcctgcctcagcctcccaagtagctgggactgcaggcgtgcatcaccacacccagctaatttctgtattttcagtagagatggggtttcaccatgttgaccaggctggtgtggaattcctgacatcaaatgatctgcccacctcggcctcccaaagtgctgggattacaggcatgagccactgcaccaggccaaccaatgtacatcttacacatattgtttgatgtctcatgtcttcctaaaatgtataaaaccaagctgtgtcctgaccaccttgggctcatgtcatcagaacctcccgaggctgtgtcacaggtgtgtgtccttaactttggcaaaacaaacttcctaaattgcctgacacctatctcagatactttgtattcacccagtcaagtatgcaactcacacatactcaggaaaattaacattcatgcaaattgataggctcaaatattgaagaacgcactcacacacactcaaaatagcatacgcttttacaaactaacagaaacacacaaacaagttctcccacacacttggtcgaagatatagtgtaacaatcacaaactaagtaactcattttaatataaaacacaggcacacacaagctcacaccctcacacacacacattcacaaacacacagacacagttgtatgcatcatcccacttacacacaatgttctacagtgacacacagacaaacattgagactattccatgaccaggggcttgagacagtagctgtctcagtctccatggacatcacactgtctcagaggctcaaggtttgctttctactacagcaggtagccctgaaatttccctagatgttaatgattgtgtcttcccttccaccatctagattctcctcagagatggccaggactccagagttcaggttctcacatgttgtgtggcttttgggctaaaacacacctgaaacactgagtggctgttgtccttgatcacttgatcatcatctgcattttggttgatgcatttttttacctcatttgaataaaataaaagaaattaattgactctacctgggccaaatggacttctttctgtttctcttggtagctgcaaatgtagccccaaatatgacaggatccaataaacactgcagctcttaaaacactttcttggtcagctggtctaacagcataaggacctcaggagaacaattatattatgggtctaattctgtacccactgcagaccagtttatttttatagaccagcagctccagtctatcacaacctatgattatccagatggaaggaaacagtcttcaaatttttatgacagatgcggtaagataaactgatatttctgtcatttgttttctaggcccaggtcttgtagctcctggccatggggcactgtggtgctctctgatttggggcatttgaaggatactggaaaatagtattgtcctcaaaactgactttctttagagactaatttttctactatgaaacagtggcataaaacatctggtataatactcatatgggactggagagactgaagtcaattctcccattgttctcctgggtctctgtctgggcaactgtgaaaagacaaagcactgctggatccctgctcatgttcttacgatcacgtctcctatccctaacaacagctacattcctttgtgtcagatcataatatgcagtctctcatactgggaaataagatatccagaacttggacagtggcgttagcaggttctctatggaaaaaaaagaaaccacaaaacctaaaaacatcccatgtgaagataggagtcagtttctcattataaattactacctatcaagtttgggctttatctaaattattcaaattgtccccatatggctggtggatatccttaaagggtgtcattttttgttagacaaatgtgatatctatcactatcagctcaggcactcgctgagaggtgctaggttagtctggtggaaggtatctgtgctgagtcttcattgtacatgttagggaaagttttgatataaagagagaggagactataacttgcgtagcagtattaattaaactgaagaagataatcatactatgagttccccatactcacttacccaggataatggatttcccttttcttcagctgttggcttacttaccttaaatattactgcatttacttttatttacaatgtttttttatcttaggttattgcctgattaaagtaagcacaagtaaaatttaaaattaacaatcaatcacctgtagaaataacataaaatgggcatggtgaaatttaaggagagatgccagaattaaacaaataaagaaacacattgtgtaagttagagtggtcagtgaggactgaaatgatgagaagctggtgctgaatgatatatgaagaacgtcaaatatacttgatattcagaatgctggtcacaacagtgaaaaaatctgtagagtggtctgcgcagataagaaattagaaagtgataaagtcacaaacttgcaacaccaggagacatgcaatatattcagtattcagctctctctgtcctctaggaaaaataggttataactgcatggaaaatgagacaagtagtttttaagataattctcgagaaaaattgctaataaagtgactcagatgatgttccgacacaggattgtggaggggacgttgacctgtggtggtcactgtcagctatacgggatggtcaacttggcggtctcctttgccaattttttgtccacaagagagattacactgtcatgtgctatgttgcagatgagtttcttaacctcacaccatgagaggaacatgagaacaaagaagatgagaaaactgaagaccacactacatcaactacattccactgatgagcactcgtcacacagaggcccagggatgagcagggaagacgaaggggctgggaaatatcatccgcaaagggacaccctccagcctgcttgacctccccatgcacggaggggtgaaatgtttgttctcagctaatggtggctatgtcaggacctccacaagctttgagaaatacagatttgtatgaacaaatgcccatactttattcggagggaattttttactcataatttatttcctctccttagcaagcaccgcagaaggatgtttccatgattctccctaatccttcctcagttcctggtgcagttcctggaggaaaagcctgcatcggggagggagccctcctcatgtgcagccctgaggctgtcccatcacctcacccaccattgcccttcagtcactttttaaacattccaaactaattttcctgaaatgtgtagtatttggcagtgtctttcccagataagaaaatacttaagttctgtttatccctgcaggcgcatatccatttttggagctcaggttgtttttgaatgattagtagtggataattagtgggaggaggtttgtgtgcatcttgtcatcttccagagtgcaccccaacatggcattgacactggcaagcaagcagatgggcttgctcagctggagaatggcagacattattataacctgtgaccccaatgaggctctccctctacaagcccaatcaggctcatgcctcttgacaacgtgcagccagcacaggacaccagtgtccacctcagtgaggggccttccaggtgcccacctccttcctaagggggagcttttgtccctgcctggatcccatgcatgtgcttgcatttgctgcaaaaagggattcatccataaacatgccccatgagcctacagtgtaggtaatccatctacagggcctcatacatgacatctctcatggtcaaggtctccacttcttattaaagaacattcattgtagaattcactagaacttgctggacttttagaggcatggataggaatacccttacccactttccctctaatatcattcctagaaaccctctgaaaatacctctggtgctccaagataatttatgtttgttacaccacgggatcaccaggaaaagaaagaaccaaagtgtccatgtaggttcatcatttgtaacttgctgatatgactctggtgcaggatgcagatagtggagaaggctgtgcctgtgttggatggggattcctgggagctctggtactttctgttcaagttcactgttatcctaaaaccactctaaaataaattttatgcaacaacagtagcagagacattcttggaagacattttggacatttttcagaatcatacttagtcttaccatgtgatcaaataatcttgctcaaattattcatccatctaatttgaaaacttgttcacaataatatattcatgggaatgtttgtatcagctttattgatatggtttgactgtatccccacccaaatctcatcttgagttttaataattcccatgtgtcaagggtggggtcaggtggacgtaattgaatcatgggggcggtttcccccatactgttctcgtggtagtgaatatgtctcatgagatctgacagttttataaacaggagttcccctggcacaaggtgtctcttgcctgctgccgtgtaagacatcagtttactcttccttcatcttcttccatgattatgagaccacctcagccatgtggaactatgattccattaaaccacttttctttataaattatttggtctcaggtatgtctttattagcagcatgataatggactaatacagggcctttcctaatctttgaattttctgtatacggtgactcttgaataaaatatttattataaaattagagtgtgtccttgtttctattgatccttgtcctcagttacttgacccattttctaaacaactttaaacctcatcttccctgtcatctcctctgcaggaacacagctgcctcctccctgcaatttctgacactctcaggatgtgggttttcacattgtgtctctcacacagtaatacatggccgtgtcctcagatctcaggctgcttagctccatgtaggctgtgcccatggatgtgtccctggttatggtgactctgccctggaacttctgtgcatagcttgtgctgccatcactagggcacaccaatcccatccactcaagcccttgtgcatgggcctggcacacccagtgcatacagtagctggtgaaggtgtatccagaagccttgcaggagatcctcactgaggccccaggcttcttcacctcagccccagactgcatcagctgtacctgggactgggcacctgtggagaggacacaggagtggataaaaccccctttgactggacccagtcaccttagtcctggggactgagaattatcctacctgcagctatgaccaccaaaaacaggatcctccaagtccagcccatggtgaggagctgtgctctcaggggcttctctagaggacgtgtgtggttattgggtgatgctctcagggcgcagacatatctgtagtgttcacctcaggtgatttgcatattcacaagaactactacttcatagccttacacttgatccagcatgagaaagagaaaatagatctcacatgagccacacaactgtgggatgctgaggtgcaagtcctcattcttatttaatgtcgtgtttccctttatatgcccagaactttgtgaagggagaacttctccactaagaaggtgactcacacaggacatagcacatggacagcctccactctttctaggttttgctgtctgcagtcttactcttgggatctatgtgtcttctgaaatgtgtacattttgatttaataaaatcatccctgttcttcatctttttactaggaaaatatctcaaacctgtaataattttgccttttaaatgtggttctcactgaattgttgatttatttatttctaaatgtatagagataatagaaatagtctttgcaaaattctaattttaacatgttataattttttgattttcaataaaacaacactcagttctcagagaaatcccctctgcagcctcatgtgcaccagctctggggctggagcctgctctgggtgggtcctgggtgccccctgcagcactgcctctgccctgcatggaggtttccatctgggctcacagaggatttatctctcagtgtttctagggctataggaagaggtcatgccctagtttaaaatgctccttcagtgacaccatatgttactgacaccatcttttgaaaacattgaccttaggagacccagtgaactctaagaaaccatcagggagcccctccctggagctcaggatgcatttaatcagtggacacattgtaagcacaaaaattttgaagggttttcggggatgctttatcttgtttggtctcctgcaattgaatattacatctaagaatacctgtaggtatatatacttgtggatgaatgcccactccatgtcttctttttcaataacacacacacacacacacacacacacacacacatacaaacacacacagaactagttgatttttacaacagtgggcctctaacttgccattttttctagtatcttgcaaatggggagcaccccctacatggatactagacctgagtatatgacttccttctccaaacagaagtaaggaaaacagtacagaattggagacgtagcaagtgtacattcatcatgtttgcatattgtcacctgagaatactgcaatttccctaagagaagtgactctgtgtccaccaagggttgagtgaccccgttcatcaagctgttggtgtcagaagcttccagttgctctactgtccttgaattttttctcccattgtctttacatttccctatatagagtctctgcattgccacactcatcttcaatatagattaattatgctgatgagaaggtaatgtgtgaggattgtattttttttcttttcttacaactataggctttttcattcagttaagaggtaaacagattaacattggagactattccatttaactagcccaagttcctattccactttatatatccctcccacactgccatacatcttgaagaaatgactgccaaaagactttgcttctaacttcttagcaataaccttcaatgaattgctttcaaataagttattcctaacttaaaattttattgtgttcaaagaaactcgtccctctaagaggcttccacatatgccaatagaacgttccaccactgacaggagggcagagtaccaattattctaattacaggagctactccaaggaaagcttcagtgatatttgcgttgtcagattcagtgcttgttagggcagaagatggtgagactaacaatgcagagcacactctgtcaaatgactgcatgtttggctgttttaaaaaaatctttggttatctttagagacaacattttaaacataatggaattgaagcctgatacaaaatgtatagaaacatgcacaggaatagacagccaagaagcaaagtggaactcagtggaaacctggctacattacatagctcgttttgaacctaaccatatttatcaccaaacaactgtagcacaataacactttccttctctggctcccaaatttaagtagactcgtgtcagccttccctaacactgtaatcattctttgagagggccggaatatgtaaggtagtcccaaacattgacaaaaatgttaatgtcaaacagcttcacactgtgaggatgacatacttgaagacagccaagatggcagcactgacaattccagaaataaagactgtgacaaaccaggctatacaatatcacgaaagagtcaagtcaacaactttcttggattaaagccaggtacaaaggagcccatgttacaacgtgttgtactgatggggaggccgatatttgatgcaatcaccatagtgagggggcaggagccagtccagtaccgaaggcacgagagggtgttacagtgtcagattcttccccatggcctgaatcactctcctccaaacccacagactaatgcagattccaacaccaccagagagcagaagccatactggcatcaccactcttgaggaaacatttcccatgttataaaccagatacaaagccacgagagaatttattacattgctgatgtcattaccaccatagggtaatgacctcaatcaggcaataagaagttgcaggaactggaagaggagagatagttcaagcttatcttggccatacaattcttctcaagaaccactacttccttttctctcgcctagacccatctccaccttgatactcatgattatcttcgatcctgagaaggtcagagacagcattgtagtaaccagtgtaactgtccattcaaaattacttcttggggactgcattggaccatgtaagattctccatttccttacccttctgaggaacttctttggcatgaaatgagtctagaagtgtgccacatattgtcatgatataggaaaaacagctattattgcaccgtaagtgtttgccaccaaatctcccatgccgtcttccactatggcaatgtgcaacttatagagaagctcttgtaccagaacctttaggcatggggtaatatgcatagtggccactaaagccacctggctgttgatggcttgattgaactggaccaagtttcttagaatttcatctcagtgattttgttatcttctgtttcttggctgtgacctttacaaggagtttcctctaataaagctgatatttgtctattatgtccttccctgtctgcagcatctcaggactatttttgctcaatcttaccctactggcacatccttttgttcaatcttaccatactggcaatcacttgcctaataaaggaaggctgggaagagggttctacaatggcagtgaagtacctttcaccatgtagataaattattataaatgttcttcccgtgggtggtctatctggagaaggttctgggtaaaggtgttagagattaggtctctcaatgactgacccaactcacaaggaatttatgtgaattctaaattaaaaatgtggaggttcatggagcaaatgaggggcacccagaatatctcatcctaataatagtacaaacctgtcctttaagttattttagtttagatttatatataacaaatcaaacagccagggtcatttaaatagtaacatgctcaaacatattagggcaacagctgaatataataatcaaattgaaatcaagcaaatctgggagcaaactaatgtttttcatagttcagaacagctttattaactcaattaacttgtaatcccaggagtctgggaggccaacttgggcagatcacctgaggtcaggagtttgacaccagcctgaccaacatggcaaaacaccgtctctactaaaaaatacaaaaattaactgggtgccgtggcatgcacctgtaatcccagctacttgggaggctagggtggagaattgcttgaacacaggaggtggatattgcagagccaagaccgcaccactgcactccagcctgggagacagagcgagactccatctaagaaataaaaaatttaaaaaaattaataaaaatgcttccaacactgaccttaatcctggttatatttacggttgttgttgtttgttgttgttgttttgttttttcaaacagagctaaagcaagctcagtactcctggagatttggaaagtgtcttcgccttgtttttgcccgttctcacctgggaaccctgtggatgccccatgagaggtaaatctaaggccattgacagaggggccatggccttggtcctgaagctgttggtctcagaagctttaaaccgcttcactgtccttaacttatcctctccctctgcctttggttttcctaagttctagtccttggacagagtctgtgcattgccacacttttctctttaatccagattgatcatactggtgaagaggtaatgtcatgggcaggggagcagtatatgtactggaaattgaatttcaatgttttcttgatgttttttctctagactgtgccctttacaaggagtctctagtggtacagctgattttcctccatcattctactcccccctcctggctgcagcatccacatattattgtcttgaacttgacccccagttgttttattaattttgcccctttttatgacacaggaagactaagatgaaactgcctgggatggaaaagaataccttcccctcacatagaatagagatcttgaaaagcattttttctttataggatctgtctggaggaagttctgagcatatttatcagagaatagctctcctgatgacagagccatgagggaatgtttggattatcatcctgagaacccagaagtttctggagggaaattccatcaaagtgtggggtgtgcagcccccaggagttcttaccctatccctgtccacacctgtccaccagaaatttactgaattaccatgtaactgttcccaccagcttgcactttcaacggaagagtcacacaatttataaatttagaaaggagattttacttccgataaatgattgaagctgcaggacagccatcttaacaggctgggaagcaaagcttcccacagagacagtgagcaggcacttcaagagagggaaagaggataaatgaattcatgcaaatggataagccaagtgtacacattcagcagactataggaggatctattgatattcacatagtgggcaggctctcatgtctaataagcaaacacacgttacatgcacttagtgtttgctttgggggtgaggacttaagaactaaatgaatgaaaattgggccctgttcatcaaaagggctttgtgcaggggctgaaagatacacactgcacagtctctgtaaattgccaagacaagttcatggtcagtggtctcttctcagaagacagttactgaaatctgtctcttgtccaatcaaagctctatttatggcttgtggaacagggtcacagttaccacatgtttggagttccatgagctgcaaatgttttaatatgcttacctcagaaccagtgcttgtttaggtgctacagaaaacaaaaaagccctgtggaagttacaatatagtcatttttttaagtgtaggggtgagtgacttaatccatgactttaggccttgtttataatttggtatcttattgccacagaactttgatccatcagtctgattatctctattttaatgtctttctagttttgggggtcctggttttccctgcaatttcatttcttcaacagattcaagaaattattgataatcaattttccaggcttttattattgtaagaaagtgggtgatgtttgacatgctttttacatattgaagcagaaaccagaagcagcttcagagatcaccagtgacctgacacaagcagcaggaatctcatctcattaagtgtaagtggcaccacacagatatagctgaacatgcagggacacagaagacccattccacaggacaccccccaaaattacagtgaatctaatggaattatagaaaaacatacatgatgtgcatcatgaccaaggtctccacttctcatcaaaggacattccttatgggattcaccagaacttgctttctttccatagacatggatatactgctaaacacttagggaccttaccctctgggaagggacatagtaaatcaggagtcacagaatgtataggaaaatatccgttttatgaatcctctaaaaaacagcccaaatatgaatagccccacccacttttcctctgaactggcatcattcccaggaacccacttgtagtgttatacccaaacgagttagagaaaatgcaacactttgagacgaattaagagtcctttatttaagctggcggccaaagagacagctaacgctcagaattctctcggccctgaggaaggggcttgattaacttttatatcttggtttaggaaggggaggggaactcaaatacaataattctatagaagtaaaaacatgcaagaatcaaaagaagcaaatggttacagagtgataaacaatttaaaagacaaatggttacaaaaagcaacagtaccaggtgcagggctctaaatccttgatttgagttatatatagatgctatgctgggcacgaactcaaggctttatgttgttatctctttgagaaaaatcctggtaacttcatacattgtttgttccagtaccttatcagttaattgggctcctttgaaatgctgaggatctgtttacataggttaactccttgaagaagggggttggataaggagccttaatgtcttgtaaatcaaaagatcaaatggagtttgtccggctttcccagccagggagagtctattcatatgggaaacgtggctggcaattaaggagacaaaagaagggaaaacttaaagtagcaagctagagtaaaaaacaaggttaggcattacagcagaacctatggtgcttcaagataatttgggcttggtatgccaagagaccaccagaagaggaaagaacaaatctgcccatgtaagttcatccattgtaacttattgatgactctggggcaggatggtgacagtggggaaggctgtgcatggtgaagcaggggcacatgagaactctctgcaccttctgttcaattttgctgtggtcttaaaactactttttaatacattttatgtaaaaggagtggcagagacaatttggagtgcattttggccagtttttaggaatcatatttagtcttagccatgttaccagcaatcttgttccaaattatttatctatctgattttaaaacctatgtctgcacaaggcctccatgggattctttgcatcagcctcactgattgctgtctttaccactctgaattttgcatatagggtgacagctgaaagaaacatttcctatatagagtgcatccatgtttctattacattcctcagttgctcagctcattttctaaacaactttaaacattgtaagccctgtaatctcctcaaattcactgcagctgcctcctccctggggtttctgacaccctcaggatgtgggttttcacactgtgtctctcgcacagtaatacacggccatgtcgtcagatctcaggctgctcagctccatgtaggctgtgctcgtggatgtgtctctggtcatggtgactctgccctggagcttctgtgggtagtttgtgttaccattgtaagtgttgatccatcccatccactcaagcccttgttcaggggcctgtcacacccagtgcatatagtagctggtaaaggtgtaaccagaagccttgcaggagaccttcactgaggctctaggcttcttcacctcagctccagactgcaccagctgcacctgggagtgggcacctgtggagaagacacaggagtgggtgaagtctcacatgactggcctggtttctccctcagccctgggactggggagtcccttacctgttgctgctgccaccaagaaaaggatgctccaggtccagtccatggtgaggagctgtgatctaggggattctcccaaggaggggtgtggttgttgtgtgatgctctcagggcacagagatatctatattcacctcagttatttgcatattcatgaaggatgctatttaatagcccaattcctgccccaggatgagaaagagcaaatacatgacacatggacgacacaattgtagaagctgagggttcaagccgtaatcctgttagaggcgatgcgacccctacacatccctgaactctgtgttgacagagattcccccactggagaacaagctcccccaggacacgcacctcactttgaacccacatttgactgtctcatgggcaacttgaatcatttctagaccttaatatgtgaatgtgctattttgggaatgagtgtgtttctccaaaaattgcacttatttataagaaaggatctcctccagacctccagctgcttactattaagatgtctaggggagtttgaaatcctcattgtaaaagtggttctcattacaacatcgagtttcataaatgctgacaattaaatagggtatttatgtgaacatcagcagtctttctgaaatacttattttagattttttaaaggaagtcccaggccctaagaggaacctctccccagcctcctgcgctcctgctctggggcggaagcctgtgctcggtgtgtcctgagcgccccctgcagccccgccccgcccctgcagggaggttcctgtctgagctcacagagtatattcctaccagtgtctccagccaagtataaagtggctgtgccctggctcagaattctcctttagtgacagcctgtgcttctcacaccattttttgaaatagtgaattggccttaggaaacccagagaactttgcagagagaccccaagtaagatctcatgcatcaccagggagacctttcctggagctcaagaggcactgaatcattggacacacggtgaatccaaaaagtcttcaggggtttgggggggctcttatttcctttagggtcctgaagttgattattgcacctgagaacactggcaggtgcaggttgatagaagcccactccaactctactattcaactcacacgcgcgcacacacacacacacacacacaatggctaattttcacattaatgggccctatgtttaccctatttttctggtatccgtgttaaggaaagcactccctacactggcactaaggctgcatatgtgtctactttctgcaaatagaagtaaagatatcagaatgcaagtggacacttcggaagtacatgcgcattgaattaatttttttcactttggaaccatgcagatgccacaggaaaagtaaatttgaggccaatgagggtgaaatcatttcctttgtgctgaagttcctggtatcagaggcttcgaattcttctattttccttaacatatttctcctatttcctcctcagagtttgtgcattgccacactctcgtatttaatccatgttgactaaactggtgagacgtaatgtgtggaacacggaagcattacatgttcttacagttgaatcttaatgctgtggtggtcttcttcctctgggctgtgccctatacaggaagtctccagaggtgaagctgatttttgctcttttctggctggaacatcacaggaaattttccttaaatttacatctattggctaattttacccattttcatgataaaggaaggctgctagtatgggcttgtaatggggatggattacctttccccacatagatgaggatctaaaaatgcctttcccatggtttgtgggtctgaagaaagtctgggtgtatttattagagatttggtttcctggaaatagagccatgaagggatctatgtggattctcaccctgagaacttggaggttcctggaggaaagggcgataagagtatgggggtggggttcccaagatctctcaccctcatgctagtccagacatgccttttatgtttatttagttcagattttcatataacaaaccacacagccaggctcatttaaattccccatactcagtccatattggagcaggagctgagtataataattacgttgaactcagacaaacctgggccaaatccaatttttcctatagctcagagcagctttcctgactcacttaatttggagattatttcttccctgaaagaactgtaagggttgctgtggagcctctgtgggtttggaattttttgcatcagcctatcctgtagggtattctgtacaatgtagacctttatacttagatggtaattattcctaatggcatggaaatagctggcagccctcaatcctgtttctttcttctgttcacctgaatgtttacaagaatcccatgaacctcaggactccccttcatggatgactctgaagattgtagactcagtgctacagacagagagagctaagggaggatactcagttcactgatatgtttggccagcaacataggatacatccaagaatgaatcacttttgtcaatgccaataaataataaattcaagagtcatgactttcagtatatcagagttaaaattttcatgattcttgacaatgaggctcaaacttgatggtttgcagaagaaatgagctcatcattgttagaaagaagccttttcctaggaagccagtcttttaaactaaagtgccagagagtttagtttcacaatagataaattgtgaaaatttatctattggagaaaaataaaatcaggaaaactggtctcaaataattgaaagaaagcttataagaaatttttattaacacagccatgaaactccagttagtcaaattttttggttcatttgttacaactcaagaagcaattcagaagtctacacaattggaagcctactccaacagagataatttttcctgatgtgaaaaacagaccagtatttataaagaaagagttccccatgagatctacaacttacacagatttctgtaacctgaagaagttttgctaaaaggattatcctctagatatctatgtatgcaaaaatatattgcatatatttgtataagattaatctgtaccagcccttggcacattaaacaaacttcatgtagacatgataactttatcacttactgtgcactcacactttactggtttcagaagttcatcacccttgtgaggcagcaataagttcctttgagaatatgctgttgcttcaagtgaacatgttctagatcctcacttgacttcatcatttcatattgagtgtaggtgggtctatgactgaaaacccaacatttttatgcaacagattctcctcttatgagatcatcctgaaacctgccaacagcctccatcatgtatgcttccaatgttttgcttttaggaaataagaggtaaattcataatccatccaagctttaaggtgagaatccttcctggccttccatcatatttagtagaaactctcattgagagccataagcaaatgctgtttatggatcataactcaaaaccaaaactgtttttcataatggctataccattctacatttccacaattatggaaagcaacataaagcctcctaaatgaattaaaactggagattttatatgaccagaaatcctgtttctgggagcatacccaagtagatgaaattaccaccttgtaaagatatctgcatcctatgtttattgaaacactattaataacagccaagatatggaaactatctgatggtcagcacatagacaaatgaataaagacaatgtggtatgtgtatacaatataatacggtttaatgttataaaagaaagatgctgccatttgccacaacggatcaatttccatagctactaacagtgcacaccatccactatagcactccctaggggatggcagatccttattcagtagtaaccactggctgtggtgggaaggcaattttacgtactgttgaatttttcagcataagacatcgatgtcttaaaatattctgcggtgtctgcatgtgataaagtggagtctaatattggaggcaaaattaaaagtgcatgagtcttctagacaccaagtcatagaatgatcctggctgtgtccttgagggagtggaccatatgtaatagcatttggattggggattggtgcatttccagttgtacgaataaagttgtattatattaggtgtaattatgactttattattgtctttatttgaagattatatataatctcaggagatgtgtatggtttcaagttgacagggtggactcgtaatgctaaatactgattagcattgattagattgcagggtgcaaagtattgatcccgggtgggtctgtgagggtgttgccaaaggagattaacctttgagccagtgggctgaaaaagggagacacactcttaatctgggtggtgcaatctaattagctgccagtgtggccagaggaaaaaaaaaaaaagaaaaacagaagaacatgaaaagattagactggctaagttcttcagctttgggactcggactgccttccatgctcctcagcttgcagatggcctattgtgggaccttgtgatcatatgagttaatactccttaataaactccgtgtgtgtgtgtgtgtgtgtgtgtgtgtgtgtgtgtgtcgtgtgtgtatatatatcctgtttgttctgcccctctagggaaccctgactaatacaatcttacttgaaaagaaatttttttaaaaataggtgattaggaattccaggatggaatgcagataatatagaaaatgtctaattccattacaaatgtatgaattcaaaagaggtactaagtagattcagaaatggtgtaggcaataagattaaagaaaaaagaaactgcacatcagcattgtaccccaattgatgatgttccacaaaagagcacaacttacacatctggttacactccacaggaatcttggaattggactacaaagagaatggacggtgtgtggggaaatggggttcctcatggttggagtgcaaggttagtgacaggcatagaaggaatgtgataaacattcatgtggtattaacttagagtggacatgtcattttatttgcaagtttagcataatataggtacatatattagataaaaatagtttagatgtgtgtgcatatatgggttaatacacaacacacacttcctagatttttttacctgagaatttctacaagaaatgagtgcacattaacaaaaaatacacccagaatcaagatttgagtttttaatactattcttctataaaagaaaccagtgacagggggcagtggctaacacctgtaattccagcaatttaggaggctgaggtgggcagatcatttgaggtcaggagtttgagaccagcctggcccacatagcgaaaccccgtctctactaaaaatacaaaaagtagccaggcatagtggcgcatgcctgtaatcccagctacttgggaggctgagacaggagaatcgcttgaacccaggaggtggaggttgcagtgagcctggaccctgtctcaaaaaaaaaaaaaaaaaaaaaggaaccagcatgtctttgagaaatggctaatgctagggctttggaagagaatatagggattagtctacaatttctaatcgtaccagaaaatgagaaagggtctcaaaacagataattgctccttttgcatttttcttgtttgttgataaatctagctaacagtgtaacagttctgttcatgttttatttctgttttttttccgtagaatcagggtgtacatgtgcaattttgtaacatgaatatatttcataaaggtgaggtttgggcttctggtgtaactatcgcccactagtgaacattggagccagtaggtgattttttaaccctcacattcctctcaccttgccctcttttgcagttcccagtgcctattgttttttatctatgtatatgtgtacccattatttactttccgattataaaagagaagatctttttgagttattttatttaggctaatgtcctacaactcttcatgttgctgtgaaagacacaatttcaatttttatggctgcatagtattccacaatttacatctatcatattttatctatctaatcatccactgattggcacttagattacttgacttttctattgaaaatagtgttgcagtaaatataggaatgcaggtgactttttctgatgtaaaatttccttttgggaggaatatacccactgggagggattactgggtcaaatggtaattctaatattagttctttgagaaacttctgtattgtttttcatagaggttgtactaatttatattttcaccaagcatataaaaagcattatttttcctatgcttctctgcaaacacctgctgttttttatttgtaataacagccattgtgactggtggaagatgctatatcatgttgtttgtaatttacatttatcagatgattggtgatgctgagtatgttttcttatttgttttggccatgtctgtgtcttcttttgagaaatgtctggtttttgctcactctttaatgaaattgttatttcttgttgactgatttgagttccttgtagattctatgtattagccctttgatgaatagattgcaaatttttttttttactgttcacaggttgtcttttcactatgttggttatttcttttgctgtgcagacaatctttgtttcaattaatcctgtttgtctaattttgttttcattgcatttgcttttgaagtcagtcttagtcatattttatttgcttaggcgaatgtctagaggatttttttagattttcttcaagcatttttatgagtttataaatttaaacattgaatccaattcagttaatttgtgtctgtgatgatatagaagtctcattttattcgtctacataaggctatccaattctcccagcactacttattgaacagagagttgtttctccagtgtatatttttgtcagttttgtcaaagaactgttggttgtagatatttggctatatgtctgggctcttgatttttttctaccactaccatgctgcctttcttattatatttgtgttgtgtagtttgaagtcagggaatgtggtacttccagctttgttctttttgcttaagattgcttttgctattcagactcttttttggttctatatgaattttaggatttttaaaaatatgtaatcaattatattagttacttgatataaattgcatggactctgtatattgctttgagcagtgtattagtctattttacattggtatagattaatacctgaggccaagtgatttacaaagacaagaggattatttggcttacagatctgcaggttgtgtgagaagcatggcaccagcatccgcttcttgtgagggcctcaggaagcttacagtcatggtggaatgcaaagggggaggaggctgtgtcatatggtgaggaggggggacatgagagggtaggagggttgccagactcttttgaacaatcaaatctcacagtagctaatacagcaagaattcactaattaccatggggtggatgccaacccagtcctgaaaaatctcctcatgacccaaaaccatccagttggccccacctccaacattgtgggtcacatttcaccatgacatttggagggtaaaacccttaaatgatatcattgcactctcggacccaaagttctcatattcttcttacattgcaaaatataatcacctttttttcaatagttcccaaaatgttaacttgatcaacctccaactcaaatgtccaaagtctcatctgagtcttaaggcaatttccctccagctgtgagcttgcaagtttaaaaaatgaaagttgtttacttccaaggtgcaatgatggtgcaggcattgggtaaataattccaaccccaaagggataaattggccagaggaacaaccaacaggccccacatgcatataaaacccagcactgcagatattaaatcctaatgctacaaaataatctctcttgactttatgtacttcaaccagggcacactggaacaaggattgggtccccaaaaccgcaggcagacaatccctatagtttgctaggcacagaccatggggctgccttcacaagtgagagtcaagtgctggaagcttttctaggctgagggtgcaagttgcccatggccctaccattctggggtcttgagggttgtggtcacattcccacaactttactatgaagcaccctagtggggactctgaatgggggctccaactccatctctccccatctttggtgctgccctagtagaggctgtcagtggtggctccactcctgcaccaggcttcttcctgggcatgcagggctctctacacatctgaaatctaggtagaagttgcacaggctccttcactcttgcattctgcatatctgccagaatccagttatcccagcaccatttactgaatacagagttttttccccattgcttgtttttgtcagccttgtcaaagatcaactggttgcaggtgtgcaactttatttctgttttctattttgatctattttttttgcgtgtctgctctcataccagtgccaagatgtgtttgttagcaagactttatggtgtagtttaaggtcagtatcatgatgcctctagcattgttctttatgcttaggattgctttgactattcagggtcttttttggttccatataaattttagaatgtttttttttctaattctgtgaataatgatgatgatagttttatgtaaatagcattgaatctgtgaattcctttgggcagtatgacaatttttacaatattggttcttccaatccatgagcatgaaatgttttcccatttatttttgtcatttatgatttatttctgctgtgttttgtagttctctttgtagggatttttcaccttgtttgttatctgtgttcccaggcatttcattttctttgtggatattgtaagttggaaaggattgtgttcttgattatactctcagcttggatgtggttggggtatagaaatgctggtaatttttgtctatcgattttgtatcctaacactttactaacgttgtttattctacaattattttggcagagtttttaggattttctagctataaaattgtatcatcagtgaagacggatggatggacttcctttcctatttagatgctgtcttagtccattctcacactgtaaagaaacaactgagactgggtaatttataaagacaagtgttttaattggctcatttaatatgatgttgactgggggtttgtcatagatagctcttattattctgaggtatgattctttgatgtctagtctgtttagggtttttgtcatgagtggatgttggatcctatcagaagctttctcagcatctattgacataatcatatggtttttgcatttattctgtttacattgtgaatcacagttactgtggatattgaatgagccttgcgtcccaggggcaatgcccacttaaccatgatgtatcacattttgaagtgcttctggattctatttgctagtattttgttgaggactttcaggtctatgttcatcaggaatattcatctgatattttcttttgtcattatgtctcttcctgattgtgtgtgccaagaacacacagtagagaaagtacagtcttttcaataatggtgtaacaaccaggcatccatatgcaaaagaaataaaattaggccttctctaactccatataaaaatcaactaataatgggtataatacctgaaaccataaactcataaatgacatggaggaaaaaaatcttcctaccattgattcagaactgatttctttgaatttaataccaaagcacaggaaaaactatgcgcaattatgtatctgacaagaagttctatccaaatgtataaataacccatatacctcaatagcaaataacaaatgaactgattaaaaaaagggcaaaatcctggatagatttttttttcagaagaccaacacatggctaacagaaaatgcaaatgttctcaacattcctcattatcaggggaattcaaatcaaaagcacaatgcgatatcacctcacacaagttaatatggctatcatcagaaaggtaaaagatgacaaatgttggcaagaatgtgtggaaaagggaatattttgtggtgggattggttactccataagttgaaaataaagctatcatataatctggtgatcccacttcttgttatacatctaatggaaataaaattattttgccaaagacatgttcattgccagattataaataattgtatagatttgtaaaataacttaatgactgtaagtggatgaatgtataaagaaaatgtgtatacacaaaactgaattttatttggctttgaaaagaaggaaattctgacatttgcaacaacacggatgggcctggaggacgtgatgctaagtggaataagccagatgcagaaagacaaatgctgcatgatctcatttacgtgtaggatctaaactatcccagctcttgaaagcagagagtaggatagtgggtctcaggacctgagaggagagggaaattgggtgacgttggccaaagggtacagagtttcagttgtgcagggtgattgagtcctggaggtctaatatatggcaatgttcctatagttaatactgtattgtaaaaatgatatttgctaaaaaggtagatcttaggtgttctcatgggacacacacacacacgcacacacagacacacacgcagtaaaaataaaaatggtagctctgtgagatgatagatctacaaattaccctaccatgatgagcattttacaatgtatatctgatttggtttggatctgtgtcctggaccaaatctcatgtattataatcctcaatcctgaatgtgggatttggtgggagacaactgggtcatggggtgggtctttcatgaatggttcagcaacaactcctggtgctgttctcactacagtgcatgggttcttacaagatctggttgtctaacagtgtgtagacctcccccgccacttcctgtggctcctgctctggccatgtgatgtgcctgctcccctttgtcttctgccatgattctaactttgctgagtctccccacaaggagaagccactgcatttcctgtacagcctgcagaactgtgagccaattaaatatccttttcttaaaatttctgagtctcaggcatttctttttagcactgtgagaacagaccaataaaacataaaaacatcaagtggagcactttaaatatatactttttaaaaattttctattatacctcaataaaaatgaaaaaaattaaacttactcttataataaagaaatgcatacttcatattttctcaataaaaatgagagaacatagaaaaacttatgttaagatatttgcaacagctttgcttacaatatttataaactggaaacaaatttaaagtccatcaacagaaaaatagatcaatatattgtcatttatttacttaatgggctgactcagacataaaatctctgtcctttctctctctctgtctccatatatacatgaaaactttgaggtttcatgtcagagtcagttcattaattgaataaatgacaatatgttgatctaattttatacattaaatagcatgaatacacctcaaatatagcaaaagtagccattaccaaaaaaagtctataatgttagatttcatttatgtgaagttcaaagcagaaaaacatggatctatggtgtcagaaatcaaaacatttccccatgcaggagttgactgcaggcacagaggaagacctatgttgggggtggacttgctcttcagctaccttaggtgttggggacaagggtattcacctttgccagaaactctctagtgatacattttagatctatgcatttcttcttatatgtaaattttatctcataaaacaagaaataaaaatgtataaaatactttaaaattcagcaaataataaaaataatataaaacccttatataaaatatgaacattattaaatgaattaataaagtacactcaagtatacctagcaaattaaattcctgaatccaaaaagataagggtaacatctgtaacataaaaaataaaaagcacacatttcatagagaagacaaaaataggacatatgtggaacatgtattcttttttctaatcaaatgtctttaaattatttacacaatattttaatctgtcataagtataaattactaatattctgtttgatattacaactatgaacaacttttaaagagaaaaggatattttagaacatgtgaaataaattgaatttattctcaatgttggtacaatgattacacctaaaagttctaataatacccgggttttcagtgggtcttttgaaaattaattttaagagataaactaatgcaaatcaaaaccacaatcagatatcatctcacaccagttagaatggcgaacattaaaaagtcaggaaacaacagatgctggagaggatgtggagaaataggaacacttttacactgtttgtgggagtgtaaattagttcaaccattgtgggagacagtgtgacaattcctcaaggatctggaaccagaaataccatttgatccagccatcccattactgggtatatactcaaatgattataaatcactctactgtaaagacacatgcacacgtatatttattccagcactatacacattagcaaagacttggaaccaacacaaatgcccatcaatgttagactgggtaagaaaatgtggcacatatacgccatggaatcctatacagccataaaaaaacaatgagttaatgtcctttgcagggacacagatgaagctggaaaccatcatcctcagcaaactatcatagaaacagaaaactaaacaccacatgttctcactcataagtgggagttgaacactgagaacatatgggcacagggaggggaacatcagacaccagagcctgttgggggtggggggcaagaggagggatggcattaggagaaatacctcatgtagttgatgggatgatgggtgcagcaaactgccatggcacatgtatacctatgtaacaaacctgcacgttctgcacatgtatcccagaacttaaagtataacaataaaaaaatacataaaagaataatctttaataaagagacatcagcattccgtatcagaaagaaattgaaaatatgtaatacatataaagtcctgataagaaaccttgaatcataggaagagtctcgtgtatggtaggttgtaatatgtttattgttaaaattatcatctttatgttgttttgaaaaattaaaccaaagcataataaaaggaagtgtttttgtgtttatttggtacaacaacagcatgttgagaaaactgaagagacctgtaatcctgaggaggaggcctaatccaaggagagagatgctcctggacctgtggacacacatggtttgcctgattctacccatctaagagctactgaagccttcgggagacatgagaatggatgagttcctcaggacgattcaatcagatctggacaggggggaaaaattcatgacctagggtagattaacaaatataattaaattttcattgaaaattgagaaatttttgttgtatatatttatggcctgcaaagctatgttatgatttgtgaatacaatatggaataattgaatcaagctaatcgacatatatattacctcaaatccacaaatccctatcactttttgtgacaagaatatttgaaattatttcttggctattttaaaatgaccaatacactatgtttaagcttacaaatagacatcgatttatgtgaatcatagagaatcattgaaatcaattatagattactttaataatttatatttgtttttcattaagtttgattctttaggacatattttagaattgttctgttataatgttaaatataaaagactatacatgtatgcataggtttgtgtatttaatcgtatgtctaggatgtaaattaatgtctctatagctgtggagtagctgatatcaacagacgttaataaaactctagaagaataagagtaaataattaggaagaattatttcttgaagttatgtatctttaaaaaatatccctacatataaattttaaaattacaataacacaaatatcaataaaaatacatcataaataaaaataataacatatcgctaactcataaaactccagagtcctgcaaaaacaaacctgcctcctgcatctgagaaaggaaaccgccccctgcccctgctcctgggacctgtccctatctcagtggtcccgagcgctccctggtggccccgcacgcccctgcagggaggtttgtgtctgggctcacgctgacctcccctcactgtgtctctagcacagtaatacacggccaagtcctcggttttcaggttgctcatttgcagatacagcgtgttctttgaatcctctcttgagatggtaagtctgcctttcacagacgcagcatattctgtcgtgtaactgttagctttgtttcttattaaacctaccaactctagccctttcccttgagcctggcggacccagctcatgtagtggtcactgaaggtgaatccagaggctgcacatgagagtctcagagaacccccaggctggaccaagcctcccccagactccaccagctgcacctcacactggacacctgcaaacacagagacaccctggtcagaaactgccacacaaatccactgtttctctcactcatgtcccctcacactcaatctctctatttctccatgaatcaccttttaaaatagcaacaaggaaaacccagctcagcccaaactccatggtgagccctctgtgttcagtgctgatctctgaatggaaacacctgggaatctcatggctggggctcctctcccagagctgcagggtcagggctgggctggttttcatcagcaatggaaggggcccatttgcatgtctcctactatatagcgagttctggaagggatgcctcagagtgggctgtgtcccagagtggatatgagcgattatatgtcataaataattaattatcattagcatgtctacttttagatgcacatgaattatgctccgtgagagtcaagttttccttcatttacaaatgtgaacataaactcccaagcatggaggggccatgtgacgtgtctacgagctcacatctggtaagagccagtctcactgtctggcctgtgtttctcaggactggatccaactgcttcctaaattaactctaggacagagcaagaaattctgagtgaggtttacaaaatcctcttaatataatgatatcatattatttggctgtatcttagtgtttttctaaataatatagaaaaactgaggattcattcgcatgtgtattcagaagtctaaggcttttcttgtactatttttatctctctctttatctttttctaccaaattatacacttttattttttatgagataatactgaaaaattgtagtcttcacctaatatcttctcagtttgacaaatattgacataatcatcaccactcacagataaaacaaatcaattagcctcacaattttctctttttctcctgaaatttccctttctacacctttcctcctcttaccatgtagaagtcagttaggtatcttcattatgtaacttgcaatgagtattcgctttgtacattttataaactggagtcatatgtatgtgctttgactcattatacttatcatgtgtacttgtgaattgaaccacactgttgatcatatccaacattaattgattgtagtaatgggtactattccaataaatgacttttccacaatttgtttattgataaagctgctgattaatatttgaattttcagtttctgtgtatttcaaataaagctgctgctcagctcagagaagtacacagctgagaaacatgttcttaatcttacaacaacatgaacaactgctaaactggtcaagttgcaaatgaatcaatttgctttaatgtatcaggtaattaaagttatagcaccccgtgtgtttgtcagtgtatgtgagagaaagaaagaaaaagggaggaaaggagactgaaaaagaaagtgattccacaaaaattttaatttatgaagtcttcaaatacaaggacttattcctaatgaatggggtccacataagttgaagctgaagagtctaacatatggctatatatttataatataaatattattctctaaacatataaacactcatacacatgagactagatatagtggagggtgtctagtggtgcaatgagaatgtggcacaaaaccccatctccagggcctttccccacctgctgtacctgccctgatgctgagccttgagcctgcctgaccactgagccccacaatgctcctgagcccccatgcggcgccaagtgccccctggttctccctgctggttcctgagtacttgcttctgtcctcagcaccctcagctgtcctgtgaacccccacagggaggtttgtgtgtgggctcacactgatgtcccctcactgttttttgcttaaaaatacatgtgcggtggctcacgtctgtaatcccagcactttgggaggccaaggcgggcggatcaggaggtcaggagatcgagaccatcctggctaacacggtgaaacaccagctctactaaaaatacaaaaaattagccgggtgtggtggcaggtgcctgtagtccccaggtactcgggaggctgaggcaggagaatggcgtgaacccgggaggcagagcttgcagtgagctgagatcgcgccactgcactccagcctgggcgacagagcgagactccacatcaaacaaacaaacaaacaaaaatacatggttgtggccaggtgaggtggttcacgcctataatcccagcaatttgggaggccaaggcaggcggatcatctgaggtcaggagtttgagaccagcctgcgcaacataatgaaaccctgtctctactaaaaataccaaaaattagccaggcatagtggcgggcacctgtaatcccagctactcagaggctgagacaggagaatcgcttgaacccaggaggcgggagttgcagtgagcagagattgtgccattgctctccagcctgagcaacaaaagtgaaactccttctcaaaaatagatacgtacatacatacatggttgtgcacttgtagctcagctgtaggaaaaactgttttttggacgtagatctggaggtggtgaccagactcttgaggagtgggttggaatttgtgctcccttcatgacctgtgcacctgacccactccactcccttccttggggctgatggatgaagctccagcaggaagcactggttctgttggggaatccagcatttaaacctaaatgttattgttgttgattcactaaacaaaatgtggcactcgtttttattgagttgagatacacaaaacataaaatttaccattttagccctcattaagtgtattggtcagtgatactttacacattcgcaatgctgtgcaaccatcaccactgtttggtttgggaacattttcatctcctcaaagaaaactgcagctccattaagcattactctccatttcccctccactcacctcctgggatctgtctctagggattttcctcctctgcatacttcacgtcaatgggacaattcagggtgtggacttctgtgtctccctcagttcactcacccaatgttttcaaggctcatccaagttgcagcctatgtcagtgcttcactcctctttaaagctgggttagagacacacagacacaccgcagcctcttcatccctgtgggttaccgacactcagacacaccatgacatcttcatcccagtgggttacagacacacagacacaccgcggcatcttcatccctgtgggttacagacacacagacacaccacggtgtcttcaaccctgtgagttacagacccacagacgcactgcagcatcttcatccttatggcagtcgatgggcacttgagttgtattctccattcgactactgtgagtggtgacactaggtacacttgtatatgaggttttcagtgaagaccattttccaaagttgctgtcccatttcagtaccaactggcaatccacagccattctaaattcagtatgtttttacctacaagtgattatgttttttctatttagttttgaatacttgttttctcagtgtgtgcaaggcagtaatctatatggaacttaaattagcagcataaatcaaataaccccattaaaaatgcggaagggacgtgcacagaaacttctcaaatacagacacagaagtggccaactaacatacaaaaatgctcagcatcctcaataatcaaataagtgcaaatcaaaaccaaatgagatactatctaacacatgtcagaactgctatcactaaaagatcaaaaattaacagatgcagacaaggctatagagaaaagcgccacttacatatgtttggtgaaaatgtaacttggccaaagcactgtggaaatcaatctagagatttctcaaataacttaaaacagacctacaattcccctcagcaatccaattcctgggtatatgccccaaagaaaacaaattattgtaacaaagaaaacacatcccctcatgtgtgtatcactgtgcaattcacagtaccatagacatggaatcaacctaaatgtccatcagttatagactggataaagaaatcatggttcttatacacagtggaatactatgcagctataaaaaagaatgaaatcatgcttatttgcagctacttggatgcagctggggtcaaaaattcgaagctaactgacatagaaacagatgataagagtcaatgggagaggaaatgaacattttgggtgttgctctgtgtacaattaagaaaagaaatccccgggtgcatgaacacttgaaatacaaaagcctggagacactcatgtcctgacttccatttcattaggttgtgctttctctcattttttttttcagttaaaattgctttccttcactcttggccaagatagccacacataatcatcgagagacattacaataaaaataacacatctgaacattagaacaaatgctaacttttaggtcaaagttattgtggattcagtgtgatagacaggagacatggctgaatagtagcagtgtgctcacagtaattttatctaaattatgaaaatttgtttacatctgttagattagattcccattgaaatccttgatctaatatcatctctgatgcattatacatcggtaatgaaatgaggttatgcactcaattgagtagtgcaaactttcattcagcgtttgttcctctacgtgatgtaaagtcagcccggatggcagaatttattgcagtcaacagagctcatcaataagccaaagacaaggattaaacacatgttctagaggagtacctgactttgtgatgctcttcatgcaaagaaatttctcacatcttctggaacatgtaaaaatgcacaacaaaataacacattttagatgcactcctacattttagagacctgactaatataacttggaaagtaaaaactgaaaggaaaatgacatagcataccaactaaaagtatacatattgtagtgggttatcacaccaagtaagcagtcttatcagtcaggagtttataatattatctaaatatggaaggcattagcattatgtatacaacacagcatccgtcccatccacaattttctgaaaatgttgaagaaaattgtcatccttaaactaaaattgtccaaaccttaagaaaatcttgaacttccttggccaaaggttctctccctagcaagacagccttatagttaacaccctcagggagacatcagttgttagcctattatttggtagctggaaggcccatacatttacccacactattcatcaacagattaaaccatcatttccctacatcttttcagtaacctctaataagattaaagaggggaattatatctattgtaagaaacatcagggtagaatattgctcttgaaccactttggaaggaattttaccaggtacttttaaccacaacacagcagtgaaattgcagaaagtcaatagttgggttcatatttataaactgtaacctaaaaataaatccctaaaacccaccactgattaaatagtccatctcttggcctagggaaccccctaaaaatctaaaaactttttccaaccatgactaaacaagagatcagacacgcctcgttatacctactcccctttgtggtttagtcacagcagtgaccaacactcatgttaaaatagagatcttaagactgacagaagagtggcagtaagatgtcaaattataaacaagacctaaggccttgccaggcaaggattttgccactcacttctacacttaaaagataaactatgttttaactgccaataggttattccttttctctagtggctcagtaagcactggcactgagacaagcactatgaagacaattgcagcccatcccctgatgaactgaccccctgttccacaagccataaccccagctttgattgaacatttgctatcaggatctttttcctgatcagaggccactgaccatggcctggctctggccgtttacagaatgtgcaccctgagtgcctttgtgtctctgcttctgctatttgcacatagggcctgactgtaatggatttaaatgctaagtcaccactggtgagtgaacagggctcataagcttcatgtgtgtttgttcagtatgcgtgtgtcaggacaacctccatgaacatccatagcccctcctgtaacctgttgattaagtctgtttagccaaacagttcagcataaagcttctgcccaaccccttcttcttgggagtgcctgtctctcatttttaccaaatccatgctttccagtgtataggatggctgtaacccttgataaaaatatagtctcagtttcctaatttgtagattgtggtatttttaaatatttaatacaactgaatattaaattcagaacttcatctaattattagactactttagtaaagtatgacaaactgtggatatcctataataatttttatataccctataagggcctgtgatattttgaagcaggaagctgacctgagaccttcagaataaactgatcactgtggataatgaaaaggccccacccaggacattgattgagcacccctgcctgtctcattccttcttctctttctttttattatgtgcttaccataataaaaatttttattgtctttagatctgtttgcttttcacacatagtggactcatctctctttttcactcattttcttaaactgctagggagaataaagtgtcaggtcctattttggtgctcactgctgatgaattaaggtttattcttcttcgtccttgtcccccacatatgggaaatctagtaagaaatcgtagaagctcccttatctgatgccagtgtgaggtttaaatcacacaagctccttctcctgagtagaaacgtgcccctacccccaaccccaccaccaaatcattataaagccctgagccagcctcctttcctcttccattgaagaaattccagtttggaatttcctgagaggcctgtgctgctctcagcagacaataatagagttggtaaatcttttcataaccacctgaggtgtgagtgtggcactatcagacctgacatccacactaacaattggtgggctctctcttcttttgcatggggtcacctacaattggaactatgggtttggagtcctgacagtgaccaccacagggcctttcttcttttgcactggatgctaactccctctgccccagtgcccagcatgcactttatcctgcctgctgctcactgacccttggagttctgttgagctgggctgcagtgttgagttaaacaccacaccttttatagatttagctgattgaattcagaagcattgataatttattcacattgagaaacaggagtgattgtaggtgactctgcctttggtgcatgtgagaaaatttttctcttgtcaccacaaatgtttcttcttcaggaagaacaggataaggaatccagagaagtgccccagaggaaactgtttcatggagaggaagccacagggctgacaggaaaccagaccttaacctccctctgcacctgccctgaggctggcttttgtgctcagtgggtcctgagtgcccccagctggtcctgttccctcttcagggaggcttgtttctgggctcatactgacattttttctaattgtgttccccaaaatggagacagagtaaaccgtgaatccatgcatctcagagaacagagaacagcagaattacacccactgatccccccacacacatttaggtaaatcttattaaaactgctgaaaaggaaagacaaatagaaatatacgcaggcaagtggaggtgagcagagggggcattccttccaaaagaacagaaaagatgatgacagcattcttctggttaaaaccttacaagcaagaggaaagttgatggtatctgtaaagtgttggatgaaaagtcaacccattattttataacgcatgggtgttctctaaaaagtgaaaaaaaattctatttctctttgacagcatgagggtttcagtgaatccaggccctcatgagaccagtgaaaattattttgaaaaattacagggtttggaaaggctctaacaacataaagcaagtgaagaaatatttattcaagaaaatctagaaaactcagtaaggccagtcatcatacttgatctaagatgctcttccttccttccacatcccagctcagcatgatgtaaactccactgcggacagatgcagccaagaagacaggtcaccttctaccaactcccaccagaggaaactcttccccaggacccagtacgttggccctctgaccctgcacacagcacatgatgctgaggttcagtgctgaacaagagctactgagagccagagactcacttcttccatggagccccactcatggatggaggctctgccccgggtccagtgccactgggaacactgggtctctggtttctagctctgtcctatggcagaggttccatcccacaataaccgaagtgctgagaaggtgggaagctcctgcccgaccctccactgagagctcagctcctaggctgaggaataaaacagctcaactttgtctacacctgcagaaccttgtttaggagctctgtcccaggagagagggggcaatggaattcagtcataaaatatgatccttaattagtcctaaaaatcctaacttcagtaacaacagaatgtggacaaattgaaagcctgccagtgctctcaaaaacagtggatggtgtggtggaaagcccttggaaggagacgggtggatgcatgagagatgcaggctacactgcagggctgctggcttgcaggagagaaccgaggacgagggagagctggggaaagttctcttgtggttgaaataaatgccagacactcttcaatggagcccatgtttgtttggttcagtctgtgaagtaattcaaacctcagtgcatgattgaaaatagtacaattttccatctgcaagtggcagagctcaacatctgggtctggtcaggagagagacagagagagcccagcccaaaccactgacacctggggttgacagtgctgcttacagatgtgttcctttgatctttgagactggtttctctcacttagcataatgcctggagttcaactgtaatggtttgtgaatcgatcatttgatattttttattgctgatggattcaatttatagatgcttcctagttttttcacctactcaaattttgagacatttatgttatttttcatttctaacacacacacacatgtaatatcttgaatatttgaacagaggttttgtgtgaaaataagattgtatttctctgaagcaaaattcaagagtgggatatttaggtcatgtgttaagggcatgtttgattgcagaaaaaactaaaaattattttcccgagtagctgtttcattttgcattcccattaacaatgtcgtagacactaggaacttggtatgctcatcagcattggtattacctgtatttcttcttaatttcagccattctaaaaagtgtatagtggtgtctcattgtgggcttgatttgaattcctttaatggaaaatcctgttaacagcctgtttatatgcttatgtgtcatctgcacatctcatttgatgaaatgtctgcacaaacctttgcctattttatccatgggttgtttctttcttatttctttttcacagttgagtcctgagagttcttattctaattaaattggtggttatgtgatttgaaaatagtttcccatctgaaacttgacattcatgttcttatagttacttgagtagaaaacgtctttaaatttaatgagtttcaactgatagtaatttcatttattgatcattttttacatattattttattttattttattttattttatttgagatggcgtcttgctgtgtcacccagactagagtgcagtggcacgatcttggctcattgcaaactctgcctcctgggttcaagcaattctcctgcctcagcctcccgagtagctgggattacaggtgcctgccaccacatctggttaatttttgtatttttagtagatggggtttcaccatgttggccaggctggtctcaaactcctgacctcatgatccacctgcttcgacctcccaaagtgctgggattacaagcgtgagacactatgcccggtctaaattttaattttaagatcattggtcaactgttaattattttatatttttaacttttttgtgtgtacatttatttgtataaatttaagggctatgagtgcaacttttgcacatggatatattccatagtggtcttggcttttagtgtaatatcacccaaataatgtacattgtacccactaggtaatgtctcctcatgctcccaccttccacctcccatccttctaagtctccggtgtccatcatttctctctccatatccttgtggacacattgttacctcccacttacaaataataacgtgtggcatatgactttctgtttgtgagttagttcactaattatattgtccccagttctaggcatcttgctgcaaaagacacagtttcatttcttattgtggttgactagtattgaattgtgcatatgtgctgtgttcttttataaaatcatctgttggtggacactcaggttgacatgtgtgttattaagaatagttttgtggtaaacatagaagcatggatatctttttgaagtaatgatttattttcctttgggtagttaccccgtagtcagattgctggatcaaatggcagttctatttccagtgttttgggaagactccataccattttccatagaggttgtcctcgtccacatcctcatctacagtgtcgatgagttcctgttactttccatcctcaccaacatctgatacttttgagtttttaataatagtcactgtggcttttgtaagataataccttactgtagttttaatttgcatttccctgatggttagtgatgttgagcattgtttatatatttattatccatttgtatgtgttctttggaaatgtctactcacgtcctttgctcattttaatagggttatttggttcttcttcctgttgttgtatagtctaattccttgtaaattcttcatgttagttccttgtcacaggcaaggtgtgtgaaaattttctgtcattctgcaacttgcctgttcagtctgttgctgtgaaatacctctatagtttaattctcacttgtctatttttttcttgggtgtgttttgtggtgttagtcataaattcttcacctcgcccagtgcccagaagagttgtcctcgtattttatttgagtacatttatagtttgaggtctcatatctaagtctttaattcattttgtgttgagtatgtatgtgttgagggtaggggtctagttttgttcttctgcatgttcatttccaatttccccagcaccatttattgaatggggtgtcctttttctggtgtatgtttttgttaagtttgtcaaaggtcatttggctatagattgtgtggctcaattctgggttctgtaaaatgtaccctagagccttgattctcctgaggcctcagtagtgacctgctcacagttagaactctgttgactcagtggtgtttctatgagtgtagtgattcgtggtcatggggtggttttcctaaaattgtggacaattctgttttgatgttcaagcatgtgctaaaaatttcacaataaatgtgtctgtgaattttccatttcatttccacattactccttggacttactgagatgtgtttgtgatgtcaagatgaggtgtttttctttccaggtgttggattttttacctatctgggtatttatgggctccctgggtggaaataagccgcatccatcacacctaccttatggaatttttagaaatttatttgtgcactgccactgtgagacactccatgatgatgacacatttcatttatgttattgtttcataaaattactagtgtaccttccactctagaagagaagatgctgtctggattttcataattcctcctgctctcttatctccacattcttctttgacaccatatctgcagcttaagaatgacatacgctactgacatttgtatttggtcccttaaagtgatatgaacctaaggaactggtggccgcatatcagtgatgcatctggctcaggtaataggaacctttcgtgctgaatcttgtcaaactggatacagcctcggctgtgtcctgttgagttaggcatagaatagacagcttcattgccaaagaaaaaaagtagggggtaaaatgggtggtatgtctccagcaaatacaatgcataggaaaacaaattgccatatgctttaaggctccgctgcaatcatctctgaaacaatctttttccttctcagcttatttgggtggcagagtcagctccaaggctgcaggcagaggcaccgctcctgaagcactgctaggcccagctcccatgtcaaaggcctcatgcagccctacacacagggctggctggttgctcccaagcccaagcctctgttgggtggtttcttcctcaagattttagaaacaggctttctggtctgttgaaataaaggcagtggtctgatagtttctaaataaatttaaagcttattttttctcccttccagaagaatcatgtacatttgctgccaagtagctctattattccaggccattaaatctgaaaaatctaacagttttcatcagatttgtctcaggtcaattctcattctttaaaacctgaaatatttcttttcatagagtatcttaggcttcttactgagtgatatttcagtcatatactcagtgttctttgtagaatacagtttctgattttggcaatatggataggttgagaattttctaagtgctcaggttttttattctttttcgtttatatttttttctgattttaatttatctacctcacttgttataagcactcaggaggaaccaagcaaaatatcttcaacactttacttagaactattctcagctactcacaagttctcactactcgcaacttctctttcactaaatattatatcactgtccagccaagatttttttaaaaactttatgataaggatgactattgctccattttccaaaaccactctactcatttctgtctatcagcatgaccctcaacatacaaatttcttcatatatgtcaaaggtacccatccttttacacataacccaattccaagctactttcacaattttcaaataattgtaacatcagatttccacttcctaaccccaaattttcttttgtcagtttaagatgccattacaaactatcatatttggtgactcatgcaacattaattttatttcatttatcagtgctgtgaactccaagatcaagatgctgacaagataggttttattttgaggcttccacttttggctcagagcagccatcatattgttactttttcatatgatcatttcattgtagggcatgtgtgtgtgtgtgcatgtgtgtgtgagagagagagagagagagaaatagagagagagagaggctgtctggtgtctttacttatgaggtcagtaatttcattctgatgtttcaccctcatcatctcctttaaaattcagtactttctttcttatagaaagcagcccgacagaaatttgcaaacttcctttgtgatttttattattattattttttagctcatcagctattttcagtgttagtgtattttatgtgtggcccaagtcaattgttctttcaatgtagcccagggaagccaaaagattggacaccctgctctacagctacagtagtttaatattaatataaagatataggcagaacaactgaacagaataaagactagaaaaatatctaaacatattactaattatctaaacatattactgattttcagtaatgaaaatcaattaaccactgacatgtattacctatatgaatctcacaaacaatgttgaatgaaagactcaaggcagaggttgtacattccatttcaaaatttcaaaaacagcaatcaagaccagtgtcaaaagttagcatagtgattacttctgaatactgttagaagataaactcagataactaggagattaatgagaaaaacaaccaaaaatggcagtaagcattgaatctaattacctataggaggccaagactaatatagggattttgatttgaaaattaaatgttggagttgtaaaccttgataatagaatagatacataactacctatatgtagagaggccgaggtatgagaatcacttgaacctgggaggcagaggctgtggtgagccgaaattgtgccgctgcactccagccagggtgacagagcaagagtctgtctcaaaaaaaaaagttatgaataactgtgcaccaggtaacagagcatcagcattcacagagaagagctataggggaaacaagaaaaaatatagaaaacacagcatcttaattatttaattcatgtgttttagttcattaaacatcaagaggaccaaaattaagcaagactaaaaaatacctaaatatcgtaattgataaggtagaaatatgtgtgtgtatgtctgaacataacaactcattcttttttaagtggcaatgaaacattcataaaataaaaaaaaagaaattccttaattgctataaaagtattcctggggatgagtaatttataaaaaataaattctaatttggctgacggttttgaaggctgtacaggaagtgtggttctgctatctgcttctggtgagggcttcaaaaaccttatatttatggtaaaaggcacaggggaagaaggagtgtcacatggtgagcagggggaagaaggaaagggggagatccaagtctctcttaaaaaatcagatcctgagtgatctaactatgtgagaactcactcattaccaagtggatggcactaagccattcgtgaggaatctggattctggattcccatggggtgatgagaggagagcagaggggaggaggggcagggttgggtcctgggtaaggcggtgctcgggctggggtccctggagagaagttctgggttcctgggggccaatcaggcaggcgtcttttctgtccacaccccgagggtcccagccggagccaggtggggaaccataaggagagggcttgtgtcctgtcctccccagtcctctagacagggtggggactgaggggtccaccccagggcagggccaggcagtgactctgatgtggggcctggttttcgtggactggcctggggggtgcggggtgcagagcaggagggggcagattctgttgggggatggtgcagtcatccctgtgttcaggccatttcctgccctggtcacctgcagtgaaccctggcaaggagggggtggcctcccagacagcagcctgcctgggatctgctctggccctggaactggggatggagccattctggaggtcagcagctgcctaggacagcaggggaccaggccagcccctagcaggggaggcagtggggattttggcaaggaccgaattgtttgggagccagtgccccactaggcacagtgacagacaccccagcagtatgtcctgtccccaccagactgcccaccctatcttaggtgtggcatgtgagggtgccgtgcccctggcaggcccagcccttgaccttccatgcagtcatgaggccctgggaagctgagaacagacctcccactgagggaaccctccccacagagggcagagtgcagacaacagtgaccttgagagccccaggagaagcaggtgagctggaggcctggggctgcatggcagtggctcatctacttggcgtggttgctgctatgggtggccccactgtggtaatcgtagacactatatccaccacagtctgacaccccctgacaataaccacacctggaactggaggcggggctgtcaggaggagcttcccagggagcaaggagggtccagacagctgtgccaggggcccccaggactggggacgtggggggctgctcagggaccagacatgcacagtgtccccctggagaggcctctgcagcctcctgggctctgggacgggcctccagtcagcaggaggctgggtgcttcctgacatgtgctctcctgccctcactggtgagctcctatgtggcccagtgcaggcccagctccagcgtccgctcctgtcagcctggccgagggtctgggcagaactgggcatggctccttcttagatccctcggggactgtctctacagctgtacctggggctgggggctccatgagtggtctttgccatatggggacgtcaaaggcaggtgtttctctagtggcaggtgagggagactgtccagggcctggccctacgaaacatagtggcctctcagaggagggtgtgtgggagtcctgcctattgggagcctggcggatgctgccctcttgattccagccaggatgggaatccaggcaattggcaggagctgctggaacaaggctggtgtctacagcaattcccggccctaggaattggctgttggaactgtggcagctgttgggacagggttcggtgcagctggcaggcacctgtggtcatgagtgaggtcacctcagagccctctgaagcccttgtttgaaggcagatgaagtgtggggcaccagcccatgggctttcatggccaaggtgtccctagaggccgagggtctgggcagaaatccttgggcctggctcttcttatcctggagaactctgagccgagaagtgtgcataaaccctgggagtccggtcagtttttgctgctgggttcatcactgtggtagttagcaccatagtcacatagcaggagggccttcacaaaaagcccctcagtgagcccagaggcatttcccacgcaggtgctggtccaggcgtctggggcccccattgacagtggtgctgcatcctggggatctcagaccggtctgaatcttccccgcctgccgtcgagggcaggagggtctgactcaccctccagggctcctgtcccctccaggaggggccgaggtgacatccggtcagagcatgtgcaggagtcaggcctcctggatttttagtcctggggtaggtgcagggggtgggacaccttttaggggtctgggaagggctgggctgtggggctgtccccatgggccatcttgtgttctgggtgccgtcctgatccagatgtgggttcccgatgtgatatcactgaggactgtcctggaagagggtgcccactggggagagagacagggatttctggaaggttctttgtctctgactgtgagaggtgagtcctctgttggcttcccgggtgaggtttggaaaggagcaggactcaggacggccaggcaggatgagcgactcccagctccggctgtcccgggaatgccttctgtcttggaaatgacccaggagaggctcaggtgtcagagccaggcaggccagggaccacaggggcagggacagcgcacaggaccagccccgccctcctgcccctactcggacctggggggttctcagggtccacacatgtggctcagccttgagggaggggcttccgggactgctgggtgcctgtccccatctggactggtactggagggcagcagcgatgcagacctgttggactcaggtctggctgacctatgggataatcctggccatctgtttcatggtctccggggctggcgggcaggagctcagggtggtcactcttgggcttgtccattgtgcctgctgccctgtgtgtttgggacacaggttgcactgctgtggtagccactacacccatggtgctgtggcctcgatcaaaatcctaacgcggcatgtggtggtccactgtggggagggctatggcagaaggctcccagggatgggtttttgatggactctgtgacactgtgggtataataaccagtccaaaaatcataataccacagtgacacagacctcaccccaaacctactgccaggtccggggaaactcgggatgtccagggctgacctgaggaggtagcagggcaccgaggggaggctgtgggcccagcgctctcaggtctgctgcggggacactcgggtctgcccctcgcttaggtggacagtgtctgtgcccacctgtgtcctgaggctccatttcaggctgatatctgtctgtactgtccctacccattccatagccatgtccttttgggtttataaattgcccccaaatcacgcaggcatcactcaggctttttatattccctgggccaccaggtgcctccacccagaaaggtgagatgtgggagagttccagagtcattctgcaaccctggatgagcccttgcagcctcagtgctactgaggttccagcaacacctggagcaggtgcaggtgaggcccgaggccaggtgaagcccaggccaggtgagatccaggccagtgatgcccaggtcagatgaggcccaggtcaggtgaagcccaggtcaggtgaaacccaggtcaggtgaggcccagatcatgtgagctcgggacaggcaaggtccaagtcaggtgaggccgaggtcaggtgaagcccagaggtgaggtccaggccaggtgaggcttaggccaggtgaggtccaggccaagtgaggtccaggtcaggtgtggcccaggtcaggcaaggctgaggtagatgtatgagacttctgtaattttcagtcggtgccaaccctgcctggtgtccctgcccctcctcccagcccacgctctgtgcctgccagatggcagcccctgcacaggtggtgctggctgtggaggagctgggctctgcttccctgtgcatgggcgtccctctcaggctctggcctgggagtgtggctcagttgcttctctctggaatgtgccgactgtgccatccttgggggtatatgtcctcggggggatacggctctgtgcctgctccacatctggccccaggagctgccagcaggtaccggcctgccctgccacacagtgagcctgcagcctgtccggggatgcccagggagatgagtgctaccacacatcaggccttttctctttaaagtcatttctttggggatacatcatcgatgtctcatatactgaatgtatgtctgtatcactgtgcaattgcctgtgtcatcgtttatttatccaacctgggttaatgtctttgctattatgaacagtgccggagtgagaattttctaaacacagctgtgtacattttcctcttcttgcgatttagaagtttaactgctgttttcaaggtactgtaatgtatttgttctgttcttgttaggagacttgccaaacctgtgtgtctctgttcacaccctcttccttccccagtagaagtaaccacaactgtgtttatgtgatcatcgttttcttgattttccttatagtttttctagtggaaagtttatcccttaagaagatagttcattttgccaggtgtaaattttatttagaagaaatcatattgaaagtattttttggagtttcctttgttactccaattactcagcattgtcatgaactcaaccacagagttgcccgtaaccctggtaaccctgtactgttgtcctcgtggctgtctgggtttgcatttcatgaacctgccatcgtttatttgcctgttttccttcagatggatgtttgcttcattctcagtttagggctatgacaaacatatgttctgcacatctttgcccatgaggttctcagggagggctctggggctggcattgcctgcagggctctgctttgttgcagggagttcctgccagggcttttcagagtgtctgtgcccagcagcaatgcctgaaggtacacactgtactttgcccttgcatcaggcactttctgtttgcttgcttctgtgtggctccacattctggagaatttattcagatctgtgctgcaaatccttctcactgattctctctttagctgtgtctacatcagctgttaagcatcccatgatgcagcagtgtgggcacagggcaaactttcgaaagatgacagtgtgggatagaggctgctcctccttccctgtgcccttcccacactgtcctcctgggctcactcccagccatttatctcgaacaccagtttatggaattctctgcccaggaaagcagaaacagtaaaaggccctgctcaggctctgcctgcatcttctcttgcacacccaccaaagctctttccttggggcctgtgccagcttccccagcttgcttctcattttctgtttactctgctcgctggctggtgggggtgatgtctggggggaagtctggtgtgttttggcattggtggacacccctaggccctacttcccagacgctccccctcagctccagaagtggaagcatttacagcagggctttgggactggggctgtgtcactgtgggcatagaaagtagtactattacaatattctcacagtgacacaagcccccacaaaatcctcctgtccccatgggtgtcacggagtccccccttgctgtctctggccagttctcctgctgatactgtgatttccagggggtttttgtctgaaactcagggtgtcttggagaggactctgagcccagtgctgtacagggggctcctcctttgtcctgggggagttgcgtggaccctgtgtttggttaagggaagcatttgctggtgaggtagacctcccctcctctctttctcaggagcctcctctgatgattttgcctggtgtttcttggggctggtgctcggggctcagcagtctctgccctggtccagctgggaatgtgggtccgtcctgtttccatgagttttctggggccaccagtgaggggctcgggatgtcagcggctggtctcggtccctatggtctgggctccggctcactgctcccctgccctccaggtcagtcactgactcagttactatgcagcgggctccatggctgtttggtggtggctgcaggtctcttcccaggagaggcctgcaagagggttgggatgtctgggagccctgcattctcccgtgatgttgctgcctggatccctcatctttaaagggagtgccgagcctccctgcaggtgtgggcagtgagagacacaggcggatgtgcatcagggcgctggaggccgatttctttcattgccttctgcctgtggaagagctgagctccctgcttctgtgcacaggagatttccctgtaaatggggagtgagggcaagggtctgtgtggggaagacttgggtgagccttcgtcctggaaataccagggccatgtccaagaggggagtggagccaaagtgtccaggaggaaggtgaaggcagtgtgtgggtgggagtgcacggtcagtgccatggctcagaggccccaggagaggaagagctcaagttgtgggcaggaggaggcagtgggtaggcacaggggggagaaactgaggctctggcagcagaagaggggagggcctgcatgtgcagggttggcctgggaggggtgtctggagggagagacaggggtctgggtggagaccagggtggtgactgcagggacaggaccccaggattgtctgggtgggcggcaagagcagcagggcagaaagggcccaaggcagggtccagtcttctcagggtgtgggctgcagggatgggaccccagggttgtctggatgggcaggaagagcagcggggtagaaagggctggaggcagggttgggcgtccccagggtgtggggtgcagggaggggctgcacaggctgtccccctgaaggagggaggagggaaggagcacagaggtgctgggagcaaatggagagggaagtggcagcgacccgcatgccaggcggtcccggtttggggttgatctgtgtggaatagctccctggcccatgtgtaagtggtcaggggagacatggaggtctggagctacaagcggtggcaggaaggcaagtcctggtcttgggggtctggagcttatcttcttcctgtgaactgagtgtgggcggcacctatgggtggtgccctggacctgtggtctggtggagtccaggcctcccagggatagcagggcagccagggctagaggagcctgaggggccaggtcagggtagccctggggacactgcctccacctttgaccagtgctgctgcggggatctggtcatgagaccccttcacccaggaggggaggcacgtgagtgtgaccctaagtccgtaccctatggggggctctgaccctcctgcatagggcctggacaggggtgggtggctgtgtgcaggtggggagtggggagcccagactctcccagacacagcctgctctgctccagaatgtgggcttggggactgcaggctggctgggtctgggctgcctggtgtgcctgtggtggctgcattcccatatctgggactgaggcctagtgagtaccaggaggagcctgaagggagctccatggaggacctgcctcggatgacacccctattttaagaaggacatggtgtgttccagctgggaggaagggaagtgggccacctcctgggggtcttccacccccaccacctcagcctggggcttctgtgcttcctccctgcgcagaccccaaagtctgtgccgccacagggcaggaaggaagggcctgtgtcctggtcgaggttggggccacagtggtgttccctaagccccagtctgctctcagggcccgccccgcagcaggtcctgagtgagggacagagacggggaggggtttctgatcctggtggactctggggtggactccagtggggagtcatcagggtcggtgtcccccagggtattggggtgaatgtgctcctggagtctgctctggatgtggggtttatgcctgtgctgcctggggttgatgttggggggtgccagtgacccgtttccctgagggactcttgtcggtggtagggtcagttctggccaggggcacggggccatagcagtaggatggggtccagccccttccatgaccccctggagccctggtccccatcctcaccattcagtggggactccgttgtgctctggctgctgggggtcatgtgagctgagcaggacctaggttcggggcggctgttcccctctctggcatggcctccggcagtggccaggagacggttttggacaaagcttttctcacagtggttgttccagttatacccactgtgactcggggctgttcagaatctgcccaggtgccctgagctctggggcctcctgggtgggggctgggcttgtgggcaggatctcctttgggggctctggaggctgtggctcactttggttgtggggtgggcactggaagccccagctagcagaacacccacagagactggggcctgcacacattccgccccagtgtgtggggtgggcccaggcccctctgcgcaggtcagcttcaatggggagggtgctcaggtcctgcttgttttcctctgggttaatgggattcatctcctggccccagatcctcacaggctgcccctgtccctccagcaatgcaggacatggcaggtcaccctggagggaggcatgttctggtctgggtgtcaggtgtggcacctcagattttccatgcatgctgtgggctgagcaggacagcagatgaccccgggcccccaccctgtctatggacattttttgctgcggcaactgtgggagctgacagtgttcacagccacgccacggtcatcatcatagtcaagtctttctaagagtttcattgtgacgaagcctcctattaaatggcacctcggccctgcttcctgagggttactgctgagtcccggatttcccacagaggcgaagagaggagagcaaagggaggaagaggcagatgagctgggccctgcagaagggggtgcttgggttggggtctgtggagcaaagatctgggctcctaggggccacgcagacaaccatcctccctgttcacaccttgaagatcccaacaggagccaggtggggagactgtgaggagagggcctgtgtcttgtcttccttgggccatgggacagggtggaggttgagggcgtctttcccaggggatcacagaacagcacctctgctgtggggggcatctagcatggggggctgggctgtggggtgcagggcaggagggggcatgcatgggaggggtgtggcccagtcattcctgcattcacaatctttcttgtcctgggcacctgcactagaccctggcctggaggggcggcttcctagccttcagcatccctggagtctgctctgactctggacctggggacaggagccaggcaggaggtcagcagcctcctaggacagcaggagggcccaggccagtgcctagcagacttccacgggagaggggtcccaggggcggggagataatgatttctagaagggtctgtgtctctgagtgtgcaagtttgtccaaactgtccaccagctgtgatcaggtaaacacaggcagacctgagttcaggtggaggaaacagttttgtcattaactctctaccgactctaggggaatgagccaagctccattgtcgtctgtgcagaggccacagccttgaaaagggagggggtagagggagcagggagggtgctcggggctcagtcgtcggggaagggaaaatttgcccagtgctggtcagcgtccctgggatggggcccgctgtgtccgtgctggccactgttgaggtcaggattctgtcctcccagagcctggagacacaggccccatccttcccaatggggacacttcagggagtggctctcaggtcccgagaaagaccttcctggccacaggagacacacagacatcaggaagggacagaggaaggatgtgcagttgcagccttttcagcagatgctctgagaatgggaggtcaagagttggagcaaacggtcagttctggtgcattgagctttctcaggcaggtgttgatggggctggggtcagcctaggggtgtgacctgaagccactggaagccttgctggggtctggctctctcttggtgcaggggggtggagggagccctgacaatagagcactggggggcctccaggagaccatccctgcagcagccgggccatgctctgaggatgtgggaagaggacccccactgtctctgagtagagggtggtgacttctttgcacagactggccaggggtcccacaggggcacagtacaggtgtccctgggctgcagggctgggggacatcagagctgctctctgggcttggcagccacctcaggtgggatcagaagggggggcagtgcctggtgcttcccctccaggcctctctccatggtgtccagggtagcttctggggctttggtgccaatttctgaggccagggtcctacccttcctgatgccgtgatgcttggtggctctggaggaagccccagctttggccactcctgcactgcctggggctccagtcctgctgcgccttgaggggaacccagggccccaggcttggccctgtaaggtcagatgggggctgggctccagcatcctgccgctaggtttagttcctaaatgacagggaggcagactctggctgagctcaagacctgttcccaggctctgtgccagagcagggtcccccagcagaggctgtgtggagctgggcagggttcgcactttgtggggagttccctggacctggagactcaaccctcagcctccttgatgatgaatgattcatcctgtgactgtcttggcccagacaatcaggtggcctcctcacctacccctcttcagacagggcctcagacctaaggcaggagcaccccctacaccagacctcctgggtcacaggaaatgcacagacatcgggaagggacggaggatggacggaggaaggacgtgcagttgcagctctttctgcagatgccctgagagaggaggtaggagcacgcttgctgtggtttgaatgcttctctcctccaaaactcatgttgaaatttcattgccattgtaacagtatgaagagtgattaggtcataaggtccccacctcatgggtgggattggcgctgttataaaagggtgagttcggccccctcttgctctctttcttgccttctgccatatgatgacacagcaagaaggtccttgccagatgctcctggacttgctttggactttcccttgctcttggacttgctctggcaccttgctcttggacttcacagcctctagaactgtgagaaataaatttccgttcagtataaacttcccagtcttgggtgttctattacaacatcacaaaacagtctaagacaaccccgtattcagacctaaggtgagataacccctacccatatctaaggatcccctgctccagatcttagtggtgaggtcaatacaggactccctctgagggaagccctgacagcagtgcctgggaaggcatctgtagggcccagtgggccggggaggcccaggacacacctacatcatctctcataatccctccattctgttataacaggagcatatgcttatagcatactttaaaaatcagcccaaaactgaaggtaagcatcagttaattgatggactccttttcacggtttggtctttgtatttacaccacagtcatctcacagtgtgtgttgagctttgcacccttttatcaaatgaggtcaccccatgaatgctggctgtcacgttatcacagatatgtgacaagtataattgggaatgtttgcagaatagtcccattaatgtatgcaccataatttcttcaggcactatcttgctttcaactattttataattataaataatggtctgaagaatgtctgttcacaaagtgttttcctcatgtgtgctagccacttgttttcttttggaaattgtgttatatcctttgctgatttcttaagggatttgttctttttcttattagcttatgtatgttgtttgcctaataatggtacaagacctttacatattagattaatattatttgagtttattatttactgttaagttttgatgatttttaaatgtaaagaatctgtaaaggtgttacctagcttcatgatttgggtatgcggtgaagcctgcccaactttgggcagctgtctgggcctgtgtttccagagcttgaaggagtctctgcttccctctggagggctggtgtgatagtgttctctctccaggcctgggtgccctcctgggtctgggcttgggctgggctcttagatgtctcagaggaattgagactctattaatcaagtgagtctttccatttctggtgagatgatcatgggtcatcattggcctgagtggtgggatgagctataaatagttcttaattcccggtgtaagtccttgttcaatgagatggacagaatttggccttctaggatgtcatttataacatttggctctttgccaaaatgcaagtaacccatgttttactctggggactgtggagtgtgatcccgttcatagacttttccatgtttctccaaatcctggagcagttcttatgggaactgattagttttgtgaaagtctaaacttcacccataaagccatcttggcctgaagtcatctgtgagggcaattatttaataatcttaatgctttcttgaggattattgttccaactacgatttccatttcttcttgagtcagttttaagttttattgctagaaaagaaaaatgccaacttgccgtcatctctgccgtcactattttgtgttcaacaattgccttctgtatctgctgtgtcttccccagcacagaagctgtaatgttattaaacaaagcaatgtatccagatcactcagaatctatgcctgtcacggggagcaggagatgagggtgaatgaagagccagagcatggcaggggagccactgcaaggatgctgaaactcatgtgaacagagttgctgtaggcaggccaccatggaaccttgcgggggaagcactgcctcttaggaatggcagtgaaaatgggagaagagggtggtattgcctccagatagaagatgcagtgctttgccttgctccttggtgcatggagagggaaagggatgctgctataaagttcctggctggactttggcttgataaggcatgggtacctttgggagtatgagggcgggtgggtttgtgcacatcttccacgaggagctgttagtattggggcagacgtttcaagtatggcaaacaaaggatgttctgcatggggaaatgtggtgacatccatttcacaaggacagctcacatagattgagtgctcaggaaggaccagcatcatacccagtgcctgatgtgtatcatctcaattagtccttgcctcaaatgcaaaaggaagccattgccatcttcatcaccaccatcatcatcatcctcctgtgcagatggaaaagctgaggcatagagaggtgacggagtctgcccaagactgcaagcctgctggtggcagagccagattccaatggaatgaaggttgtcatcctcagatggcagggtaggcaagtggctagagctcacttgggagaaggggaaaggacactgacattggctagggatggagcagggcttgggctggctttccatgcacgggcagtgggcctggctcatggctgtgctccagccccgggtgtggacattgaatcttccaggtctaccctaggctatgggtttggacagcactgtgatggaaagaagacgctctatgtcctgcagtctgtgaccaatgatgtgactgtgggaatggcgctggcatctggctgccactctgggacgggtggccagctgccatcaggccctgggatgggaccaccatacgacttcttccctcgctcctccaggtcatgtccacagcccaggaggaccagcaaagcctctcaagccgatggcagctcacgttctgccttgtcagctactcctctcctgggcaacattggctgcttgctgtggctctccctggggtacgtgactgcctctgtgctgggcgcctggcctgggctttccttctgggcctgggcagctgggctcagcttggacccaggcagcagccacagaggggcccatggaggtgacagagttgcttctatgatggtgaacgggcagctgtgacacgggggaggcgaccactccttagtttccaagtgctgcggtcagggccagggccagcaaagtccctcccatattcaaagagtgggtttgggtttgtcccaggaggacatagtcaggagcccatgctgggacatgcctcctccaaagttcagcctggaccccagcctctgccaacggccccgctccttagctaacccagcttactcctgggttccacggcagagtcagatgtttctgggtactttcacctttgtgccttaaagcatgttgaggactttaaggaattgtggagaaatagggctgtgccaaaggcaagtgacaaccgggaacaatgatcccacagaggctgctgaggcctgggccccaggggcgtgagttcatccttctgcctgggctttggtgagaggggcagactctgtggtctgagacacaaaaaaaccccaaaacatacttgtgtacagacacacagcagaggcacacacacacttgggcccatgcacacactcacaggaggctcgtggactccgcacagtgaagaaactcctccggtcgacagtggaaggtgctgcagcagggacccacccccaagccctgcctgcctcccattgcccacctggccctggcttgatgggctcatctcatgctgtggctggggcctcttgcttcctgcaaccccttgctggcctggggcctgggcctctccggggctgtgcctagggtttgtaacccagggcctgtgctggcgtgcacagagcatctctccctgggaggctcagggctgcctcctcgagttctgtgggcctgcaccggctggtgagcctgtggtgtgcatttttgggctgtatccttctacttcctgagtccaggggtcccaggtaccctgcagctgtctcctcagccaccctgtggggccccgagaccttgccctcacttcagtgcccgggtgctccagctctgcccaggtgccaggcgaaggtgtgagcatgagcctatcggacacacctggcaatgtataccgggtgtcccacccctgccaccacggggcctcccaatacggcaaccgccaaggacctgtggggaccaatgaggaaagagagacgcaggtctgggccaggctcacagggactccgccatagcagaccctgccccagcaggcccccttgtccttcctgggccctggtccttcatgaggaactagcccatccctggtggggctcccaccccacttctagtgggctccatgcttgtcttgtcagagtcacccctcaggcagtggcaggatcctctcctttagacccactgtgccttccgggcctcctgggcttctgctggggacagaagaaatgcctccccaggtctgtctctggaggctctgagggagatgggcttgggggctctaggaggaggcagggattccagggtgttaggaaggcaggggtgcaaggtcccacccagtgaagtaacaagccgtgggtggtgacagtgacccagcgccctcgctgcccagccctgcctgtccccagccagcactgcagggaacccagtgaagtaacaaaccgtgggtggtgacagtgacccagtgccctcactgcccaaccctgcctgtcctcagccagtgctgcagggatcccaggcccagactctgcaggccttcactgatcctggccacccagaaaggctgcagcctgcgggcaccagccgggccacatgcccagtgccagctagggcccaccgcccatccttcacacagggctgctgggtaggtgcccctcacacccccaggatgtcagtgctcacctcgagcaaagtgccccagcttggccttgggaggcggtcatgtcccggggcatgatggagagctgtccaactgagagagagggagggagggaaggagggagggaaagagacagagagagagagagagagagaggaggtgtgggctctaaggctgccttagtggagttgtgcgtggcctgcacctcaccaagcctagccactctcaccgctctgagtggctcacaggcttgtgagggccccgtcgctgcctgctgggtccccaccagggctccctctaggaatgcgccatggctgctatgacaatttgcacagcccagtggcttaaacaccacacatttataccacaggtccagatgaatcctacagggccaaggtctaggtgtgctggaggccatgctccctccaggcttgcggggagaacttccctgcctcttctagtctctgcatccctgagctctcggctcctcctccgtcttcagggccagggcgtagcatctgctctctcagcctctgcctctgcttccgacctcatctggcttctgtctatgtcagtctccctctgccatcctcctagaaggacacctgtgattatattagggctcacctctttaatccaggagcacctctccacttcatgattttcagctaacttccttctgcaaagaccccctttccctataagggcacacattcactggtcccggggctaaggaccttgctccaagtccctccacccatgatgttgtgccttccagaaacctgtcctctgcagttcggtcttgaccccaagcctgctggtgacctgaacatcacagggttatccccttgggccgtgtgcagcatgatgcaatttcttggcctgaatgtcatgctccctggggcaggaccttgagcctgcagcacacactaggccacctgcagcctcacaggccatgccctgggtagacagggaggtgctcaaccccagctcgggtcctctagtctgcctggctaccatgcttctcattctcctgcatctgcagaccctgggttgccatgtgaggcaggggtggggtggggctgagggcgtggctttggtccctggctgtccggatgaagcaccagagtgatgacacagcccatcccggtgacatgctcacccccaacccccatgtccgggaccccggtcttgtgtggtccctgatgtggagtcctcagtccttaagatacatccagaaagtcctggccatgaattgggggtgcagagtcctgcagagccgctgggctgggctggtgcccccaggagatggagggtctggtggatgccctcctccctcagagctggggcagctgcctcccaggggtgggaccgtgggctcagagagaggcccttgagctgcagctcaggggagtgtgaggcttcatggagtgtgtcctggtccatgtggtccacgtgtctccatctccaaggagaggctcctcagtgtgcatccccatatccgtcctctctgccggcccccggcatctgagcagtcattccctgtcagcacctctgcagcctgctgggcctcaggttcgctgtgagggacctccccggccttccgcggaggtggagtaagctccgtcaaggcaggtggcttcgtcccttcctgtgagtgacaccagtgatgaaatggacccctccacacaggcatcctcagggcacagggccctgggggcaccttcctcctttcttatttgttgagaaaaaaaagtggcattgggctcacaccaggatgctggtgcagagctgacatgctcgggaaaggtcagaggtcactgggggtgggaaggtcatccagtccagactcagcaccttgtgggctggtaaactgaggctcaaagtgctggtgccaggcctaaggcctcgcggtgactgctgtctctggttcccagcacctgcctgagacctgccccaggcacccataacctggaattccgtttccttgtccagggcctgaggaaatggctccccaggtctgtctctggaggctctgagggagacgggcttggaggctctaggaggaggcagggattccagggtgtcaggaaggcaggggtgccaggtcccacccagtgaaataacaaaccgtgggtggcatttcggcctccctgccttccccactgggtgtgctggtgctggtgctgctgggtcagggctgcccgtgaccccagacaccactgtccgtcctgtgaggctcctgtctgggcatgtcctgggtggattcctcctttctgttaagtagctacatgaggcaggggctcctggatccaaaaaaaatgacaggaattccagagccaggtgcatccactcaggacagccagtgttcgtggagctgcctctccacaagtgaaagtcagcccgcccctctcatgagaaaagaacctgtggatacctctcagcctccagcgttgcaagtgcaaggccagtggagttaatctgcaacgtgcatgagggcatgtgtcagtggctgtgtgcaggagcgtgagtgagcaagagtgagagtgcatggctcctgctgtacctcaaagtgtgggctcctggtggctgctcagcgttcccaggggtgagaggcctcatgcatcctaggctgtctatatatagacacagattttcttctctgtggtctggagcgccgcctggtggtcttgtgcttccctgcagggaggtttgtgtctgggctcacactgaggtacccattctgtctcccacgggaatgtgtggccctgcccttggccatcacggagctcagctgcagggataactgggccttggatgtgtctctgcagatggacagttggcccagaagggtgggctgaagtgtgtgctgcccctggagctgaggtgccccagtgccttcccagagtgctgctgggtccaggcccagaggtctgtgaggacctcaccagccctgggcatgactctagtagctgcacttgatgcaggacactcagggccaagaagcaaagacatgagtcgcaaacggacaccacagcccacagccccagttctgaaatctctgagacactcacatggaagtatagccatcaggcagaggacgacgcagagagatctcatgttttcctcaacaaggggcacgactttcccagtggcctctccaggacagaacaagaaaaaataactggctctctctagcctgaggttgcatttcgccgagtctctgggatggaaatgtgtcttgtgtcttcaggagtctgcagggcagccgctgctgtgactcaggtagaaacttctctcccctgatgtcctggccccttgttatccctgccacggtggaatcagactgggcaccgctttcgggagaaacggaggacatggagtgacggctgggtagtggagactattgaaaggagtcaaaactctccaggggaagagacgcctccaggaacccttggcattgttttcttcacttcgcaggagtaggaaggagctgagagtctagagagagcctcagatgcacaaccctaatttggcatatcagggagcaatctcatcagcccaggagaaggcccaggagaagggtcagctctttgtgcctctgcagagaagcggcagggactgggagggctttttccctgcccagcaggtggtgctgcctccttgttccctgcttggcacagcctcggggtgcagctgctggctttcccagggcctgtggagagcgtcttcttggtacttccttaacgtcaaataaagtgaacgccttctcaatgcacatcttaattcatcattggaaaggccaaaacacacacacacacacacacccctatatttttttctgacaagagctagagacaattgataagtatgttatctgactatagctcaccttaaggaggaaaaaactattaagaaatttcttaagtgtaaattgtgcctaatcatgtgtaaattagtaacagaagcaaaaaataataactgcagtcaacttatacactttaaaagaatactctgtgaaacaatgacatgttatcaaaaaagggatacttaatttgttatgtgtggtgacggtcaatgagcagacttgtgttcttgctggagaagtcacagcatccccacaggtggacttcctgcagcaatcttgcatgcctcacacttctgtccaaagcacgtaagggaggagctcagtgcgcacaggaacctgacgcctgccacccaagggatgcgtgagcttccgtataagcagaagaagatggaaacttcagcacctgcaacagaagaggctttctgctttggggacccaaacagttccatctatggtggaggtgtaggctcattcctacatcaacgtcaacaagccattgaacacaacaacatttaggagtagtcgagcccaccttctccaatgtggcctgcacagcccaggctgcagggtgggagaggttgattctggagaaaagtcattcctgctcccctggtacactctcctcccccactgcttcatacagagaccaatgtgatgatgccatcatgatgttgaagcacacactgaaccctgtaatcaattaaagggttttcccatccacccatccacacacacatccacccatccactcacccatccatccatccatcacttatccatgcatccatccacccacccagccatgcattcatccagccatcccacaatccacccacccacccacacatccaaacatccatccactaattcatgcatctgtccacccatccagccatctgttagcaggagcgaatccatacaggtctgcagcaacttgattcttgcctccttggaggaaagaatttggccaaggggcatgcagaagagtgagagacccaagcaagttttagagcaggagtaaatgtttattaaagttttagagtgggaacgaaaggaagtaaagtacacttggaagatggctaagtgggtgacttgagagatctaagtgctctgcctggcccttgacttggggttttatacattggcatggttctgggatttgtatttcttctcccttgatttttcccttggggtgggatgtccacatgtacagtggcctgccagtgcttcggaggggccgcgtacacaatgggtttaatgaaatgtgcacatgctcatttgaggtgtttttctcttacttttagagtgttcctagaggaagattatgtgccagttaaactctgccactttgcctcttagtgcatatgcttgagcccactcatccaactcctgagatcttatcgggaagctgctgatgaccagtttcgggtgttttctatctattgggagactgccttttcttggtgcccgctgagatcaattattattatttattattattattattatttgagacagggctttgctctaccaccaggctggagtgtggtggcgcaatctcagctcactgcagcctctgcctcccaggttcaagcaattctcctgcctcagcctcccgagtagctggaactatagatgcacgccaccacgcccagctaatttttgtatttttagtaaagacagggtttcgccatgttggccaggatggtttcgatctcttgaccttgtgatccacccgcctcagcctcccaaagtgttggtattacaggcgtgagccaccatgtccagccgagaccaattattattttagagaggcagtttaacaatcacttgactatcagctcatgcctgcctaactacccactctaatacatccatcccttcacatacccattcatccatccatccatccatccaaccatccactcacttatctatccaagtactcatccatgcatgtagccacccacctacccactcattcatccacccacccatgcatccatcaacctacccatccacccatacatgcatccatctatctttccactcttccatccacacacctactcagccattcatccatccatccatccatccatccatccatccactaatccatggttgggtccatctgtctgtgcggcaaacatgcaaggataagttccatgtgacaagtctgaactcagtgttggaatcatgggaggggcaaggtggaacaggctggcttcctcaccactattaacactgtggggagaaggccgatggcaaactcacttccatgttaagtttcctgaaagaggaaggggagtgtaatgctagagagtaatggaagctcccactgttgacacagaggtaataaatgcctgtctgatgagctaagacctgcaggaacagaaacagccacatgaaaacaaggcaggaaagaggcctatggcagaagagcagctgctgaaagttcccttaggttgggcaaaactgctatgttttgaggaacttagaacagtccaagggcaagctaccgccctgtgtttctcctcttcccccgtgtctgtctgtgttccacagtgattgtgcaaactctaaatacattgatgactcaccattgcctttatgttagaataaacaaaacagaaaacaaatccctgatgaccccacaggttgccctctttcactttgtatctctcatttctgcctctctctctctctctctgtctcccttcatctggcccatctctctgtatatctttttgtcttattatttcaacaaagtctcttagggtccatctactgtgctggaaactttcttctcaccaaccattgtaagttggagaatgttttctccaccttattacaaaatgttatagctaattctcttactgcagaataatctttaatatgggtgccctgtttttagaatttaaaattagtatcaattgccattttttcacaattacaattagtattttacaaatgagttttgtaacagggcagggcattaatgaattaaattactctgtaataggaatgagaaattttattttaatatttttgagacagagtcttactttgtctctcaggctggagtgcggtgatgtgatcttagctcactgcaacctacacctcttgggttcaaacgattatcctgcctcagccccccaagtagctcggactacaggtgcacgccaccatgcccagctaatttttgtatttttggtagagacagggtttcaccatgttggccaggctggttttgaacttctgacctcaggtgatccacctgcctcagccttccaaagtgccgggatacaggcatgagccatcatacccagccaagaaattttatttttaatggaccctcttagatagttattaataatggcagtatcaaaatacatgcaattatgcatatggaagtagcttttttcctgcaaactcaagaatatttcaaatcatcttctctttattcttttgaattacatgtgtgagaaacagattataagtatttcatgtcattttcccagacatcactataagcatcaagtaactattcacatgtgtgccagcgatttatcatcatactcatgagggttttctatttctagaagttgcccattttttgatctcttctttgctttttccttcttgtaaatgttggacttcttaattcttttctaatgctgcagatcctcctagggaaggattctctacagtactacatgtgttagaatgttgggtgaaaaattatacatggtttaaataatgaatgagccccaaaaaaagagctggatgttgccaggtgctaggaatagacaaaattaaaaagggcatttgaattgagaatgaaacctgaatgccccttgcatttctgaggtaggtttaacatacacaggacaggagcagccttgtgtgacttctgggactggagctgaggtttctgctttagtagagaggttttttttttaataattagtttctcttttgattgacacataaaaatgacctatatttattctgtacagcataatgttttgtaacatgtctacataggggagtggctccactgagctaattaacatctgtatcactcacatactccccatacggctagagaggttctaagttggcttcagccatgacgtcaggtgagaaacattccccatgaagagcagccctggacatggtagaaaagcaaaccccaagccctcgctgttcacaaagtggtcctagtgtctcacccaccatctggagctgcaacactgagctaggaaatcaccgccgtggagtgccactggcagcgcacaggtcccagcagcccggaataaggcgccatccacagatgcctgctcccggcggaccacagctcctgtggtgaggtctcatacatagaaaccatgtgatgagcatgggaaaagcctgttatggcattctgaaggccacaaagagggaggtaaacctctagagatgacagatacttcaagttactttctgatttttctaaaattataaaatagatcaacaaaaagctagagaagaatgaataattcaagaacagattttaagaaagaagaactttctgatgtgtgaaagtacccaatatgcattatcataattgtaggcattgagctctcaatgaaagaatgacctcacacttgacactcagaaggggataaataatgttggacagattgccaaagtgctctaggaagaaaataatccatctttaattttacaataccactctttctacaatgatagcaaaaaaaaatccagatacaaatggcaggaaagtggagcatacagtttcttgctgaagctgctgttgatgaatgtgcttcacttgcacgatctcagctgtgcatagtgtgtggccagtggggagcagtgcttgtgggtggctgaataatgcatcccccaaatgtttacattcaaactcccagaacatgtggatttgtgacctcatatggcacgaggaactttgtagatgtgattaaattaatctcgagaggggagaatatgaccctgcattttctgggtgggtatgacataatcacaagggtgcttataagtggaagcaggagagccagagtcaggggaagggtgatgtgatgatggacacagaaatgagaggatggcctttgaagatggaagaaggggacacagagcaaggaatatgggttctagaatctggaaaaggcatgaaaacagaatctccctcccagggttcagaaggaaccagctctgccaacactttgcctatagactaataaaaccgcaggacaaccaagaaactgctctttcttacatagaacacagtcagtatgctcacatgacatgggtgggtttgagagttaaaggagactgcaaggcctctgggtgaaacagggcaggaatcaggtggagcaagagggtgggtgggcaggacctgattttcaggagtgtaaatgtgaggcactgatgagatttccaggtggagacagagggaggagttatgtgttcaggtctagagtggagctggtagcttggtctgggcctgagaaaggagggcatcctctagggattgagagtaggaaaaaggaagagtggattagtgctaagaactaagtgggagatttctggaggtttcagctcacagagccagcaatggcttatggttggggtttgtaaccccagtcactgaaagtgtcctcccagcctttctttgcatatgcccctggggctgagttcctgcgttgggtggtcacttaccattccctaagaggccctaagcacctcctgcagcccagcaactcctggaccctctggagaggaagtttgtgtttgtgtttgcttatggagcccggctgcagagaaaacaagttttgtttttttttttttcgaaaggatctcactctgcctgccacccacactgaagtgaggtggtgccatcatagctcagtgcaacctcaacctcctggcctcaagccaccctcccaccttggcctcccaaagtgttgcatttacaggtgtgtgccaaggtgcccagtcaaaaacgggttcttggctgggcactgtggctcaagcctgtaatcccagcaccttgggggtcaaggtgggtggatcacttgagcccaggatttgagaccagtctgagcaacagactgtgacatgaccatttagcctatgcaaatgtggggctggttaaatggtctatgtggggctgtcgccttgtctttgcatctgtcactgaggccagaagtcagcagggcatacatttcggaaggaaagacagtgggcaagctgaggtggacagaggcatccacagggatgggttgggacacatgaaggcaggtgaaaccatgttgtctctcacaccctttcaagggtctcagagacttgatttagaatttagatttttgagaacatttgttatagatgctaaaaggctcaaaatatttgatcaaaacagaatcacaggccattgtaaaatgatagttactaatttaaccaaagtggtaattaaaaagactttggaggtgagtcaagatggctgactagatgcagccaggaggaacatctgccatggagggagtgagacatcaggaagactggtgctttccaagcagatctttaaagggaaggcattgagagtggactgagagatgccgggctgaaggtggaggaagatgggaaccctgcatggggatgccgagcaccaggactcattcctggctcccagcaactcctggggaaaggttgagttgaacaggtgaggagtggcctgctgttgccatgggcctccagaatcctagcagcaggagaccccatgacccccatggacacttgtgctggcagggacagctgcttagagggataccaagggtaggactccagtctgtgtaaagcccagagtgtttgacatgagaatggctgtagtggagcacagccaggtgacacccatcccccaaggctcaccaacctcctctaggagattttaaccttagagtgactattggagctgaatatagcagggtggtcttgtccatgggacagggtccatctgaaatgagcatttccttgccttctggcctctcctggggccccaggctggctgtgcctgcttgcagtacagccttggaagcccaaccagggtgtttcctgggggccctcatcatagctcctttgccagcagaccatgcctaaccattggggacctccagcaagccagcctctgctgatgtgcaccagtccacccatagcacctcccaactgctttgctggcatgagtgcacagcggatcacaactccctctaccaccagcaagcatgtgcatgtgcaccccgccaccctgtccctgccaacacacaggcacctcactgtcctgtgactgccagcaggaacctatgtagggatgctgccaccctgctcctgccagtacccccaccccagcagaggcatgtgcaccctgccatgacaccacaactgctggcacctatgagtgagaatggatcccactgccaccactctaatgaagtgctttggccggcaccacctactatagtgttgtggccagtggactgggaaaaactcagcccctccaatgcagcaagtttctaaactcaaggggccagagaataaagccaggggcccagtcccagagcagagaacacaccacaagagtgctgaggtcagcctggaccccctaagattttcaagaaacacagctaactgaacccactttataccacaatcaaacctgcaagagtatcaaagaagataagagcaaaaaacaaacaaatgaacaaacaaacaaaaacacacaccaaaaaacaacaaaaaagaaaaaaacatccaaaggacagccacttcaaagattaaagaaacagcccacaaagatgagaaagaattaatgcaagaaactctgcaactctaaaatccagagtgtcttcttacctccaaacgaccacactggtttcccagcaatggttcttaacctgactgaaatggctgaaatgacagacatagaattcagaatatggataggaaagaagataactgagattcaggagaatgttgaaacccaatccaagggagctaagaaataaagtaaaatgatacagaagctgaaagatgaagtggccattttaagaaagaatcaaaatgatttgatagagctaaaaaactcacttcaagaatttcagaatacaactacaagtattaaccgcagaatagaccaagctgaggaaagaatcacagagcttaaaaactgattctctgaattaactcagtcagacaaaaataaaggaaaagagaacaaaaaagaaggcataaaacctcagagaaatgggtgattatgtaaaaagatcagacctatgacacattggtatcccttaaaaagagaaagagaaacaaagcaacttgaaaaacatttcaggctatcctccatgaaaatttctccaacctcaccagagaggccaacattcaaattcaagaaatgcaaagaacctctgcaagatattatacatgacaaccatccctaagacatatagccatcagactcttaaaggttgaaaggaaaaaaaaaatgttagaggcagctagaaagaaggttcaggtcgcatacaaagggaacccaatgaggctaacagtggatgtttcaccagaaactgtacaatccagaagagattaggggcctatattcagcattcttaaagaaaagaaattccaagcaagaatttcatatctagccaaactaagcttcacaagtgaaggagaaataagatccttttcagacaagcaaatgctaagggtattcatcaccactatatttcccttacaagaggtccttaagggattgctaaatatgataatggaagaatgttactgaccaccacaaaaacacacttaagtacataacgattgccactataaatcaactatacaatcaaatctgcatattgagcagctaacaacatgataacaggatgaaatatgcacatatcaatattaatcttgaatgtaaatggactaaatgccccaattaaagggcacagaattgccaagttggataaagaagcaagacccaaatgtatgctgtcttcaagagacccatctcacatgcagtgacatccacaggctcaaagtaaaaggatggagaaaaatcaacaaagcaaatggaaaacaggaaaaagcaggtgtttctttttttttaatttttttattatactttaagttttagggtacatgtgcacaacgtgcaggtttgttacatatgtatatatgtgccatgtttgtgtgctacacccattaactcatcatttaacattaggtatatctcctaatgctatccctcccccctccccccaccccacaacaggccccggtgtatgatgttccccttcctgtgtccaagtgttctcattattcaattcccaccaatgagtgagaacatgtggtgtttgctttttgtccttgcgatagtttggtgagaatgatggtttccagcttcatccatgtccctacaaaggacatgaactcatccttttttatggctgtgtagtattccatggtgtatatgtgccacagtttcttaatccagtctatcattgttggacatatgggttggttccaagtctttgctattgtgaatagtgccgcaataaacatatgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctacacatcttctccagcacctgttgtttcctgacttttaaatgattgccattctaactggtgtgagatggtatctcattgcggttttgatttgcatttctctgatggctagtgatgatgagcattttttcatgtgtcttttggctgcataaatgtcttcttttgagaagtgtctattcatatcctttgcccacttttaatggggttgttcgtttttcttgtaaatttgtttgagttcattgtagattctggatattagccctttgtcagatgagtagattgcaaaaattttctcccattctgtaggttgcctgtttactctgatggtagtttcttttgctgtgcagaagctctttagtttaattagatcccatttgtcaattttggctttggttgtcattgcttttggtgttttagacatgaagtccttgcccatgcctatgtcctgaatgataatgcctaggttttcttctagggttttcatggttttaggcctaacatttaagtctttaatccatcttgaattaatttttgtataaggtgtaaggaagggatccagtttcagctttctacatatggctagcctgttttcccagcaccatttattaaatagctaatcatttccccatttcttatttttgtcaggtttgtcaaaaatcagatagttgtagatatgcggcattatttctgagggctctgttctgttccattggtctatatctctgttttggtaccagtaccatgctgttttggttactgtagctttgtagtatagtttgaagtcaggtagcttgatgcctccagctttgttcttttggcttaggattgacttggcaatgcgggctctttttgggctccatatgaactttaaaataattttttccaattctgtgaagaaagtcattggtagcttgatggggatggcaatgaatctataaattacattgggcagtatggccattttcaggatattgatccttcctacccataatcatggaatgtttttccatttgtttgtatcctcttatttcattgagcagtggtttgtagttctccttgaagaggtccttcacgtcccttgtaagttggattccaaggtattttattctctttgaagcaattgtgaatgggagttcactcctgatttggctttctgtttttctgttattgggttatagaaatgcttgtgatttttgcacattgattttgtatcctgagactttgctgaagttgcttatcagcttaaggagattttgggctgagacgatggggttttctagatatacaatcatgtcatctgcaaacagcgacaatttgacttcctcttttcctaattgaataccctttatttccttctcctgtttcattgccctggccagaacttccaacactatgttgaataggagtggtgagagagggtgtcgctgtgttgtgccagctttcaaagggaatgcttgtagtttttgcccattcagtatgatattggctgtgggtttgtcatagatagctgttattattttgagatacatcccatcaacacctaatttattgagagtttttagcatgaagcgttgttgaattttgtcaaaggccttttctgcatctattgagatatcatgtgttttttgttgttggttctgtttatacgctggattacgtttattgatttgtgtatgttgaaccagccttgcatcccagggatgaagcccacttgatcatggtggataagctttttgatgtgctgctggattcagtttgccagtattttattgaggatttttgcatctatgttcatcagggttattcgtctaaaattctcttttttttgttgtgtctctgccaggctttggtatcaggatgatgctggcctcataaaatgagttagggaggattccctctttttctattgattggaatagtttcagaaggagtggtaccagctcctccttgtacctctggtagaattcggctgtgaatccatctggtcctggactttttttggttggtaagctattaattactgcctcaatttcagagcctgttattggtctattcagagattcaacttcttcctggtttagtcttgggatggtgaatgtgtcgaggaatttatccatttcttccatattttctagtttatttgcatagaggtgtttatagtattctctgatggtagtttgtatttctgtgggatcagtggtgatatcccctttatcattttttattgcatctatttaattcttctctcttttcttctttattagtcttgctagtggtctatcaattttgttgatcttttaaagaaaaccaactcctggattcattgattttttgaagggtgttttgtgtctctgtttctttcagttctgctctgatcttagttatttcttgccttcttcgggcttttgaatgtgtttgctcttgcttctgtagctcttttaattgtgatgttagggtgtcaattttagatctttcctgctttctcttgtgggcatttagtgctataaatttccctctacacactgctttgaatgtgtcccagatattctagtatgttgtgtctttgttctcattggtttcaaagaacatctttatttctgccttcatttcgttgtgtacccagtagtcattcaggagcaggttgttcagtttccatgtagttgagccgttttgagtgagtttcttaatcctgagttctagtttgattgcactgtggtctgagagacagtttgttataatttctattcttttacatttgctgaggagtgctttacttccaactatgtggtcaattttggaataggtgtggtgtggtgctgaaaagaatgtatattctgttgatttggcgtggagagttctgtagatgtctattaggtctgcttggtgcagagccgagttcagttcctggatatccttgttaactttctgtctcgttgatctgtctaatgttgacagtggggtgttaaagtctcctatgattattgtgtgggagtctaagtctctttgtagatctctaaggacttgctttatgaatctgggcgctcctgtattgggtgcatatatatttaggatagttagctcttcttgttgaatttatccctttaccattatgtaatggtcttccttgtctcttttgatctttgttggtttgaagtctgttttatcagagactaggattgcatctcctgcctatttttgttttccatttgcttggtagatcttcctccatccctttattttgagcctatgtgtgtctctgcatgtgagatcggtctcctgaaaacagcacgctgatgggtcttgactctttatccaatttgccagtctgtgtcttttaattggagcatttagcccatttacatttaacgttaatattgttatgtgtgaatttgatcctgtcattatgatgttagttggtcatttggctcattagttgatgcagtttcttcctagccttggtggtctttacaatttggcatgtttttgcagtggctggtacaagttgttcctttccacttttagtgcttccttcaggagctcctgtagggcaggcctggtgatgacaaagtgtatcagcatttgtttgtctgtaaaggattttatttctccttcacttatgaagcttagtttggctggatatgaaattctgggttgaaatttcttttctttaagaatgttggatattggcccccattctcttctggcttgtagagtttctgctgagagatcagctattagtctgatgggcctccctttgtgggtaacccaacctttctctctggctgcccttaatatttttttttcatttcaactttggtgaatctgacaattatgtgtcttggagttgctcttctcgaggagtatctttgtgacattctctgtatttcctgaatttgaatgttggcctgtcttgctaggttggggaagttctcctggataatatcctgcagagtgttttccaaattggttccattctccctgtcactttcaggtacaccaatcagacatagatttggtcttttcacatagtctgatatttcttggagggtttgtttctttctttttactcttttttctctaaacttctcttctcccttcatttctttcatttgatcttcaatcactgataccctttcttccagttgatcgaatcagctactgaagcttgtgcattcatcacgtagttctcgtgccatggttttcagctccatcaggtcatttaaggacttctctacactggttattctagttagctattcatctgatcttttttcaaggtttttagcttctttgcaatgggttccaacttcctcctttagctcggagtagtttgatcatctgaagccttcttctctcaactcgtcaaagtctttctccatccagctttgttccattgctggcgaggagctgcgttcctttggagggggaaaggcactttgatttttagaattttcagcttttctgctctgtttttcccccatctttgtggttttatctacctttggtctttgatgatggtgacgtacagatggggttttcatgtggatgtcctttctgtttgttagttttccttctaacagtcaggaccctcagctgcaggtctgttggagtttgctggaggtctactgcagaccctattttgctgggtatcagcagcagaggctgcagaacagcgagtattgctgaacagcaaatgttgctgcctgataattcctctggaagcttcatctcagagaggcacccggccgtgtgaggtgtcagtctgcccctactggagggtgcctcccagttaggctacttgggtgtcagggacccacttgaggagacagtctgtccattctcagatctcaaagtccatgtgggagaaccactactctcttcaaagctgtcagacagggacctttaagtctgcagaggtttctgctgccttttgttcagctatgccctgcccccagaggtggagtctacagaggcagacaggcctccttgagctgcagtggactccacccagtttgagcttctgggccactttgtttacctactcaagcctcagcaatgatgggcacccctcccccagcctcgctgccaccttgcagtttgatctcagactgctgtgctagcaatgagcgaggctctgtgggtgtgggaccctccaagacaggcatggcatataatctcctggtgtgccgtttgctaagaccattggaaaagtgcagtattagggtgggagtgactggattttccaggtgccatccatcaccacttcccttggctaggaacgggaattccctgaccccttgcacttcctgggttaggcaatgcctcaccctgcttcagctcactcttggtggtctgcacacactgtcctgcccccactgtccaacaagcccccatgagatgaacccagaacctcagttggaaatgcagaaatcacccgtcttctgcatagctcatgctgggagctgcagactggagctgttcctattcagccatcttggaactgccccctcatagattcttgatattagacctttgtcacatgctgatgtggttttgctctgtgtcattaaacaaatctcatctcaaatagtaatcctcggccgggcgcggtggctcacgcctgtaatcccggcactttgggaggccgaggcgggcggatcacgaggtcaggagatcgagaccatcccagctaaaatggtgaaaccccgtctctactaaaaatacaaaaaattagccgggcgtactggcgggcgcctgtagtcccagctacttgggaggctgaggcaggagaatggcgtgaacccgggaggcggagcttgcagtgagccgagatcccaccactgcactccagcctgggtgacagagtgagactccatctcaaaaaaaaaaaaaaaaaaaaaaaaaatagtaatcctcatgtgtcaagggatggacctggtgggaggtgacttggtcatgggggtgatttcccccatgctgtcctcatggtctcctgatagtgagtgagtgctcatgtgatctgatggttttatcaatgtatggtggttcctccttcattccctctctctctctttctctctctctctctgtctctcacctgctgccatgtgtcacatgcctgcttccacttccaccatgattgcaagtttcctgagcccccaaccctaaccacacagaactgtgagtcaattaaacctcttttctttacaaattacccacttttgggcagttctttatagcactgtgaaaacagactaatatagtaaattggtaccaggagtggggaactgttataaagataactgaaaatctggaagcaactttggaactgggtacctcctgacagaggttggaacagtttggagaacttgaaagaagaggggaagatgtgggaaagtttggaacttcctagagacttattgagtggttttgactaaaatgctgatagtgacatgaacagcgaagtccaagctgagctggtcttagatggtgaggactaaactctgattttttttttatcttgcccaaattcctatctaaagagtctggggaggcatgctctacaaatcataaattctcatcagataggttttatttaaacctatatatcatgatttactttccaaactgactctggcataacattatgagacaaataagaaaatcaaaatattttaccccaaaacatgtttctttgccatactctgagatggccctgcaggctgggcatggtggctcatgcctgtaatcccagcactttgagaggctgaggtgggcggatcacctgaggttgggagttcgagaccagcctcaccaacatggagaaaccctgtgtctactaaaaatacagaattagccgggtgtggtggtgcatgcctgtaatcgtagctactcaggagactgaggcaggagaattgcttgaacccaggcagtggaggttgtggtgagacaagatcgtgccattgtactccagcctgggcaacaagagcaaaactccgtctaaaaagaaagaaagaaagaaagaaagaaagaaagaaagaaagaaggaaggaaggaaggaaggaaggaaggaaggaaggaaggaaagaaagggccctgcaaagctgttctttgtgggggaaaatttgcatctgtaaagaatctctattaacatggctagatctttttcttctagaacctcccaatcctaaagagttgaactaagatctgaataggaaacatttgtcacctattatctctaagggcagccactataagacttcaaaagaactttggactctagaatctttatcttaacctgaacattacctttctatctatcccaggtctttagacaaactcaaccaattgtcaaccagaaaatgtttaaattcaccaatagcctggaagccctcgctttgagttgttccacctttctggaccaaaccaatgtatctcttaaatgtatttgattgatgtctcatgcctgtataaaaccaagcttgatggaatttttccctgccctagaaatctgtggaactttgcccttgagagagatgatctgaaataggaacttatgtttaaaagggaaacagagcataaaagtttggaaagtttgcagcctggccatgtggtagtaaagaaaaacacatttgctagggagaaattcaagttggctgcagaaatttgcataaataatgaagagatgaatattaataaccaagacaatggggaaaatgtttccaggccatgtcagagatctttgcagcagcccttccaatcacaggcctggaggcctatcagggaaaaatggtttcatgggctgggtccagggcccagctgctctttggagccttgggacttggtgccctgtgtcccagctgctccaggtctagctgtggctaaaaaagtccaatgtacagctcaggccattgcttcagaaagccccaatcattggtggcttctacatgatgttgggcctatgggtgtgcagaagagaagagttcagctttgtgatcctctgcctagatctcagaggatttatagaaatgactggatgtccagccagaagtctgtgccaggggcaaagccctcatggagagcctctgctagggcagtgcagaagggaaatgtggggttggaacccccacacagagtccccaccggagacagtgactaatggggctgtgagaagagggccaccatccttcagaccccagaatggtagatctattaacagcttgcactgtgcacctggaaaagctgcaggcactcaatgagagcagccaggagggctgaactctgcaaagcccatgagagcagccatgggatcagagctgcaaagccacagggtgagagcttcccaaggttgtgggagcccccactttgcataagcatgccctgaatgtgaggaatggagtcaaaggagattattttgaagctttaagatttcatgactgccccactggagtttgggcttgcatgtgacctgtagcccctttattctggcccatttctcccaactgaaatgggagcatgtatctaatgcctgtacccccattttgtcttggaaataactgacttgtttttcattttacaggttcatagatgaaagggacttgccttgtctccaatgtgactttggatttggacttttgagttaatgctgaaatgagttaagatgttgggggactgttgggaaggcacgattggttttgaaatgcaaagaggacatgagatttgggaggggttggggtggcgtgatctggtttggctgtgggtctctacccaaatgacaccattcctcagggtgatcagcgagctacctgatggcaggttggattatattggacctcttccatcctggaaagggcagaggtttgtcctcactgaaatagacacttactgcagatatgcatgcaatgcttctgccaagactaccatctgtggagtcatggaatgccttatccactgtcacagtattccatatagcattgcctctgaccaaggcactccctttacggctaaagaagtgtggcagtgggctcatgctcatgggattcacttgtcttaccatgttccccatcatcctgaagcagctggattgatagaagaatggaatggcctttcaaaatcacaattacaatgccaactaggctccaatactttgcagagctggggcaaagctatccaaaaggccatgtatgctccaaattagcatccaacatatggtactgtttctcccatagccataattcatggatccaggaatcaaggggtgggagtggaaatggcaccattcaccatcacccctagtgatcccctagcaaaatttttgcttcctggtcccatgatattacattctgttggcctagaggtcttaattccagtgggaataatgctgccatcaggagaaacaacaacaattccattaaactggaagttaagatttccacctggccactttgggccactcctaccttcaagtccacaggctaagaagggagttacagtgttgactgggctgattgacctgaactatcaagatgcaatcagtctattactccacaatggaggtaaggaagaatatgtatggaatacaggagatccattagggcatctcttaacattaccctgccctgtcattaaggtcaatgggaaactacaacagcccaatccaggcaggactacaaatggcccagacccttcaggaatgaaggtttgcatcactccactaggagaaaaaactctacctgctgtgatgcttgctgaaggcaaagggaatacagaatgggtagtagaagaagtagtcatcaataccagctacaaccacgtgatctgttgcagaaatgaggactgtaattgtcatcagtatttccttcttcttttgttaaaaacatgtttgtgcatgtacacacttgtactaagaaaattccttcattttatttcttttttcctttatcatgtgacataaaatttattgacttcatatcagcatttaagtgttcttaactttacataatagcacttgggttggggattggtgcatttctggttgtacaaaagatagttgtattacattaggtgtaattatgaccttattattgtctttatttgaagattatgtatgatctcaggagattcgtatgggttcaagttgacaagggttggacttgtgatggttaatactgagtgtcaacttgattggattgaagcatgcaaagtattgatcctgggtgtgtctgtgagggtgttgccaaaggagattaacatttgagccagtgagctgggaaaggcagacctacccttaatcttggtgggcaccatctaatcagctgccagtgtggccagggtataaagcaggcagaaaacatgaaaagactagactggcttagcctcccagcctacatctttctcctgtgctggatgcttcctgccctcgaacatcagacttcaaattcttcagctttgggattcggactggcttccttgctcctcagcttgcaggtggcctactgtgggaccttgcagttgtgtgagtttaatactcctcaataaactcctacatatatataatatataatacatattatatattatatatatacatactagggttctctagagggacagcactagatatatatatatatatagtttccatagtctgtggtgtaaactatgtgaaatggactttacaacctcctgaagggtaacacccagactgtcacctgaactccctgaaatcctgtgccctggggattggagaaaccttaaaaccaaagccagtgttaagttagctcagtctttgattaaacatggcaatctccctatacttggcttccaggggtgggtgagggagaattcctgcctggaacaaggtcgcattacaaagaatcttcacaatgctcatgagacatcttggaccttccatcagaagcattcaggatggcaggagactggacatgatgagcaaacatggggagaggaggaaggaaacagagaatggaaggaggtgacagctgacaaggccttgtgttcccagatgctgagtgtgaaatgaagcgtttatgatgaaggaaacagaacagatgtacggtacaatattaaatataaaacagtaaattacagcaggtggcttcacagcagcttagacacagcagaagagaagaggatggaattggaagatcgatgctcaggacggatgcagagtgaagccgaggacccggcaaagaggatttgggagttgcaggctctggcagaggacccaccccagaaagagagaaggagggggtgggaggaagaaggaatgtttgaaagtgctccatagagaaccaggacagccccttgggccaagcaacccacgacccttgcagcttcagaagtccagactccagcctggcctcacatgctggttggtcttatccctgccaggccagaaccctcttcagaacccagagcccccacagctctccctcaccctattcccaggacatgtctcctgtgtactcttccctggcccacaggtgggagtttacacctgcttgggtagcctcggcatccacaccaacaacccggtagcagttgtcctgctccctccacctggcacagctcgaatctcccacagtgcaggccccgtgtataggagtgattaggacacacaggagggcaggtcaggacaacaggtgctgaggcaggcagatttcgaggatttaagtgctgatgctcttggaagaccatttccatggggttaattgtggtttttcttggtgaactgttggcttgtttttgatattgttgttgctctaaatagtgtttacctggcttcaatacaaactctattggtcatgttctttgttaaaatatgtatcattctaaaagttcacatggcattagattttttgctcaaactacctataatatttctccaacagagtgcacatttgccttccttctgcacataccaccgccccctgcgctgagcagtgtcccagtgggtccatctgtttagggggtgaggaaggggacacaggccctgacacaatgtggggctgtgccaagcttggtggtcttgcacgggcactgagtgggtgggccctggagagaggggaggtcattcccccagggaaccccccaggccacagggaagaggtcagctgggtgcatgaggtggagggtggagatgcataaagggtgggacggggcctgctgttctatcagcaaaacccctcacacccgaaggacacacagggcgagggcattgtattcactgacctcacacttcactgtccattagcgttcacccacaaaataatagaacaccctgagagaggcacaggaatgcattactcgcatttttatgacagctgaatggaggaaatttctaagcaggttcagagaaaggatatcaagctgtgtttggagaaaggggtgggaattctaaacaatatctgtggaagcaggacatctagaaccacagatgtattcagaaaaatgctagatctcagtactactctagaataccagcagttttctgttgatggtatgggaagggtgatatcttccgttggtgggctttgcctttgacattctctgtgacatatctacactgcattttaaacgtcaatattattgtgaattgtaagttaaaataaaatgttatctcattcagttatttatacatttaacttccattttcctttacaacaacttagcgacacacctagccctgttttccacccagaccagcctgtgctgctacaagcctggtttctcttcctcatcatgacttactcagcttcccttcctgtttcagttcaagaaaatgtgggggcaagaagaaagggggcagctgccactcacagagctcacactaaatgacagacagcttgccctcacgtctacctatttttctagttgaatttcattgcttgcagcaatcaacctgagggattcattttcccacatacgggaagctcggccccaggtagggggatttgcttggtgggggatttgaacccaagtccctctcactgcaaagcccacagcacccctgtaaggaacagacagggaacagggagtagccctggatcaccctaaactgacttcgggtttagagaaggactgattacctggggaatgaggaagcttattgctctggagctctcttctggagaaatgtcatgaacgtgccctgtaaggagctggtggcaacttccgttaattccgggaccagcgacctcaggtcaagagccagatgctcattcatgtctctccaggccagaggttctggccaagtttgggctcccagaggagtctaagaaaatgtggaaggcaccaatgtgtgtttttgaagatttatttcagagtgaacatcagcgacctacaagaacctgggatagaagccaatgcctcccctttccctgtgacgtgagacaggaccatgtgcctcctgtggacttcaagaaatgtggacttgagctttgccatcccttcgcctgatcctatttcatagattttgctgttatattctctgtatctttacagggatcgggaggctgaattagtcttattcagggttagtaactgtctcttcctaaccggtggtggtcctgataagtttgcacatttgtggctgtcccaaagagcagtgcaattatgaaggtgtaaatacgaccaaagaccactctcagatacatctctgattgttggctttgtctgagagaacatgttctttttggaggtggcccgctgtcgacactcccaccagcacctcttcttaggcacagtggaggatcccagcctatatggcaatggcagttccttctgttgttgcagacccctctatgactgcacttctcaaggcgacagtcgtagcccagtgaagtgatagttgcattgcaccgggtgttattacagaagtttccatgaacacaaggagtgccatctatcacacgcccaacctcagtcatgtctgttgcatggtgttcatccagtctaaaacactgaaaccctcctctcactgagtgatggaatgaaacatgttcctgcagctggggaagatgggtcacattggtacactgcagtcctccacaaaacttatctattcctgtacaagcctggtagctgagatatgtttgttgtctaatacaatgtccaaatcggtagctttcaagatttatgtcatagcagacctcaggagcatcctcagcactgacaccaaacatcgccttgcagagcacattgcggtcagtgcagttcccatgataacagtagccttcttccatgcacagggttccatcttgcatataaaagtttgctgggcatgtcacggtggtcccgtgacagtactctggaaggtcacatatattttggataggtctgcagagagtccctggtggggagaagctgaagtttgtacagcactctcctatatgacaggtgctccccggtgttaagtgacagtcactttggcagcaataactggcataacactgcttgaaggagccacagtcacattcctccctcccctccactatgaggtttccacagcgaaccattgtcatggtttcgttatacacaggagaaagtgttttgaaaacacaccggcctggacgtataaaacaatttcgtgcatgtccataagaacagttactgaatgcatctgtcatcccaggaaatctctgcataatgcaggaggcccttctttaacatgtgcagtagttatcatcatactccagaccaatacttctcatctgtgtctgggttattatgatggctaccaataaataatgtctgcctagagtaccaatgtgtaataggcctaaatgtgtacagaagctatacctttcaggttcatagttggattcatgtggtgcgtctttaataagtagtgtggatgaatgaacatgaaaagtatcagaaaaggttgttttaaaataggtaaacattgcactctgaattcgatattgattcacaggggctgggtcacgattattatatatggtcaaaagataaatgtagtaccacagatcaatattttgaacaatgctgtcaatgagactgaacatctggaccacctctttggaacaggtggtaatattgccatatatatgataatatgaattggaacattgaacgtggccttttatattgcctctatgagaactatacagcgaattagatatcctgggattcatgctgttatttgcttcagagaacagggggtctgtctcctcattgtcaccatctctaaatgtgggcaccgttgcattgggctcagccactatctgagaaacaacatgttcaaacctgcgggaatcctggaggggtttgatttcgtaggcaaggtcgtccagcttcatgatgcctctgaggcccccatagcacgtgtcgatggtgaccatggactgaggcacctcctccaggtagccgaggtagtagcagtctggtggaatgtaggggccatccatcggcaaggctccttggtcatcctgagttgtcaccagcagatgtctgggccaaagaaggtgtttcctccgcatgtgaatgacgtgtctttgacccccaaaacgcaggctgtgggacagccagccgggaaactgaaggcctttgccgtggtgcgtctccttcctgggaatcaccacctcggaggaggcgtagtgccacaagggacggccttgagaacaccggactggagccaggagcgcccagagccccagcagcaagaggggggccctaagggtgacccgcacctctgcctgcctcatgtcccagcccagcaataattacccaacgacaatgggaaaggaaaggactgtcctcggtgaagccaggccccaaccagctgcggtggctgcgtccctcccagggagaccctgacagagaacaaagggcctccccaggctcccgcaccacaccgcggggcacctggactctgggagggaatgaggtaacagtcccagggaggggcaggaggtgggtctggacaggacggcagctgctgcactgcgggatgaggctgagggtcacggctgtgagggctcattgggaagggaaaagggagagggaagcagggctgtctcttttaccaccgtcaatcttttctgttgctttctgaatctacaaaatgcaatgatgtgtgttcaatgccctcgcatcacccgtgttattctcggtcactctgtgggttaatatgctcctttctgtggcttacactgcttactcctttgtcatgtggaggtgggcactgccaatattttccttggggactgaatgtttttctactcttaataagtacccatgtcttattctttttgttgttgtattgttttgttgtggctttgaagttttgtttgaagttaccagattgtgaaaggaaaatatcttgggccccatcaagctgagaaccactcagggcaaatctgcctcccagtctatttaaagttgtccctctgctcacagagacagatgaatattctcatgacctcctttgcgaacacttatcagaaactcaaaagaatgcaaccatctgtctctcacctacctgtgacctggaagccctaagtggggaggacttgctttgagttgtctcagcctttctggatggaactagtgtccttcttacttatattgattgatgtctcatgtgtccctgaaatgcctaaatcaagatgtgcccgaccaccttgaatccacagttcctggattcacaagatcaacagttgatatagggtaactttttcttctgtgctatgtaaaacccttgtgaattatgatactttttacttagtccatctattgggagcagacactattcctgaccccatgagagccccaggtgctgtccctccgatgcttctgtgtggttctctcctggtctttggtcatttcttcagatgcaggagctgatcagctctcagggaaggacagagggggccctctccgggtgtctcatgtctgagaactaacgtttcacatatttctgctgattctgtcattgcttatgaggggagggaaaatccaatgccagatcataatcagaaacacaaattactgtttcctcaaaagtgtaaatatttccctttcctggcgaatgtggtcactccatttaaacttaacatgaccatagtgtgtttcgaaggctgcgttgtgtggcactttgtgttccaatgccccgtactcccatcttccaccgcttcaaatcctgcctttttaccacaaatgtacgattactaatgaagctggtttcccctctacgagcgtgcaggttggacgccctttccctacccctttagggttttcacagggagcagaaggaaaatatttgacatccctgaaggaggctgctagggtagactgtgtccctcctaaatttttgtgctgaagtcccaacccttggtccttcagaatgaaatcatacttggatcagtgtcttttaaagaggtgaataagttaaagtgagattcctggagtggggccctaatgcaatctgactgttgttataagaaggggaagcaggagggagggtgcacacgccctgagggacggccatgttaccacagaacagcgagaaggcgccatctgcacaccagggagtgagacttcagaggaaacccacccagctggcagcttgatcttaggctttcatcctccataagtgtgaggaaattggttttgtattgtaagccatccaatctgtggtatttcattataaaagccctataaaatgaatacagtaggtaataggagatcttctaaaaattgaaaaagtcggatggccagacaaacctagacactcctgttcagacctgagcagggtgatggacctgctatgggacaggagaggggaagagatgaacccagcacccagacccagctgagcccattcctcagcaggctgtccctgggccggagcttgcactggtgtgaaagagtgtgtcttggtcttcaggggctcatggagttggacagagaatggtgtaaactcttgcttacacaaaagaacaagtcatcggtgtgcccgtgtttatgtgaatgggatgtgtttctagggtgtgctcatccccaaagaaaaattaatcaggtctcttgggctagaaagaggttgtggcatttgtgtgtattaataactgcggtcggacagtaaattatgttaaaatgcttatgggaaggcacaatggaaagaaacagtttgttacagaaggaaaaaaatggtgattatttaaatgagatgcctttgaaagtcaccatgccaagaaagctgatcacatgatagtgttgggtttcatgttcaggagatcaggagggtccatttgctggcttttacgatacctagacagagctgagagtataatgtgtgaatggaggggacgtggagaaaggggaggccaaatgtttgatgggaatggagggtcactattggagccattaggaaatacacaagcatgatttgtgctgaagcacagaacagtgttcctggggaatattgtgttgctttggcagctgctgaacatacagaagtttcactgttcttagttctcaaattctctagactctcttggcagcccagttttaaatattgggaatataggtaagacacattcgttattaaaaattattaagagaagatgtaggaagaagtttaaagtaatccatttaggttatgaaaatttagttgcggcgaactgtgatgtccatttcttacttggaataatggaatgtaagtcattagtcatctcaatggttcatttttccataaccatcaattacaaaactgctgcgtaatttcctgaattgcccgccatagaagctgacctcacattttctcagtgagaaactgccagtcccgttgatccagcctcgttcttcccataggggattttgtatctctgtggacatgtggtacagtgctgcatatccattggcatatggcctcgggaaaggttccagcctatccatgcacgatgaagcttacttaagggatgaagccggaatgctgggtgtgccagtgccgacagccgaaagaatcaactgcctggtgtatgatgcttttatgaaaacaagcccagggcctcttgctttcttctgtattagattctctggtgaatatttttattcatctctgccagaaattgccacatataattacctagaagcattacaataaactgatttggaagttaactgacttcctggtgaggttaaaatgagtgtcaggtgcatagtgagacagaccggagacatgggtgcatagcaaacttgtgctcaccatggtttctatcttagttagggaaacttctgtaccttccttagatgttcaggcactccattgaggaccctgacataacattatttattgacagaccatagcccaaagtatagaactggatattaccaaggaggatatactattactattttatctttatcttaaaatacactcttccaactgaggtgaaaattaatccagatggtagaacttattgcagttactacagcattttaggaaatcaaaagctgcagaacaaacatatggacagatggcaggtatgtttttggaatcataaacaacttcgtggtgattgtaaaaccaaggggtgtctcacaagggctggaaacctctcaaaatgaaacaacacactgaggatctttgagaagtactctgacctccaagtgagctggctgatatggaggctgagctacatgtagaaagccaaaggaatttctgcaggacatcatcatgccaagcacagccgtaacctgggttccagcccttttcacacgctcaacggttggatcttgggaggaaatcaaagaagccattgtaaaatatcaaaatttaaaccctgattttgaatttaaaaagtgttaaaatatggttgtggcctacactcagaaaatctgtgtccttcagatggtttctcggtggcaccagatggtttcaagtggctattcattaggtttctcagtgaaattaccagatatagaataaataaattgtcactgtcttaaatcaacccatgggaaaggaaaactgtataaagacagcagagaggaaacattgtccacaccaaggaaaaaacaatctccagaaactgttgttgaagaaacagaggcatcacacttactagaaaaatatattgtatttcatatattatgggcatacaacgtgatgttttgatatatgcgtgcattgtgaaattattaaatcaagtaaataaacatgtctgtcacctcacatactgctttttttatggtgtaaatgtgtaaaatctactctcttatcagttttcaagtatatatagtacattagtatcactgaggtctgaccatggtgtgcaatagatcttcaaacgaattccttctgtctaaccaaaactctgtaccctttcaccagggcctcagcttttacatcctcctaacgccagctcctggtaggcaacattctactctctacttctctgagttcaacatttttagattgcatgtgtaagtgagatcatggagtaatttttataccaggcttatttcactcaacataaagacatttaaatgctcaacatcactcactaatcatcagggaaatgcaaattaaaactgggatgagatatcacctcacacatcttacaatggcttagtctgagtctgtttttgtgttgctataacagaataccagagactgggcatttcttttttttgagacagagcctcgctctgtttcccaggctgaagggcagtggcatgatctccgttcactgccagctccgtctcccgggttcaccccattctcctgcctcagcctcccgagtagctgggactacaggcacccacaacatggagactgggcaatttttaaagaaaaggaatttatacttaatggtacttgagtcagagaagcccaatatcaaggggctggcatctgaaaaaggccttctcactgcatcatctaacagcagaggaggatgagcaagagaccacttgtctgtgagaaaaaaagaggccatcttttattagaaactcgctcctgtaataactagcccactcccatgatagtgacagtaatccattcatgaggacagagacttcatgacctgatcacataataaagtcccacctctcaacactgttgcattaaagattttttccaaatcataaactttgggtgacacatttaaaccatagcattccattcctaatactaaaatgtatgtcccaattacaatgtaaactacatacattccatcccaactgtcttcaaagtcttaactcatccagcatcaatgcaaaagtatgaagtccaaagtctcatctaaatcagatatgagtgacactgaaggcacaatttagtctgatataaattgtttccatctgtgagcctataaaatcaaaataagttatctactttcaaatacagtgaatgatgaggcaggtatgggatagaaattcccatttcaaagctcagagagaggcaaggagaaggggtgcatagtccaaaacccaacatgggaaacaacattaagccttaaacctggaaaaaatcctccttgactgcatcctgtgcacactggggagggggatgggcccccaaggcctccagcagtcttgcctctatggattttctgggttcagtccactcagcctctctcacaggtgggactgtcaagcctctagctctcctaggtggactggataccctttgtggtgcctccaaacccatatttctgcttggcattgtgctgagggctcagtgtggtgactctgtctctgcaacaactcactgcccgagaccttaggctgtccacagcattctttgaaatctacgtggagaaagccatgccctcgtggttcttctattctgcacacctgcagaattaacaacacatggatgccatggaagttgatgacttgtaccattgaagtgatggcttgagccacacctaggtcctcctgagccacagcatgggcagccaaggagtgctgtgcctggacacagggaacggagtcctaaagtgcctgctagaagtgaggccatagatttgcttcaaatttcttccatcatatatcctcgtttatggctctgaacttccactttacagaaagacctagggatgagcacaattcagccacattctttgccactttatggcaaggatggcctttgctccattttctgatgagctattcttctttttctcctgagacgtcatcagaacggcctttattgtccatggttctaccaacattctaatggtcatcacttgaataatctctaagaagtttcagaatttcctcacaactctcttcttctgagtcctcaaaagaatcacctctagtgttctattcagggcaatctagactttttatagtctgatcctccaaattattccagactttgtgcattactacatccacttctacattttggagtatttgtaatcacaaaagccccacctcttgatactgatttttttgtcttagtccactttgtggtgcaatgaggcaataccacagactgactaagtataagtaaaagaaatttgtgttctcacagttctagagcctgggaagtccaatatcaaggtgctagcatcttgcaggggccttcttgctgtgacacctatgtgggaggcaggaaagcatgtgcgaaggagagaaatggggctaaattcatcttctaatgaggaccccaggcctgtagtaactaatctactccctctatgagtaacccactctgccaataatggcattaattgcttcatgagggcagagccctcatgacctaatcattcctgaaagttcttacctctggacactatggaatttgggattaagtttccaatatacattctttctaaatagccagagctttttaataggtttaccacccaaggctacatgaggctgtgaagcagtggcctgagggtgactgtcctttgtgagaatggagaggagtgaactgactcatggagacacaagtagatgaagtaaagggactcattgcttcattacatggatagtgagggtgactgaaggcattaacggattaatcgtggtggcaaaaccatctgaggtggacaccacggggagccaaccagaaaaagaggacacatcccattaaatggtgcttcatctccttgcaaaaccaatgaaagaaagcgaaacacaacgccatagtgtataccagacagtggattgagggaagagtttcctaagtcgtaatcgacaaagtggagaaaacatacaaatctttgcacggtgctaacatttggactgtggcttcattgtttcttattaacattttagtgaaatattgctagaaggagactgaaaatgaagtatgaaaagttaaatgggatttctgttccaagttagtccttttcagatgagaggaactaagaagttacagggaagaaacaataatatctgctgagcaagatttttgcagggcaggccaaggaattaccaaggagaaaaaggaaatgtcagcttcaccttgcatctgctcccgagccaggtcctgagcaccccctgctggcgctgatcgtcccctggtgtctgatcccctctggttccctcagcttccctggtggtgtctgagccactctactggtgtctgagcccctctgcctgccctcagctccccctcgtggtctgagccaccctggtggtgtctgaaccccgcttgtgatgtcctgagcccctctattagtgtctgagccctactggtgggtcctgagcccctttggtggtgtctgagccccctggttttgaccccccccttctgcatcctgagccctcctggtagtgtctgagtgttattttcaccatacactcaaataagattgagcagtgattctttcatctgtggtggtcattccaagtgatctgtccagggcacatggggactctatccctaggaccacttgtccccacagaaggagaaaccacagtagcagcaccaagggtaggtcacagcattgtcaccaggagtccccatattcttctcccagacgcagtgaaccttgtcaccctcttcccacactccacagggggtgtacaaagaggcatcttgcattgacctgaccctgggatgttatggaaaaggagacagcctgagctcatgactcctggaattacatgctccagtcttggctatatacagacctgcaattcttttccttttactcaggcactttgccttctggttgaggacagtgttctacagccctccacagtgtgctagagctgactagagtcgaatagccactttctttgtgcaagtttcctttctgtgactttactggatttcaatggtagtaagcgttcatccagacagattccaagacagtgtccacatgaaaggaaaacaaaggctgatgggcagagacgccctgagcatccagtcccagggtacctttgccagctgcccttccaaacatccagaggcagggaagggaggagccctgctgagcagtgcacacatgtccgcagagagaatgtcacagaaatgcagctctgctcccgctcatgagaagcagctcatccgctgtcctgcaggccctggtgaggagccagcccatgtttgggtccctcctcagcatccccaccatggagcctgtgcctgctcatcactgttgagggagcatccctcctgcagcaggctcacttgtggctgccccacacagggctgctctcagtgtgttttctctgtgcttccaggactcccttgtgaacttcagcttggggaggtcgaggacacatgaggctgccctgggcattctctgagccttctgcaaagactctggtttcaccttcgctaacaatagcttgagctgtgtccagcagactggagtgggtggcacaagtgtgtaatccagctggaaaaaatcagtactattctccatcagacaaggaagaactcaaaagaattcttgctgtttaacagggagctgagcaagagtaaggtgtagaaagcttacttaaagaaataataacagataaatttccaaaacttgagaaagatataaatatccaggtacaggaaggcatgacaacaccaaacagaatcaacaaaaataagactactacaagacatatactaatcacactttcaaagacaaggacaaaaaatggatcctaaaaccagcaagaggaaagaaacaaataacatatgaaggcattccaattcctctggcaacaggcttctcaatgcaaattacacaggccaggagggaatggattgacattttttaagtgctcaaaagaaaaaaaaacctgccatccaagaatatattcttcagcaaattacccctccaattgaaaggagagataaagactttcctaaacagaaaaaagatgagaggattcaccaccctcaggcccatcttacaagaaatgctaaagggagttcttaaatctcaaagaaaaaaatgctaaagaataaaacaaaacttttataaatataaaacccactggtaaaattaggtacatggagaaacccaggggatggagtcaaaatgtagaatttttctgtgtcttttttgcctttgcttgtttctgttctttcatttgagttgtcatctcctttaaataacttctcatatctataaggtgtttcttttaagactcatgatgaccacagcacaaaaacctataactgattcactaaaaatcagaagcaacaaattctactgaagaaaatcactgaaccacaaaaacaagaaaaagaaagaaagaaagaaagaaggaaggaaggaaggaaggaaggaaggaaggaggaaggaaggaaggaaggaaggaaggaagaaagaaagaaagaaagaaagaaagaaagaaagaaagaaagaaagaaagagggagggagggaagaaggaaggaaggaaggaaggaaggaagggagacaggagtctcaaaactgccagaaaatgggcaacaaaatggcagtggttgctccttccttctcttttcccccaactagacggcatcgctcctcacactatgctacctggcgttgggacaggagtgacacaggtcatgctgaactgttgttcttattctcttcaatgtgtcgtttcttacttttaggctgtaaccaggtatggggatctctcacttggcttccttagctcttgtgaaggatttttggacgtggatagttgttcagattaatgttccggcagggaaccatcactggagagtcctattccgccatcttgctcctggatgatcactcaagactgtcagactaaaggacacacatacactgaaactgaaaagaaggaatgaaagaagacatttcacgtaaatgttaaccaaaagagagtgaggtgggagtatctacatatatatcagaaaaaaatagattttaagtaaaaagctctcacaaaagacaaagatctttgtcttatataattattatatgtgatacaaagtttcacttatcagaaagatacagttatgcacacacacacatgcatccaacatcaaagtacctagacatataaaactatcatttacagatcagagaggagacacagaaagcaatacaatacaattaggagatttcaacaccccacgttcatcaatagatagaacatacagacagaaaatcagtagggaaacagcagacctgaatagcactagagaccaaattgacctaacagatagatacagaacattcaattcaagtccagcagagcatgcattctccccaaatgcacagggaacattcttcaggatagatcacgtgctaggtactacacatgaccttagccaaaaggctgaggaatgattacctcacatgttaggtcacaaagaagactcaacaaaattaagaagactgaatcgcatcaagtatcatttctgacaatggattgaaactagaaatcactaatagggaaaaagttgaaaatttacaaagaagtataagctaagcaaacttaaaagataatgtagaaaatattttgaaataaatgacagtgaaaacgcactacattgaaacatgggatactgcaaaagcagtactaagagggaaattcataatgatgcccacctacattaaaagagaagaaaggggctggacatggtggctctcacctgtaatcctagcactttgagaggctgaggttggtggataatttgaggtcaggagctcaagaccagcctggccaacatggtgaagccctgtctctactaaaaatacaaaaatacaaaaattacctgggtgtggtgactcatgcctataatccaaactactcaggaggtggaggttgtggtgagccgacattgcaccactgcactcgatgtttattgcggcactattcacaacagcaaagacttggaaccaacccaaatgtccaacaatgatagactggcttaagaaaatgtggcacatatacaccatggaatactatgcagccatagaaaaggatgagttcatgtcctttgtagggacatggatgaagctggaaaccatcattctcagcaaactatcacaaggataaaaaaccaaaaaccgcatgttctcactcatgggtgggaattgaacaatgagaacacttggacatagggtggggaacatcacacaccagggcctgtcatggggtggggggaggggggagggatagccttaggagatatacctaatgtaaatgacgagttaatgggtgcagcacaccaatatggtgcatgtatacatttgtaacaaacctgcacgttgtgcacatgtaccctagaacttaaagtataaaaaaaagagtttgaaaaaaataatagaaaaataaaaaaaaagaagagaaagaacctaaattaatcttattaatcttacacctccggatttagagaaagaataagtaagtcctaagttagaatgaaataataaagattagagtagaaattaatgaaatacaaaacagaaaaataataggaaaaatcaacaaactaagggcttttgaaaaaaaagacaaaattgacaaaactttagctagactacaaaaaaagaatactcaaataaatagcatcagaactgatcaaggagacattacaactgatgctacagaaataaaaatgatcatgatgtgatatgatctggatctgtgtccccaaccaaatgtcatgttcagttgtaatcctcagtgttggaggttggggctcagcgggaggtgattggatcatggagaaggttggtttctcatggtttaacaccataccccttggtgctgtcgtccgatagtgagttctcctgagatctggttgtttaaaagcatgtagcgtggccggatgcggtggttcacgcctgtaatcccagcactctgggaggccgtggtgggcggatcgcgaggtcaggaggagaccatcctggctaacacggtgaaaccctgtctccacgaagaaatacaaaaaattagccaggcgtggtggggagtgcctgtagtcccagctagtcaggaggctgaggcaggagaatggcgtgaagccggtaggcggagtttgcagtgagctgaaatcgtgccactgcactccagcctgggccacagagtgagactgtgtctaaaaaataaataaataaataatagaaaaaaataaaataaataaataaataatagaaaaaataaataattaattaaataatagaaaaaataaataaataaataaagcatgcagcacctccggttctctctcttgctcctgcttcagccatggaagaggttctcctttaccttccaccgtgactgagtttcctgaggcctccccagatgcagatcttgccatgctttctgtacagcctgcagaacttcttttttttttttcataaattaccctgactcaggtatttatagtagggcaaaaacagactcatacatggagacgactataaatcattattgaataaacaccaacacattggataacctagaagaaatgggtaaattcctcaaaacatacattctaccaagactgaatcataaagaaatagaaaacctgaagagaccaaaaatgaacaaggagattgaaacagcaatcaaaaatctcccaatcaagaagatttgaaaatcaagttcaagtggtttctccagtgaattctaccaaatgtttaaagaagaactaaaactaataactctaaactctcctagaaagttaaaggaacactttcaaaatatttttatgtgagcactctcagtctgataccaaagacaggcaaaggccatttaagaaaagagaactacagttcatatccctaatttgtataggtacaaaattcaacaaaacccagcaaatcaaattcaacagcacaataaaaggaacctatcccaccaccagaaatgcatgataaagtgggatacatctctgagatgttcctgtttgaaacacaaaatcaaacatctttgtagtaactctaagagctgtagcctggcctggcacagtggctcaaacctgtaatcccagcactttgggaggccagcgtgggcggatcacctgaagtcgggagttcgagaccagcctgaccaacatggagaaaccctgtctctactaaaaatacaacattggcagagtgtggtggtgcatgcctgtaatcacagctacttggagggctaaggcaggagaacagcttgaaccagggaggctgaggttgcagtgagcagagatcttgccattgcactccagcctgggcaactccatctcaaaaacaaacaaacaaacaaacaaacaaacaaaaacctgtagccttttggcaaggagatgcttcaagccattctgaatgtagtcacaccataaataacacatacccaaactccaagtggatgattcttgggttaaatcgttttaactgtgttcaaagtatttttgagctttggtttctccccagggttaccatcactcttttaccagcacgatgttgttgactggtcacaactgatgcaacgacaaccacagctgtgactttaaattttaccatcagatgttgattggagacaataaccaattaccatacacctcaagattcgtggagaaatcatggtttcatggagaaatcaagataacatctacttgagctcatctggtaccaccaagcatgtatcttgagagcttcataaattaccagagttagcaaacaaatttacaagaaaaaaacaacgccatcaaaaagtgggcgaaggatatgaatagacacttctcaaaagaagacatttatgcagccaaaagacacatgaaaaaatgctcctcatcactagccatcagagaaatgcagatcaaaaccacaatgagataccatctcacaccagttagaatggcgatcattaaaaagtcaggaaacaacaggtgttggagaggatgtggagaaataggaacacttttacactgctggtgggactgtaaactagttcaaccattgtggaagtcagtgtggcgattccttagggatctaggactagaaataccatttggcccagccatcccattactgggtatatacccaaaggactataaatcatgctgctataaagacacatgcacacgtatgtttattgtggcactgttcacaatagcaaagacttggaaccaacctaaatgtccagcaatgatagactggattaagaaaatgtggcacatatacaccatggaatactatgcagccataaaaaaggatgagttcatgtcctttgtagggacatggacgagactggaaaccaacattctcagcaaactatcgcaaggacaaaaaatcaaacaccacgtgttctcgctcagaggtgggaattgaacaaagagaccacttggacacaggaaggggaacgtcacacactggggcctgtcgtggtgtggggggagggggagggatagcactaggagatatacctaatgtaaatgacgagttaatgggtgcagcacaccaatgtggcacatgtatacatatgtaacaaacctgcacattgtgcacatataccctagaacttaaagtataataaaaataaaagaaaaaagaaaaacaaagaaattatcagagttagttacacaaccagatttttctattattttaaatttaaaatcaggagttaaacattcatattctgtaatggctttctgaatgcctccagagcttgatcacttgaatgtttaaataggattataacctaggttacagcgactagttttgaataataatctgctggagtatgctctttcacttccttactacctaatttgtgtgggtgccaatcttcacatcagccagcacagggaaaggaggtgtgtatttaaaggttccttaacattgtccatcttttttggtgatgattatgttctacttgttttcaatgttttctgctgtgtacattaagagtgtacaacatggtgtttagatatacacatgcatagtaaaaaggttaccacaacctagcagcaaattaaccaatcaatttccttttatggttaccgttttgtagcaggagaaactaaattctactcttttagcaaatgttcagtatacaataaaatataactacagcctacctgctgcacacaagagctcttgattttataactgcaagctctttcttgtgtagcgtctgcataactgcaaactctaacttctgtagcttctgcgtgactgcaaatgtgttaactttcacctatttctccccatttcctacctctccacacccctggtagccatcatttcactctctgtttctatggatttgatatttttaaagattttacatgtaagtgagaacttgctgtatttttatcttgtgtctggctcatttcacttagcactacgtcctctggatctatccatgttgttgtaaatgacagtcgatctccttccttcttgtccagtattggggtatgtttcatcaagtcttctttttccctgaaaacatccccaaatcatgcactatttcaacacttaccttctagatatcagtctctttgtctatttttgagacttggctagcttacaccttctagtcactggcttaaattctactattcagcgtgggtttacttcagctgatggtgatggtacctccttctccataacatgcagtttcagttttgagatgtgatccatcagcacatattgtgaggctcacattaccaatgggagtctgtaatacacctaagcaatatgcaggcagtttcctcactaagatgagacggggtgagcacagcttgatattctgccacgcctcctgcctgtctcactactcactacacactaaatttgaactcacatgaagttcaggttaatgtttcaatctgtttggtttaatttaatttttacttcaagattatttccattattatatgtggctatttcagtacaaattgaaggaaaggcaacttttattgcctttatttatgaggctttatttatgggcatgatgacagcagttttaaaagtcacattccgacatagtgatgggctggatgaagagagggcattccctctgaaatgctcttcggaaggatcagaaatgcctcaatcgaccaactctcctgtcctcatgactagagctgtgtcacatcttcagagagacacacatccgtggtaggaaggataagattacatggatgaatctggctgttttctaatgttttgcctgagatgaatccaaatatatggggaatggttatttttattattttgggatttgtaagcaatggctgaaaacaagaatactttttaagatgacattttatttttgtgacattctgttatttcattgtagagattgacaattacattttctttttcaaaaaataaattgtattatgtatatctaagacatacaacatgatatggaataaatatatacagtaaaatgatgactatagtgaaataaattaatgcagccctcaacttacagagttacccacctcccccatttggcaagaacagctataacctcagttagcaaagtcctggatgcaatgcacccttattaacttcctcatgttgcacgttggatctgtggcagcttccagatgggaaagcctcaaagagtcagacgtgacgatatgggggtgctgcatctgagcacacagctccctgcaatcctctctgttcccaggtgtcctgtcccaggtgcagccgtaggaggggcaaagccctcgcaggcaatctccgtgtcccatgctgcttcccgctgctccgttaccaggggttactcagggggggtggatcccccgacctgcagggaaaggttggaatgcaatggattgctcacctctgttatggagggagcatatagtttatccctaccatcaaagttgagtatccatctccagagatgcattcaggatacatccggttctccttgcagctgagttttgtgactactgaggacacagccctgtatgactgtgtaagagacacagagaggagatcccagtgtgggcccagacacaaacctcactgcaggggtgcctgggacctggatggcaggggcccccagggcccagcctcagggcatatgcaaccaaggagggcatatggggagggaatcatcacccagggtttcctttccttaatgaacagcatctgagccatggaacctctgctttatatctgggctacggagtggcctgaggcacctgagatgcaagcacaatggagatgtttaagattctgtatgagcatatgtgacatcacagttctttttcctcatctctcggatttcactgaaactgtgaagagaactgtcatcctactggcactgtgtgctgtgcaggaaatttctaaaatatggtaaccatcatgagggatgccttcgtggctgcactgtgctgggaagagtcacaccagggagaaatcctgtgaggaaccctggactccaccggctgtgcccagcacagctgtgaaagacccagttgatgtccaagaaatgagaatgcaaacatctgcctccagcacataggaaattacagcaaacgattccatgtcccgtggtccctctatccccaaattctttcccttttcccaaaatcaaggaggagaactggagtttccagtccatagcctgagccagccaccacgtgtgtgtccccagcctttcccagagctgcctgaggggctggacaagacctgctcccttccctcctgctcacacagctgcacaggggagctcctgcaggctgttagcatcccagtttccaaacagctttcatatccacaggattcatttcttgctgttactattgttattttgcctgagcattctcatgactgcatcacttgtcagagacacgtgccctgcactgaaaccccactctctgctttccacaaagatggagttccttagaccttcatctgctagaaggatctgatgtcttgtccttacactggccaagcattgtctgatatgccccagttggcacacagacattatggattatttgcacctgtgtgggaatggtctataattgggacacgtgtctagactcaaagatgcctggatggtctataattgggacatgtgtctagactcaaagatggctggatggtctataattgggacacgtgtctagactcaaagatgcctggatggtctataatttgggacatgtgtctagactcaaagatgcctggatggcctataattgggaaccgtgtctagactcaaagatgcctgaatggtctataattgggacacgtgtctagactcaacgatgcctggatggaaaaggtgcaggctgctccactgatgtcacctgtttcatcatagttttatgatttaataaaagtcatatttttttcatttttgcacatcaaatttttttctgtgttccatattcctaagcccatctttgagctcacagccctttcccaagaaatcaacttctagacctccctcttctcggggctccgaggtgatttctgagtggcatcctctccacctccctgctgggaacagagccagtcgcagggctcatgggcagctttagaatgcctgctactccggggtgtccccctgcttctcactggagaagaggcctctggggtggtcacagcctctttctccacatgaatcctgagagttcttcctgagctacacagctgggggaagacggccctaagagacgtgaaaagagagacatgggaagtgaggtgtctcagctcttgtctcccctggttggtgtggcctgacctcaccagagccccagcctaacccacctgacctgtccccaggagctgtactgagcgatggctgcacctgctcagttacctgtggggcccagtgcctctgagagaggtgcccagtgagggctctgcagggctccccccgagcaggagctgggctgaggtaaatcagcaggaaggaggggctgcccaggccccggggaggcaggcagcgtggagaggagacagaggcgcactgggagggagcaagccagtcaggaccaccctctcagctctgagaaatgagctatgctcacggaatgctcacactgaccactgaaagacttgactatgatgatgactctccctgtgttagcaggtgggtgtaagcacctgcttcccaggttcaagccattctcctgcctcagcctcctgagtacctggaattacaggcacctgccaccacgcctggctaatttttttgtatttttagtagagatggggtttcaccgttcaccatggtggtcaggctggtctcgaactcctgacctcaggtgatccacctgtctcagcctcccaaagtgctgggattgtaggtgctagccactgcaccagcctcaacacaactcttttagggtcaatatcttgagacccacaaggaatttcctttgagcaaattctgtgggaggtatgtagccttttatctttatagttatgtatttaggaaaaaaaaaaaatgagagacaggtttgtgtgacacagttcccagctagccttttccctgtagcgtagtgagtctgagatcccaagattttatttttcttttataatataaacatgaaataataagaaatgtatatttgtaagatctgagagctacagtgtaaaagaaaataacacagaaaaagaatacacacactcgcacacacacacatacacacaaacacacatatatggtctctgtccctgtctcctggtgcacagctcctgaaacccttggaatctcccaagtgatgtgtctttatggatgctaatgagacgactgatttctggggactcccaaaggactggtggccaggggaaccaacctcgtgattacggggttaaacttttcagccccctatcccctgatttccagggatggggaggagctgaaggttgagttgatcaccagtggtcaatgatttaatcagtcgtgcttatgtggccatcgtgggtggctcatgtctgaaatcccagcattttgggaggccaaggcgggaagatcacttgaggccaggagtttgagaccagcctgggcaacatactgagaattcatctctacaaataaaaaaaaaatagccaggcatggtagtgcatgcctgtggtccagctactcaggaggcagaggtgggatgatcaattgagtccaggagatcaaggctgcagccagctatgattgcagcactgcatgccagcttgggtgacagagctagaccccgtctcaaaaacaaaacaaaatgaaacgaaacaaaaaacaaactaaaaaccaaatcatgcctatgtcatgaagtcatgaaactcaggacagcggccgggcgtagtggctcatgcctgtaatccctgcactttgggaggccaaggcaggcagatcacttgaggtcaggagtttgagaccagcttaggcaacatagtgagattctgtctctatttttttttaattaaaaaaaaagataaagtaaacatggggcagaggaagcagtcagatatgcatttgtcccaggtgagcagagggatgaccttgagttctgtcctttgtcctgcaaggataagctatcaatttacattgtcagggaaattcaacagaactgttctaaggtcaaaatcttgaggcccacgaggaatttcttcatgggcaaattgtgagggaagtatgtagctttttaaaaaaatctttgtaggtatctatttaggaacaaaatgggggaggcaggtttgcatgatccagtttccagcttgacttttgcttttggcttagtgagttggtggtcctgagatttctttgcctttagcagtcattattcagggaagagggtatggtcttgatactcaaaatttcttaggcgagaaatctaccagggtttggatgagaccatacattgctcattcagtatctcaaacccagaaagatgagttactgacattgaatgtgtgaaaggaaaacaaacagctctgttgaattttttgaatttcatctaaaacagttctgggttttgttttgtttagtttttgagacagagtcttgctctattgcccaggctagagtgcaatggtgtgatcttggctcactgcaacctctgcctcctggttcaagcaattctcctgcctcagcctcctcagtagctagtattacaggcatgcaccaccatactcgggtaatttttgtatttgtagtagagacagggtttcaccatattggccaggctggtctccaactcctagcctcatgcaattcacctacctcagcctcctaaagaactgggattacaggcatgagccaccatacccagccaaaacagttatgttgaatctcaccctgacaacataaatgaaaaacttgtcttcacaggtaagggacaaaggacagatttaaaagtcatccatctgcacactggagacaaaagcatatctgactgtttcctgtagtctatgtgtatttttcttctgtaaaaatgcagattcactgagtgcaagatgaatacataattgactattcctccacccttttctttccgcatgtaaaatgtgggttccatgaatgctgatcaaagactaaaaggaacacaaatgcttggcttttcaatatgctctcccttcccgcttgtttttccttttgccttcccctactggccactctttttccatttacttattcattcattcatttattcatttatttatttatttatttggagatggagtctcactctattgcccaggctggaggcaatggcatgatctcagctcactgcaacctccgtctcccaggttcaagcaattctcctgcctcagcctcctgagtagctgagactacaggcacccgccaccacacctggctagtttttgtattttagtagagacagggtttcaccaagttggccaggctggtcttgaactcctgacatcgtgatctgcccacctcagcctcccaaagtgctgggattacaggcatgagccactgcacctgacctatttttttaagacagaatcttgctctgttgctcaggttggagtgcagtggtgcaatctcggctcactgcaacctctgccacttgggttcaatcaattctcctgcctcagtctcctcagtagctgggattacaggcatgcgccaccacacccagctaatttttgtatttttggtagagacagggtttcaccatattggccaggctggtctcgaactcctgacctcagctgaggagactgagacaatcctggtcaatatagtaaaaccccatctctactaaaaatacaaaaattaactgtgcgtggtggcagatgcctgtactcccagctacttgccaggctgatgcaggagaatcacttgaaccagggagtcagaggtttcagtgagccaaggtcacaccactgcactccagcctgatgacagagcaagactccgtgtcaaaaaaaaaaaaaaaaaaaaaaaaaaaaaaaaaaaaagggctgggcgcggtggctcacgcctgtaatcccagcactttgggaggctgaggtgggcagatcacgaggtcaggagatcgagactgtcctggctaacatggtgaaaacctgtctctactaaaactacaaaaaaaaattagccgggtgtggtggcgggcacctgtagtcccagctactcgggaggctgaggcaggagaatgtggcatgaacccaggaggcggagctttcagtgagccgagatcatgccactgcactccagcctgggtgacagagcgaaactcggtctcaaaaaaaaaagagagagagagaacttagtgattttaaaggtttttttcctttcttttgatatctaatgttggatttacaactttgaaatgcaaaactacatgtacaaatctgtgaaacacagggcagatgctagacaaaatatgccagaatttcccagtgattacctctattggaaaatttcatctccagacttttccatacattatgcattttctacagcaaacaagcattgcttttgtgatcataaaatacaagcagacacaatcaagactgggggaggtttcctgggggagagcagccaggcccaggatgcagggctctccttcctgggacatcagccaggtcagggcccttgaggcacaggtctgggcagctctaccagtgggcatgggcagagaaggacccagctggttgagcccctgatgcaattgagggcaggccccttgccggagagggagacagaacagctgccaaaacacagccttgaggccaggctctgtctgggggtctcgctgctgctccccagcccacagggcttccagccgcaccaggacaagcttcactgcaaaggcgggagaggaggggaggggatgtgccttaccttggggcgtgtgcagtgtggactgtgtgtgcgtgtgcatatgcacatacatttgtacgtttgtgggatactggtgggtgcacaagctttgtatgtgtggacgtacatgtgtctgtgtgtggggtgtgtatgcacgtgtgtttacacatatggggtttgggtgtgcacgtgttcatacatatgatgtgcgcatgtgtgggcatatacatgtgtccatttatggggtatgggatgcagatatgtgcatgtattcatgcacattcatgtagcgcatgtgtgtgttacagcatatggtgagtgcatgggtgttcgtatctgtggggtacaggtatcatgcacgtgtgttcatctgtgtggggtgtgggtatacgtggaccgtggcctgaggctcccccacaggacactgctccctgccgcctccccaggggctaacaggaccctgctcctcttgctaaagccagtttgggagcagccccacccaggcagccccaagccaaccaggctcgcctctgaccagatggctgaaggagcaggtagagcaggaagtgtgagccagtgacccaggttcccctggtggccaggcttggtggcccatgtccatggagtcccccacctgccaatgacctccagccatgtctcctgggtaccaggccacccatgggtgggggtgggggtaactccctgctgactcactgctcagctggcaccaatgaggtctccacctcagccctgggctgagtgtccagtgctgagtccttcctacaggcaggtgagcttgggaggcagggaccctgtggacttggggagcgggctcagggtctggaggccagaggccttgtccccaggcccggcatcccatcagcaagagcccaggaggctctcagggcagcactcctctagcaatctcaggggcagcgtcctcccaggagtcacatccagatcaccatacgtacctgctggcccctagcatgtcccataagtggagaggggttggcctgtggaggcaggggtggccagaatatgtgccggaaccccatctacaggctgacacctaaacccaaatggcacaggggagcctgagcatgaagtggctggcctctccctcgcgggggcccagcaactgctgactccatgtgccaagccccgcctgcccgctggaaagcctcaacagactgctccctgtggtgacaccaccactcgggtcggcttggctgaggccagcggagcatctcccctctaggtccattcacatccatcttccctggacaaatgaacactccccaaacactcacttgccactttgaccccagaccaaacacacagccactcctggagtgccggtgactgagggtggctgggcccttctgtgcccacaaagcagggcctgggctatacctgtggggctgcacgactgtgccaggacagccttacctttgctgggggcttcgtgccctcccagctgcgtgtgtccatggacgaggggacctggtagatgtcatgccccatcccggcagaaggtggcacctggtaaatatcctgggcagggcctccaggccctggggacacctggtacaggtctgtggccgggctgggaaacgggtgatggggcgtctgcttcgagaaggtggatgtctgcttggctgggggcgactggaactgagggctgggacccgggacttggtagaggccttgctgagccttgctgggagtgggcaccaggtagacgctgtcgggctggggctggtaggtgttggggagcatgggcgtgtactgggaggccggaggcactggggcatggaggccaggctgaggctgggccggggtggcgggagggccggggccaggccctgctggcttcttatcatacatacccaccaagatcttgaggtggttcccaggcacgatgccctggcgcccgtgcagcgagcagagccaccagccatccaggccctgcgtgtcctgctccagcaccgtcatgatgtcgcccttgcggaaggagagctcatccggggactcggccacattgacatagagggctttggccagcacattcaggtggttcatggtgtccggcgggcctggggccccggctcccgtgggggcgcacaccgagctgcccgggccgcgtgccctcggggctccgagcgcgccgcagccgccccggtgccgccgcgcagctgccgcctcggccatccacagccggtcccttaagtttttttttcttattgtgacaaaaagcatataagattaactgtcttaaccatttgtaaatgtactattcagtagaattatgtatattgacattgctgtgaaacatctccgggaccttttcatcttgtgaaacggaatccctgtacccattaaacagcgattccccagttccccttctcccagccactggtaactatcattccactttctgtttctatgaatttgactactttagataccttatatagtggaatcatgcagtatttattgtttgtgactggcttatttcccttaacataatgtcgtcaaggcttacgtatgttacagcacgtgacaagattttcttcctttttaaggctgaatactactccattgtatgtataaatcacattttgtgtatccattcatccattcatggcctttgggttgcttctatctcttgtgattgtgaacaatggtgctgtgaacgtggatgtgcaaacaatctctttgagaccctgcttttaattctttgattatatatccagaagtgggattgctagatcatatggtagttctatgtttcattttttgaggaccctccgtactgtttcccataaccataatagctgcatcattttacaatcccactaacggcacacaaagcttctggtttctctacatcctcaaaaatgcttgtttgtgtttttttctttttcttttttttttttttgagacagaggcttatcctgatgcccaggctggagcacagtgacatgatcatagtttattgcagcctggagctcctgggctcaagggatccacctgcttcagcctcctgagtagctggactacaggcatgcaccaccacacccagctaatttttgtatttttggtagcaacagggttttgccatgttgcccaggttggtctccaactcttggcctcagatgatccacctgcctcagcctcccaatgtgctgggattacaggcgtgaaccaccatgacgagccaaatgaggctaattttaaattcttttgtagagacagtatttcattatgttgcccaggctggccccaaacacgtagcttcaagtgatcctcttgcctgggctgctcaaagtgctgggattggccgggtgtggtggctcatacctgtaatcccagcactttgggaggctgagtcgggcagatcccgaagtcaggagtttgagaccagcctggacaatatgttgaagccccgtctctactaaaaatacaaaaattagccaggcatggtagagcgtgcctgtaatcccagctacttgggagggtgaggcaggagaattacttgaacctgggaggcagaggttgcagagagctgagattgcaccattgcactccagcctgggtgacatagcaagactctgtctcacgggtggggaaagcggggagggctgggattacaggtgtgagtcactatgcctggtccacttattgtttttgatggtagccaacctaatgggtatgaggtgatagctcactgtggtttatttctctgattagtgatggtgaccatcttttcatatgcttttttggccatttgtatggcatattcacccagaataggtaatttttttaaaacataaaaatttaaaaattattttttaaaagaaataatttgtgtgtgtgtgtgtgtgtgtgtgtgtgtgtgtgagagagagagagagatggagtcttgctctgttgcccaggttggagtgcaatagcaccatcttggctcactacaacctccgcctcccgggttcaagcaattctcctgcctcagcctcccaaggagctgggactacaggcgggtgccaccacgcctggttaatttaggtatttttggtagagacagggttttggcatgttgactgggcttgtcttgaactcctggcctcaagtgatcctgtgctgggattacaggcgtgagccactgcaccgggtctctgttcttgtcaaaaatcaattaatcgtagatattttgatttatatccggactctcatttctgttacactggactgtacctctacctataggccagtaccagagccttttttttcctttcttcttactggtaaactgaagtcacatcacagtcttgattattgtagcttagtaggttttaagattggaaagtataaattctccaactttgttctcctctttcaagattgttttgtctaatctgggttctttgcattgctatatgaattttaggatcagcttctccatttctgccagaaaggcagctgggattttgatagaggttgcattgaatctgtagattagtttggggattattgttgtcataaccatgtttagtcttccaatccatgaatatgagatgtcttgatttaggtcttctttaatttttttttttgttggtggtggtgagatgaggtctccctctgttacccaggctgaagtgcatgatctcagctcactgcaacctctgcctcctgggctcaagccatcctcctacctcagcctccttagtagctgggactacagtcatgcaccaccccacctggctaatttttgtattttttgtagggatgaggttttaccatgttgcccaggatggtcttgagctcctgatctcaaagcaatccacccgcctcagcctcccaaagtgctgagcttaaaagcatgagccactgggcctggtcaggtgttctttaatttttttcaacaatgtttcagagttttcagtatatgagtctcagacctctttttttgaattatttcctatgtgttttattctttcagatgttattacaaatggaatttcttaatttcatttttggatagttcattactagtgtatgaaatataattgatctttgtgtatggatcttgtgcctttgaccttgctgaacttgtttattagcatgtgttttctctttctctctctgtctctagtgtgtgtgtgggtgggggaaactttcttaggctttctatatacaagatcacatctgccgggcacagtggctcacgcctgtaatctcagcactttgggaggccgaggtggatgggtcacctgaagtcaggagttcgagaccagcctggccaacatgatgaaaccctgtctctactaaaaaaaatacaattggctgggcataatggtgggtgcctgtatcccagctactcaggaagctgaggcaggagaatcacttgaatccaggaggcagaggttgcagtgaggcaagatcgcgccaccacactccggcctgggcaacaagagcaaaactccgtctcaaaagtaaataaacaaataaaaagatcacatcgtctggaaatatagttttactttttcatttctaatatagatgccatttattttattttttttgtgtgcctaattgtcctggctggaacttcctctttttttttgagaccgagttttgctcttgttgcccaggctctgaggtgcagtggcatgatcttggctcactgcaacgtccacctcccaagttcaagtgactctcctgcctcagcctcccgagtagctgggattataggcatgcaccatcacatctggctaatttttgtatttttagtagagactgggtttcaccatgttagtcaggcaggtctcgaaccactgacctcaggtgatccacccaccttggcctcccaaagtgctgggattataggcatgagccaccgtgcccggactggaactttcaatataatgtagattataagtgacaagagtagatgtacttgcctagttcctgatcttagggggaaagctttgttttccccatttaatacattgttagctgtgggtttttcatagatgcctttagcaagtaaagaaagtttctttctattcctagtttgtggactgtttctatcatgaaagggtgttggattttgtcagaaaatttttgtgtttattgagaagatcatgtggtttttgctttttattctacttttatggtgcattatatcagttgatttttgggtgttactccaagcaggcatgaatcctacttggtcatgttatagaatctttttatgtattactggacttggcttgctagtattttgttgcagttttttttttttttggtctttatgagaaatattggttattatttttcttttctcatgatgcctttggttttggtaccaggaaaatattggcctcaatgaatgagtttgaaagtgtcagccgggcacagtgggtcacacccataatcccagcactttgggggactgaggtgggtggataataaggtcaggtgttccgagaccagcctggccaacatggtgaaaccccgtctctattaaaaatacaaaaaaaattagccagacttggttgtgcgcacctgtattcccagatacttgggaggctgaggcaggaaaatcgcctgattccgggagaggttgcagtgagccaagattgagccattgcactgcagcctgggtgacagagggagactctgtagtataagaggaaggaatgcatgtttgtagtataagaggaaggaaggcattagaaggaggcctgaagattcatttgggggatttggggtgataggtaaggtcagggcttggagaggacaggaaacttttcttttttttagacagtgtctcactctgcctcccaggctggagtgcagtggcgcaatctctgctcactgcaacctccgcctcctagttcaagtgattctcctgcctcagcctcccaagcatctgggactacagccacacaccaccatgcacagctaatttttgtttctttcttttttttttttttttttttttttttgagacagagtctcactccctcacccagcctggagtgcagtggcacgatctcagttcactgtgacctccacctcctggttcaagtgattctcctgcttcagccccccgagtagctatgattacaggcatgtaccacaagcctggctagtttttgtatattttattttattttattttacattattttattttatttttgagatggagttttgctctttcgcccaggctggagtgcagtgacgcaatttcggctcaccacaagctccgcttcccaggttcatgccattcttttacctcagcctcccgagtagctgggactacaggcacccgccaccacacctggctagtttttgtattttagtagagatggggtttcaccaagttggccaggctggtctcgaactcctgacattgtgatctgcccacctcagcctcccaaagtgctgggattacaggcatgagccactgcacctgacctatttttttaagacggagtcttgctctgttgctcaggttggagtgcagtggtgcaatcttggctcactgcaacctctgccagttgggttcaatcaattctcctgcctcagtctcctcagtagctgggattacaggcatgcgccaccacacccagctaatttttgtatttttggtagagacagggtttcaccatattggccaggctggtctcgaactcctgacctcagctgaggagactgagacaatcctggtcaacatagtaaaaccccatctctactaaaaatacaaaaattaactgtgcgtggtggcacatgcctgtaatcccagctacttgccaggctgatgcaggagaatcacttgaaccagggagtcagaggtttcagtgagccgaggtcacaccactgcactccagcctgatgacagagcaagacgccatgtcaaaaaaaaaaaaaaaaaaaaaggctgggcgcagtggctcacgcctgtaatcccagcactttgggaggcccaggtgggcagatcacgaggtcaggagatcgagactgtcctggctaacatggtgaaaacctgtctctactaaaactacaaaaaaaaattagccgggtgtggtggcgggcacctgtagtcccagctactcgggaggctgaggcaggagaatgtggcgtgaacccaggaagcggagctttcagtgagccgagatcgtgccactgcactccagcctgggtgacagagcaaaactcggtctcaaaaaaaaagagagagagagagaacttagtaattttaaagtttttttttcttattgtgacaaaaagcatgaggttctcaaggttcacgccatgatggtgccactgcactccagccccttccctctactttgctgccactcggatgggggaagctctggaagacttcttagggaagtggcatataaactgtgtgtcatacttgttgttgtttttttttttttttttggagacagggtcttgctgtgtcccacaggctggagtgcagtcgcatgatcacagcttaccatggcctcaaactcctggctcaagcaatcctcccatctcagcctcccaagaggctaggactacaggcaaacaccaccacgcccaactaatttttaaaattcatcccacgtagaagagggggaaaggcatgaaagggcatttgtggcagaggaacagtgtgagcaaagaccaatagtctgggaaaaggaggaggataggctgtgggtggagcaggaaatgtgggtgcttctcttggcaaaggattctgaatgccaggtgagcaggacgaatgtatcttgtgggcgccagagaggcctgggcctcagcctgcccctgtaaaatgaggtgattagactggtctgcttcaggccttcctagggcaaggggctgtcacagaaagggtctactctaggttcttccaggttcaaccccagaaaggcagaatgggaagtggctggagcagctcagaggctaggggtaatattttgctccagagcccaagtctgagaatgactattttaccaagctgtctgcattgcatccctaagtcaccctggctaaccctccacccagtcagggtcctgcagggaaaacccaggccttgggtcaggaggcaagaagggtgatgggtgtcttacccctggctccaccctaggtaagggttggccctcttggagcctcaacttgctcatatgcacaatggaggagctgtgccttgggctctctaagcctctctccccaggacagcactgtcattctggagatgggaacagcattagcaaaggaacggaagtaggattgtgaggaccttgttgggcaacagacaggcaggtgaggctggagaatggagtccctagaagtggatggttcttgttggggttggctggatccaaggggtatgaccttcctccttatgtgcagaactgggtgagccctaggtcatggccagcagccctcggagtgggactgaggacctgttgggaaaccagtttggcaaggccatcatctccatgatgtcatccagccactgtgttctctgggcaatagtgccaggcaaacttctggccctgcaggaggagaaagggcctcagatgcccactgggcagcaatgaattccaggagacccagcctcacagacaaaggagaggcaaggggctggaacaggaaggagagagttctggatgtgccagcctggacctctttagacttctgggagtccctgatgcctgggcgcagggagtgggggtctaggctcatggtgggacactatgtaattgctacctgatgggttggacactggctcctgatcatgcttatactacatgtgtggcaattttgttaccactatgaccttcacagcttgagtcctgtgaggtaggaccaccattatacagataaggagacagactcagaaccctcgttcttttgttgtttttttttgttttgttttgtctttgagacagagtctcactctgtcgcccaggctggagagtggagtggcacaaccatggcttactgcagccttgacctcccaggctcacagtgggactacagacacatgccaccatgcccggctaattttttttattttttgtagagacaagggtctccctgtgttgccagggctagtcttgaactcctgggttcaagcaatcctcctgccttgaccttctgaagtgctaagattacaggcgtgagccactgcgcctggccagaacatttgttcttaatcaccatattctaccatccaccatttggaagctccgcttggatgaagcctgagcactggggagacctgggcctcagtctgcccatctgtaaaatgagggggtttgactggcttccttcaggccctcctagggcaaaaaactgtaacaagaagggtctagattcttccaggttcagccctggactggcagagtagggagtatctggagcagctcaggggccgagggtattttggctccagagtccagtccgagaatgaatattttaccaacctgtcagtgtgggatcccagcaaacccttctctctacttctgaacatagcacctgaatcttggcatcacagagtcctggatacccaccttatggttcaaataggtaactgagtcccagagaggacaagggacaggcttcaggtagtgtagcaaatcaggagcagagccattctgcatcccagattctcaacctcccaaaactttgtttcctcctcaggtcctggcacacttaagcatgaaataactgacacatattgagtgcctatggcataccatgcactcatgtaaccatcaccacagccctataaagcagatgctaatagtctgtcccttttatgggcaaagaaactgaggctcagagaggggaagtcatttgtccaagttgacactgcatgttggtggtagggaagggatttgaacccaggtatataggcccttccccctcagcagatccagtaagcctcactggaggcatgaagacctgtagacagcagggtggatggctcctttgctggttctgaaggcgcgcagtgtccaattcagagtttccacgcaggcctggcctctctggggcaggcagaaaagtgctgaggctgcagaagggctctgaatcttcccagaggaggcggccatggtgggaggcagtgctctgcaccaacctcagagccaagtgtagacatggtggctggaccagctgcaaacaagggaaggcaggcagggtggggcccaaaccctaacccagcctccaagccgtgttcccagccttccgccagccaggccctgccctaccacccttctcgctccccacctggatttgagatgaggacgccgggcctaataatagccaaacggcagcagaggcagtgcctggagccactgccagttggagcctggggtcccccatggtctcatgttggcctccaacagggttcagaactttaaaagtactgcactccagcctgggcgacagagtgaggtcttgtctcaaaaacaaaaacaaaacaaaacaaaaaccctttaaaatagcaactgcttatgaagtttataatatgtgctgggcactgtgctaaagcatagcccacagtaacttacttattcctcaccctacccccactggctaagactatttcttttttttttttttttaagacagagtctcactctgtcacccaggctagagtgcagtggcgcaatctcggctcactgaaacccctgcctcctggcttcaagtgattctcctgcctcagcctcccaattagctgggattacaggggcccgtcaccacgcctggctaatttttgtattttcagtagagacggggtttcgacatgttggccaggctggtcttgaactcctgaactgaggtgatccatctgcctcggcctcccaaaatgctgggattacaggcatgagccactgtgcctggccaggctaagactattcttagcccttttgatggatggaacactgcccctgatgataacaggaacttggcagccttcaattgctgagcatgcatactgtccctccttggcactctgctaagcactttctttgtattttcccattgattccccatggcattatgagacagatgctaatttctttagacgaagaaaaaaatgaggcccagagagaaaagtgacttgcccaaggtcacacagctataatggacagagtcgagactcaaacctaggactttctaactgtagcgaggctaagaccttagattctggaaacagacaaacttaagtacggtgggttcatcactgctccttagctatgcagccttggcaagtcacatcacctgcctgagcctctgttttctcctctgtaaattgagggtttgggggagataatactaacactccctgacagctattaagcccacgttgggtgtaataaaataggtaatttacagcacacatttccatggtgcattccctcagtcaattctcacaatagcccccaatgttaggactcctctcttccagcacctgtgttttttggttgttgtgtttttttgtttgtttttttttttagacagtttcactcttgttgcccaggctggagtgcaatggcacaatctcagctcactgcaacctccgcttcctgggttcaagcgattctcctgcctcagcctcctgagtagtgagtagctaggattactggcgtgcgccaccacgcctggctaagttttatatttttagtagagacgggatttcaccatgttgtccaggctagtcttgaactcctgaactcaggtgattcgcctgccttggcctcccaaagtgctgggattacaggtgagagccaccatgcccggccccagcacctgttttatagaagggaaatgtgagtctcagagaggagcggcacttgcccaaaatcaatagcaagtgagtcaggacttaagcccagggctgtggttctagaggctgagctcttttttattttttaagacaggatctctgtcacccaagctggagtgcagtggtgtgatcatggcacactacagccttgacctgtctgggctcaggtgatcctctcacctcagcctcccgagtagctgggactacaggcactcaccaccacacctgacaaatttttatagagatggagtttccccatgttgtccaggctggtctcaaactcctagtttcaagtaatccgtccacctcagcctcccaaagtgctggaattacacaggtgtgagccaccattcccagccaggcatgtgactatttttggccaatagaatatatggaagtggcattgccagttcgaagcctgggtgttaagagattgggccttaagagattccactcattctcttggaactctcgcagctgttatgtgaacaagcctgggctatcctgcctaagagaccactggaacagggactagttatcctagctgaagctgtcctagtcagtcaccatctaatccaatagctgaccacagatacatgagtaagcccaactgagaccagaaaaatctttagctgagcccaggctaaagtgccagtccatgaaatcttgagctaaaaaaatggttgctgttttaaggcactaagttttggggtggtttgttatgtagcattgttgtggcaattgataactgatacacagttttattcagtgtaattaatgctggctgctgtaacaaacaaaatatctcagtggtttaacccaatcagagtttatttctcactcctgcaaagtctgatataggttggggctctcccagggagctcttttccaagcagtgaccttgccccccaatcctgcctccaccccaggctctccatggaatctattcctgaatcctctgcatgtggaaagggaatcagaaaatcaaaggaggcacatccacacttaactgcctttgcgcaggggtcacgtataatttcattggcctttatgtagtcacatgactctactaactgcaggaaaaatgagaacatgaccttcctgtgtgtccaggaaaaggaaacaggttacagaacacaaagcattgcttctgttacattcctcctgttgtggggctggtgtgcgtgcatgcatgcgtgtgtgtgtgtgtgtgtgtgtgtgtctgtgtctgtatgtgtggtgggagttggaggggcgtgtgtgttaagtagagaattaacatctataaagaatcaacagtggtgcatgcctgtaatcccactactctggggagctgaggcaggaggattgcttgagctcaggaggttgaggctgcactgaactgagatcatgccattgcactccagcctgggtgacagagcaagaccgtgtctcaagaaaaaaaaaaaaagagagagagagagagagaatcaacttcagcacctaccatgtgttagcttaaataagggacaagttataggtaaagaatttgaggctcagcttaactgggcctggtgccgcatgcctgtagtcccagctacttgggaggctgaagtgggaggatcacttgaccctaggaggttgaggctgcagtaagcagagattgcccactgcattccagcctgggtggcagaataagaccttgtcttaaaaaaaagaaagaggctgggcacagtggctcatgcctgtaatcccagcactctggggggctgaggcgggcagatcaccagaggtcaggagttcgagacaagcctggccaagatggtgaaacccggtctgtactaaaaatacaaaaattagccaggcgtggtggtgggcacctgtaatcccagctacttgggaggctgaggcaggaaaatggtttgaacctggaaggcggaggttgcagtgaactgagatcatgccattgcgctccagcctgggtgaaaagagggaaattccatctcaaaaaaagaaaaagaaaaaaagaatctgagactcagaaaggttgaggaacttgccccaaatcatacagcaagccagttgagtagctattttgcggtagtgaagggctcagggagatctggagttggacagatctaggtacaaatcccaactctgtcaattcttcactgtgtgacatttggcaagttacttaatttctctaggcctcagtttcctcatccacaaagtggggagctaatacttccaaccttataaggttgggagtgatcattcacagagcttgcatgggatggggatcctggtacatgggccttacataatgaatgtcagccacataggcagaaatgatgctatctctgatcttaccctgccagggtccatgaatttggccaaggggatttattatgttttcgataaatcctatcccttccctctgtctcttgtggtgtaaatggttttatttacttcattaagagatggcaatttggctaagtgtggtggctcatgcctgtaatcccagcactttggggggctgaggtgggaggatcgcttgagtccaggagttcaagaccagcctgggcaacatggcaaaaccccatctctacaaaaagtacaaaaatgagctgggtgtggtggcacccacctatagtcccagccacttgggaggctgaggtgggagaatcccttgagcctggaaggtggaggttgcagtgagctgagatcatgccactgcactccagattgggtatcggagtgaaactctgcctccaaaaaaaaaaaaagagagagagagaaagagagagctagaactatttccccagttgaattttttttaattaattaagtttttaattttttgagacagggtctcactctgtctctcaggctggagtgcaatggtgtgatcacagctcactgcagcctcgacctcctgggctcaagcgatactcccacctcagccggtgcatgccactatgcccagctaattttatgtattttgtttttggtagagatcaggtctcactttgttgcccagctggtctcaaactcctgggctcaagcaatcctcctgcctcagcctcccaaagtgctaggattacaggtgtgagccatgatgcccgctccagctgaatatttgttactgaataaacctttataagcacaaagcccctgaacacctatggctgctgacagatgtctgaaatgcctccattactgcatttttttttgagacagggtctagctctgttgcacaggtaggagtgcagtggcgcaatcatggctcactgaagccttgaactcctgggtgcaagcaatcctcctgcctcagccaccgaagtagctgggactacaggcacacaccaccatgtctggctaattttcttattttttgtacagatgagatcttgctgtgttgcccagactggtctggaactcctggcctcagcaatactcctgccttgcctcccaaagtattgggattacaggagtgacccactgcactcaggcttaaatctttttttcttttttttttttttttgagacagagttttactctgtcgcccaggctggagtgcagtggcgtgatctcagctccctgcaacctctgcttcccgggttcaagcaatcctcctgcctcagcctcccaagtagctgggactacaggtgcattccaccacacccggttaatttttgtatttttagtagagacggggtttcatgatgttggccaggctggtcttgaacccctgacctcaagtgatccgcccacctgggcctcccaaagtgctgggattacaggcatgagccatcgtgcctggctggcttaaataatttttaaagttttgttttgaacaggtagttctgggaggccagaggagttatctctcaggagataattatgctcaagtctggaagataagaaattgttgaacaaaaaactaagttggtctcgacgtgggggtgggggtgttccaggcaaggggaacagactacgcaaatgtcccaaggcaggaacaatctccagaaactgatggaagaccaacgtgagtgaagtatgaagggtaagggagaagtggggtttggatggggagaggggaaaaggcccagactgaaaggcccctgtgggaaccttcataatttgcaggacctggtgcaaaatgagaaaaaggagctccttgttcaaaaattattaagtatttcaagatagtgacagcagagcattacactgacccttcattgcatgaagctggccctgctcatggaccatagtaagaggaaaggactttcatgtgagggctgcagggacccatggaaggtttttgagctagaggtgatgagatctgatttgcatacgctttagttgctgtcgtcactaccccacacctggatgatgtgtgtctctgcacaggtggcctgcttcactttcctcttaaacatgtcactcccctgctcaagaacctggggtggttcctacttcctattagacccagcccagattccctatccagacacccagaggcccttcaaaatcttcccttactggatttagttaatctaatgtcaacaaaggctgtgtgctgaatcccagagagatgatgactcaacccaagttcacacagcaattataggagagcaagtcaaggctggaacccaggtttcctgaggtcggcccatccagccctgagcgaaggtgcagtcctctgaagtgttttgtatcccccatcctagcacagagccatgcacacagtagatgctcaatctgtgcctgtggccgtgagttcgttcctcttagggcacatctctgccagggcatgggtgtcccagagtccaggatgcagttagcatccttcctgactccttctctccctcatccctacctctaggcattcaccaagccccaccgcacccaggccagctggccaggtcctgcccatagacatgttgtttggcctgtgcagtgttttaaagcttttccaattcatcgttctaacattttaaaaaatccggaaacttcacatggcaacccgcatcttgtgtctctttgcaaagtctcaagcctgggtctgggttccttcggggaggcagttctctccaacctctgagcttgcggtgggtggggtggggagcggtcactgtagtccccagtggggcgcctgaatttgggactttgaagcgacagtgccctaattacctccaaggaccaataaggatgctggaagctgattcaatcagacgtataataacccctccttctggagcggggccaggtgggggcaaacgccgcctctggtctctaacaacagggagtaggaggggtgttttgccctaaaccttacaactagccccaacctgatgtttgacttcagaatcccttagggcttcatagatgaaatgaatgcccctgagagaggccatgctgcttcctctcacctggcctctgcctttgctttcttctcccccgggactgtgctcttcgacctcatcttcactctggctggctccggattaccattcagatcttaactcacacgtcacctccttagaaaggtcttcccagagcacgtatctgaagctccccaaaattactctgtactgtaattactccccatcacagcactgacgatcggaaatgattaatttttttgttgtctcctgctagactgtgagctctgagaagccagggacttgggtttgtctcgctcaacagggtccccaggacctagaaaggatctggcatcaacgaaggggctcaacacacatgtgtggaacaactgaaccactggattcacaaaacagctttccctgaaggatgcatgtgacccctgggtcagccagccagcatgggtgggagccagtaaggaggcagccaatttgcaattagggagcaattaataactacccaattggtacaaaagacagctgaggggctgggaggagaacaagggaatgaagctcagaaaggagcctcaggtctttcttggaaaatactgggagcgggcaatgaggaatccccggggtaacatttgaaaacctcttctgttattggagatttaaatgatcagaagcccccctaaaaggacttggtccctttaaaacatttttttttttgagatggagtttcacttttgtcacccaggctagagtgcaatggcacggtcttggctcactgcaacctccacctcccaggttcaagtgattctcctgcctcagcctcccgagtagctgggattacaggcgtccaccaccacacccagctaaattttgtatttttaatagagatggggtttcaccatattggcctattggtctcaaactcctgacctcaggtgatccacatgcctcggcctcccaaagtgctgggattacaaatgtgagccaccatgcctggccaaaacattttttaatggtttgtagagatgagatttcactatgcccaggctggtcttaaactcttggactcaagagatctgcccacctcggcctcccaaagtgctgggattataggcatgagccactgagcccagccaggacttggtcctttaagaagcaggtgtgggccgggtgcggtggttcacgcctgtaatcccagcactttgggaggctgaggcaggcggatcacaaggtcaggagatcgaaaccattctggctaacacggtgaaaccctgtctctactaaaaatacaaaaaaaaattcaccgggcatggtggccggcgcctgtagtcccagctactcaggaggctgaggcaggaggatggcatgaacccaggaggcagagcttgcagtgagccaagatcgtgccactgcactccagcctgggcaacagagcaagacttgtctcaaaaaaaaaaaaaaagaagaagcaggtgtgccgggcttggtgtctcatgcctgtaatcccagcactttgggaggcctaagggggaggatcacgaggtcaagagatcaagatcatcctggccgacatggtgaaaccccatctccactaaaaatacaaaaattagctcggtgtggtggcactcacctgtagtcccagctactcaggaggctgaggcaggagaattgcttgaacctgggaggtggagattgcagcgagctaagatcatgccactgcactccagcctgatgacagagcaagactccatgtcaaaaaaaaaaaacaacctttctgggcatggtggtgtgtgcctgtagtcccagctactcaagaggctgaagtaggaagattgtttgagtccaggagtttaagcttgcactgagtcatgatcacaccactgcactccagcctgggcaacagagacagactctgtctctaaataaatcagtaaatcctgccttagataaaaattgcagaccaggtgtggtggctcacacctgtaatcccagcactttggcaggacgaggtcggtggattgcttgagcttaggagttcaagagcggcctcggcaacatggcaaaactctgtctttacaaaaaaatacaaaaattagccaggcatggtggcatacacctgtagtcccagctactcaggaaactgagctgggaggatcacttcagcctaagaggttgaggctgcagtgagctgtgattgtgccactgcactccagcctgggcaacagagcaagaccctgtctcaaaaaataaaataaaacaaaataaaataaaattgctgttggattaattaggaggtttgatatggagcaagtcatcctttcatgttttgaagtaactttaaagtttgtccactcagtaagacacaagtatccatttgggcttcttcaatattctatggggtttggccgggcatggtggctcatacctgtaatcccagcactttgggaggccaaggagggcggatcacttgaagccaggagttcgacaccagcatggtaacacggtgaaaccccatctctactaaaaatacaaaaattagccaggcgtggtggtgcatcactgtagtcccagctgcttgggaggctgaggcatgagaattgcttgaatctgggaggtagagattgtgtgaaccaagatcgtgcaactgtactccagtctgggtgacagagtgagactctgtctcaaaaaaataaaataaaatattctatggggttcaagagtttcgtttttagggccaaagcattattattggaggaaggcaatccctacttctcccacttatttctgccatgggaggagggttctcctgcccaacacccacaggcccaggcacctggaggcaactctaaaaacagcaggagactactgaaggaaattgtccatctctacgaggcactccttgtgtctccagaatttattaaatgacatcacagtaaggcttggcaagtaggataagggagttagaccagggaggacagacagaagtctgcaggcctgaacacaggcaggaaggaaacggaaaatgcaaacaggagaggtgaggccagagctgagcactgcagaaggaaaatgaacaaccctagtttgtattacagaacactttcacaagtacggtctgcctttatcctcagcagttcttactggtaagatataatgatatccattttatagataaggatcctaaagcccagcaaggtcatggatctacacataactgagccacacatcttagatcagtgctttttctgcttggcacaccccacagggactggcacataatgggtaaagagttgacatttattgaagaaaagtagaaggtatgcatttgacagcacttaaaaaaaaatgtaggccaggcgcggtggctcacgtctgtaatcccagcactttgggaggctgaggtgggtgaatcacctgaggtcaggagtttgagaccagcctggccaacatggtgaaaccacatctctactaaaaatacaaaaattagcccagtgtcattgcatgtgcctgtaattccagctactcaggaggctgaggcagaagaatcgcttgaacgtgggaggtggaggttgcagtgagccaagatcgcaccactgcactccagcctgagcaacagagcaagactccatcacaaaaaataaaaataaaatagaagctgatagggtatatttgagggggaaaagattcaataacagaaattgaaatgtaggtaagcatgaggaagttgtaagcacttcctagctctgtctttttttttttttttgagacggagtttcactcttgttgcccagggtaaagtgcaatggcgtgatctcggctcacggcaacctccacctcccgggttcaagcgattctcctgcctcagcctcctgactagctgggatccacctcccgggttcaagcgattctcctgcctcggcctcccgagtagctgggattacaggcatgcgccaccatgcccagctaattttgtatttttagtagagacagggtttctccatgttgatcaggctggtctcaaactcccgacctcaggtgatccacccgcctcagcctcccaaagtgctgtgattacaggtgtgagccactgcacccagcctctagctctgtctcttacttgaatgtgatctcaccctgtgtgcctcagcttcctcatttggaaatccaggtctcagagtcaggaagtaactttttggttaccttacactgaacactgaaggttgcataagagttggttacatgctgggcgcagtggctcatgcctgtaatcctagcactttgggaggccgaggtaggtggctcatctgaagacaggagtttgagaccagcctggccaacatggtgaaaccccgactctattaaaaatacaaaaattagccaggtgtggtggcacttgcctgtaatcccagctactcgggaggctgaggcaggagaatctctggaacccgggaggcagaggctgcagtgagcaaagattgtgccactgcactccagctggagacagagcaagactccgtctccaaaaaaaaaaaagagagatacactccaggtagatgggactgcatgagcaacggcttgggttagaaattatggcagcatggatgagagacactgttctcatgtattttgtttcacgaggacaataataaaacttgtttactgtgatgacaattaaataagataatgcaggtaaggtgcttagcagaggcttgtacataatgaactcagtaatggtgcttgtttttactgctatttttgttgtttttacagattaaaaaaacaaaggctctgataggtgatatgtaggccaggcacacagctattggttgttgagcaggatttgaacccacagcttttatttatttatttatttatttatttatttatttacttatttacttacatttttaaatttaatttaattttttttttttttgagataggttctcactcattgcccaggctgcagtgcagtgatgtgatctcggctcactgcaacctctgcctcccaggttcaagtgattctcctgccttagcctcctgagtagctgggaccacaggcacatgaaatcatgaccagctaatttttatatttttagtaaagacagggtttcgccatattggccaggctggtcttgaactcctgacctcaagtgatccgcccaccttggcctcctgaagtgctgggattacaggcgtgagcccactgcacccagcctatttatttgcttttagagacggagtctcactatgttgtctagggtggaatgcagtggctattcacagtcacaatccctccactgatcagcacagttttgacctgctccattttcatcctgggcctgttcacccctccttagacacccttgcttacaggaggtcaccatattgaagctgaacttagcacagacactcgatcaatatagcacactacagcctagaactcttgggctcaagaatccctaggcttatcctcctgcctcagccttctgaggagcaggaaccacagggacacaccactgttcccggcaccatatcttcttgacactaagagaccaggctctgaaccactgtgttcaagttaccccgttgtggggcctctgttcctgccctaggggcctccctgactcagcaactgtgggtggccttgcttctgtgcctggacagcagaggaggtgagaagccttccagttccttgaaaaccaaatacggccagaccaggcctctgaggcccaaccctcaggcttggcctgctcctgcctgctcatatgggctgtggggcgcaactccctactcaacctcctggctctgctccaggaggctctggcagaacctccatccagatcctccttctcaggatcttgttgggaaaaatactgaaagagaacataaaatgagtgcctctcatccatgctgcaataattcctaattctaagactttgctcatgtaatttggtccacagagtacctctcaaatcagtgtttaatgtgtctttggtggccagtgtgagctatcaggaagagttactttataactgtgagacctgcagtaagtcactcatctcatccatccacccatccatccatccatccatccatctacccacccattgggcacctacctgtgccaaacacattacatacagactcttcttccagaccggaaactccatgagaattgcagaccaggtgtcaaaagataattattcagggcaggcatggtggctcatgcctgtaatcccagcactttgggaggccgaggtgggtggatcacttgaagtcaggagtttgagaccagcctggccaacatggtgaaaccctgcctctactaataatgcaaaaatcagccaggcgtggtggcatgcatctgtaataccagacacttgggaggctgagacagaagaatcacttgaatccaggaggtagaggttgcagtgagccaagatcgtgccattgcactccagtctaggcaacagagtaagactctgtctcaaaaaataataaaaaaattaaaaaaaagataattattcaaccaatatccatgtgtctcaatgtgtctcctccaatttatatattgaaacataatctgcaatgtggtagtattaagaggtgggacttttgggggcgatcacttcatgaagctccatccttataaatgggattagtgcccttataaaagaagcctgagggagtttgttcaccccttctaccatgtaaggacacatagaagacgtcctctatgaggaacaggccctcattgacacccaatctactgacgccttgttcgtggatttctcggcctctagaactatgagcaacatatttctgttgtttatatattactgagtctgaggtattttgttataacaacaggagcagactaagacaatgaaccgatgggccaaggcttgtccttactacagtcctggtaaggctgttatcattatcacccccatttcacagttgagaagcccgacactcagagaggggaagtacaaagaacatacagccagagatgagtggagctgagacttggccaagttcttaaccctcctaacagggaggaaccatgctaaggggcaggccctggaggaggacacggaccatttctccttcagctcttggcttccttggcaggaagtggattaattctttctcttgtctccttcctaaccaagcctttgagggtgcccagctcagagtctacaaagtccttttcaaggtttccagagccctcctctcagccctgtaggggattcagggcggggggaccttcctcatggttcagatgggagaattgaggcctctattgcccacagttatgtgccatattaggggcctggaatctcatgcttcaagaaactgagcatggaactggctgctagatatttcctgtaggtgtggtatgaagctcttagagtctgacaggtcctagctctgccacttacaagttatgcagtcttagaggaatcacttcacccctctgaactgcagacttctcccctgaatagtgaggacagtgctagtacctatttgagagatgttgggaggatgaaatgaaacaatgcttgtgaagcacttagcgtagtacctggaacatagtcagtgctccaacaatgaggctattatggtactaagtacctaaaacagaacatcagactggtaggaatatccatgctgagggtaatgttagctaatgtttccctttttttgagacagaatctcgctctgtcgcccaggctggagtgccatggcccaatctcagctcacttcaacctccacttcccagattcaagcaattctcctgcctcagcctcccatgtagctgggattacaggcacaagccacttcgccagctaatttttgtatttttagtagagacagtgtttcactgtgttggccaggctggtctcctactcctggcctcaagtgatccaccctccttggcctcccaaattgttaggataacaggcgtgagccaccatgcctggccagctaacgtcttttttattgctactatgtaccagacacattcatctggacaatatccctgtaacttagtgccattttacagatgtgataactaaaattagcccagctaattttcttgtatatttagtagagacgggttttcaccatgttggccaacctggtcttttttttttttttctcagatggaatcttgctctgttgcccaggctggagtgcagtggtgcaatcttcgttcgctgcaacctccaactcccgggttcaagcaattctcctccctgggcctcccgagtagctggggttacaggcgtgtgccagcacgcccagctaattttcttgtatatttagtagagacggggtttcaccatgttgacctggctggtcttttttttgtttgtttgtttgttttgtttttctgagatggaatcttgctctgttgcccaggctggagtgcagaggtgcaatcttggttcgctgaaacctccacctcccgggttcaagcgatcctcctgcctgggcctcctgagtacctggggttacaggcgtgtgccagcacgcccagctaattttgttgtatatttagtagagacggggtttcaccatgttggccaggctggtctttttttcttttttcttttttttctgagatggagtctggctctgttgtccaggctggagtgcagttgtgcaatcttggtgcactgcaacctccacctccagggttcaagcgatcctcctgcttgggcctcctgagtagctgggattacaggcatgtgccaccacgcccagctaatttttttgtatatttattagagacagggttccgctatgttggccaggctggtgtttctcttatttttttgagatggagtcttgctctattgccgaggctggagtgcttctttttttcagatggagtctcactctgttgcccaggctggagtgcttcttttttttgaaatggagtctcactctgttgcccaggctggagtacagtggcgcaatcttggctcgctgcagcctccacctcctgggttcaagtgatcctcctgcctgggcctcccgagtagctgggattacaggcctgtgccaccacgcccagctaatttttttgtatatttagtagagacggggtttcaccatgttggccaggctggtgtgttttttttttttttttttggtttttttttttttttggagatggaatctcgctttactgcccaggctggatggagtgcttcttttttttcagatggagtctcactctgttgccgaggctggagtacagttgtgcaatcttggcttgctgcagcctccacttcccgggttcaagcgatcctcctgcctgggcctcctgagtagctgggattacaggtgtgtgccaccacgcccagctaatttctttgtatatttagtagagacgaggtttcaccaagttggccaggctggtcttttttttttttttttttttttttttttctgagagggagtctcgccctgttgcccaggctggagtgcagtggtgcaatcttggttcgctgcaacctccacctcccgggttcaacagatcttcctgcctgggcctcccaagtagctgggattacaggcgtgtgccaccacgcccagctgatttttttgtatatttattagagacggggttccactatattggccaggctggtgttttgttttgtttttttttttttggagatggactctcgctctactgcccaggctggatggagtgcttctttttttcagatggagtgtggctgggtggcttgggtggctgggctggctggctggcttggctgggtggcttggctggctggctggctggcttcggtggctgggtggcttggctggcttggctggctggctggctggcttggctggcttggctggctggcaggcttggctggaatgactggattggctggcttggctggctggcaggcttggctggaatggctggcttggctggcttggctggctggcaggcttgactggaatggctggcttggctggcttggttggctggctggcttggctggcttggctggctgggtggcttggctggcttggctggctggccggcttggctaccttggctggctggcaggcttggctggattggctggctgggtggcttggctggcttggctggctggctggctggcttggctggcttggctggctggcaggcttggctggaatggctggcttggctaccttggctggctggcaggcttggctggattggctggcctggatggcttggctggctggctggcttggctagcatggctggctcgcttggctggctgggtggcttgggtggcttggctggctggctgtcttggctggctggctggcatggctggcttggctgactaggtggcttgaccggcttggctggctgggtggcttggccggcttggctggctggctggcttggccggcctgggtggctggctggcttggctggctgggtggctggctgacttggctggctgggtggcttggctggcttggctggcttggctctctggcaggcttggctggattggctctctggcaggcttggctggattggctggcttgcctggtttggccggcttggctggctggcaggcttggccggcttggctggctggctggcttggccggcttgtccggctgggtggcttgactggcttggctggctgggtggcttgggtggcttggctggctgggtggcttggctggcttggcaggatgggtggctaggctggcttggctggctggctggcttggctggcttggctagcttgcctggcttggctggcttggctggcttggctggctgggtggctggctggcttggccagctgggtgtcttggctggcttggctggcttgggtgtcttggctggctaggctggctggctggcttggctggcttggatggctggctggcttggctggtttgggtggcttggctggctagctggcttggctggatgggtggcttggctgggttggtgggctggctggcttggctggcttggctggcttggatggctggctggcttggcttgcttggctgtctgggtggcttggctggctggctggcttggttggcttcgctggctgactggcttggctggcttcgctggcttgactgtttgggtggcttggccggcttggatggctgggtggcttggccggcttggttggctggctggcttggctgcctcggtggctggctggcttggctggctgggtggctggctggcttggctggctgggtggcttgactggcttggctggctggctgtcttggctttctagctggcatggctggcttggctggctgactgggtgcctggctggcttggctggcttgggtggcttggctggctaggctgggtggctgtctggcttggctggcaggttggcttggctggcttggctggcttgggtggcttggctggctagggtggctggctggcttggctggcttggggggctggctggcttggctggcttggctggctaggctgggtggctgggtggcttggctggcttggctggcttgggtggcttggctggctaggctgggtggctgggtggcttggctggcttgggtggcttgggtggcttggctggctagggtggctggctgggtggcttggctggcttggctggcttgggtggcttggctggctagggtggctggctgggtggcttagggggctggctggcttggctggcttggctggcttggctggctaggctgggtggctgggtggcttggctggcttggctggcttgggtggctttgctggctagggtggctggctggcttggctggcttggggggctggctggcttggctggctttgctggctgggtggctggctggcttggctggcttggctggctggctggcttggctggcttggctggcttggatggctggctggcttggcttgcttggctggctggttggcttggctggctggcttggctggcttggctggctggctggcttggctggctgactggcatggttggcttcgctggcttggctggctggcttggctggcttggctggctggctggcttgtctggcttggctggctggcttggctggcttggctggcttggctggcttggccggctggcaggcttgcctggcttttctggcttactggcttggctggcttggtcggcttggctggctggcttgggtggcttggctggcttggctggctggcaggcttggctggcttggctgggttggctggctggctgtcttggccggcttggcttgcttggctgcctgtgctggctggctggctgggctgtctggctggttggctggcttgtctggcttagctgcctgtgctggctggctggctgggctgtctggctggttggctggcttggctggcttggctggcttgactgaccggcttggctggctttgctctcttggctggcttggctgggaggctggctttgctgggtggctggctggcttggctggtggtctggtttggctggctgactggctgggctggctgggctcgctggctggcttgcccggcttggctggctgggctggctgggctcgctggctggcttgcccggctttgctggctggctggctgggctggcttggctggcttggctggctgggtggcttggctggctggctggtttgcctagcttggctggctggcttggctggctgggtgggttggctgccttggctggctggctgtcttggctttctagctggcatggctggcttggctgactgggtgcctggctggcttggctggctgggtggcttggctggcttggctggcttgggtggctgggtggcttggctggctggcttggccggctgggctggctggctggcttggctggctgactggcatggttggcttcgctggcttgactgtttgggtggcttggccggctgggtggcttggctggcttgcctggctgggtggcttggctggcttggctggctggctggcttggctggcttggctggcttactggcttggctggcttggtcggcttggctggctggcttgggtggcttggctggcttggctggctggcaggcttggctggcttggctgggttggctggctggctgtcttggccggcttggctggctggctggcatggcttgcttggctgcctgtgctggctggctggctgggctgtctggctggttggctggcttgtctggcttagctgcctgtgctggctggctggctgggctgtctggctggttggctggcttggctggcttggctggcttgactgaccggcttggctggctttgctctcttggctggcttggctgggtggctggctttgctgggtggctggctggcttggctggtggtctggtttggctggctgactggctgggctggctgggctcgctggctggcttgcccggctgggctggctgggctggctgggctcgctggctggcttgcccggcttggctggctggctggctgggctggcttggctgccttggctggcttggctggctggctggcttggctggctttgctggctggctggctgggccggcttggctggcttggctggctgggtggcttggctggctggctggtttgcctagcttggctggctggcttggttggctgagtgggttggctgccttggctggctggctgtcttggctttctagctggcatggctggcttggctgactgggtgcctggctggcttggctggctgggtggcttggctggcttggctggcttgggtggctgggtggcttggctggattggctggccggctgggctggtttacacggctggctggcttggctggcttggctggctggctgtcttgtgtggctggctggcatggctggcttggctgactgggtggctggcgggcttggctgtctgggtggtttggctggcttggctggctgggtggctggctggcttggctggctgggtggcttggctggctgcgtggcttggcaggcttggctggctgggtggctggctggcttggctggctgggtggcttggctggcttggctggctgggtggcttcgctggcttggctggctaggtggcttggctggcttggctgtctgggtggcttggctggcttggctggctgggtggcttcgctggcttggctggctaggtggcttggctggcttggctggcttgggtggctgggtggcttggctggattggctggccggctgggctggcttacacggctggctggcttggctggcttggctggctggctgtcttgtgtggctggctggcatggctggcttggctgactgggtggctggcgggcttggctgtctgggtggtttggctggcttggctggctgggtggctggctggcttggctggctgggtggcttggctggctgcgtggcttggcaggcttggctggctgggtggctggctggcttggctggctgggtggcttggctggcttggctggctgggtggcttcgctggcttggctggctaggtggcttggctggcttggctgtctgggtggcttggctggcttggctggctggctgccttggctggcttggctggctgggtggcttgactggcttggctggctgggtggctgtctggctttgctggctgggtggcttggctggcttggctggcttgggtggcttggctggctaggctgggtggctgtctggcttggctggctgggtggcttggctggcttggctggcttgggtggcttggctggctagggtggctggctggcttggctggcttggggggctggctggcttggctggcttggctggctaggctgggtggctgggtggcttggctggcttggctggctttggtggcttggctggctagggtggctggctggcttggctggcttggggggctggctggcttggctggctttgctggctgtgtggctggctggcttggctggcttggctgggtggctggcttggctggcttggctggcttgactggcttggatggctggctggcttggcttgcttggctggctggttggcttggctgggttgcttggctggcttggctggctggctggcttggctggctgactggcatggttggcttcgctggcttgactgtttgggtggcttggccagcttggctggctgagtggcttggctggctttgctggctgggtggcttggctggcttggctggctgggcggtccactggcttggctgcctgactggctggctggctggctggctggcttggctggctgggtggcttggttggcttggctggctggctgtcttggctggctggctggcatggctggcttggctgactgggtggctggcaggcttggctggctgggtgtcttggctggctgtgtggcttggctggcttggctggctgggtggcttggctggcttggctggctaggtggcttggctggcctggctggctggctggcttggcttgcttgattggcttggctggcttggctggctggctggctcgctttgctggctggctggctgggctggcttggctggcttggctgacctgcctggctgagtggcttggctggcttggctgactggcttggctggctttgctggctggttttcctgtcttggctggctggctgggctttcttggctggttgggctggttggctggctggggcggctgggcctgctggctggcttggctggctggctggctttgctggcttggctggctggcaggcttggctggctggttggcttggctggcttggctggctggaagcttggctgggttggctggcttggctggctttcctggctggctggcttggctggtttttctggctggctggctggcttggctggcttggctggctggctagcttgctaacttggctggcttggctgggtgggtggcttggatggcttggctgactggcttggcttgcttggctggcttggacattaaatataatatatttggtacattaaatataaacattgtatacattaaatataaacatcttttatacatcaaacataaacattttatacattaaatgtaaacatatacattaaatataaacatcttgtatacattaaatataagaatacatttggtacatttaatgtatacaatacattaaatatagacattttagacattaaatataagcatatattcagcacattaaatgtaaacatattttatacattaaatataaatactgtatatgttaaatataaatatgtattttctatattaaatataaatatgtattctgtacattaaatataaacattttctatattaaatataaacatgtattttggatagtaaatataactatacattgtctatattaaatattaacatgtattttgtatattaaacataaacatatatttcccatattaaatataaacatatatttttatgtcaaatataaatatatattttatatattaaatataaatatgtatttcctgtattaaatatacacatatatattaaatataaatatatttttccatatgaaatgtaaacatattttaaacattaaatatattcatcttagatatggcccgtgttggaatgtgtaatagattgagtatataatgtctactcaatataaaatttatatttatatatgcagtaatgattcaggttgattgtagttaagaaaaacaagctccaaattcgaaagaaatatgtaagaagagagacagggagaaaaaataatgaggcaggtaaatgcaacagacaattcgagacccacaagtgcagagcaggcttcccagacccgggtaatgtctcctgggctgataggaagccctcaaccccccaagtccttgtcagccataaaccgcctgagcacagagccagagggaccatgttggggctgggcctcccgacttcagttcctctcattctgtgcaaaggaaaaacaattcagaatctacagaggtttagacgtgtgtagatgtggacagagaagtccgggcacagtggtttactgcccaagaagacagtgagtccccggaggaatagaataatatacatcatgctaatatatgtcatcccagtactttgggaggccgaggtgggtggatcacttgaggtcaagagttcgagaccagcctggccaacatggtgaaacaccgtctctactaaaaatacagaaattagttggctgcaggggtggatgcctatgatcccagaaactcgggagacagaggcaggacgaactgcttgaacctgggaggaggaggttgcagtgagctgagatcatgccattgcactccagcctgggggacagagcaagatcccgtctcaaagaaaaaagaaaaaaagaagttgtgagtgctaagttctctctggattttcaggaggccagttctccagtccacggtgtcctgggaggacaggggttcctgagggtgaacagagcctgtgcccggtcaggtaggatcacatgtccctgaagttcagaacccaggagaatggggagggtcctgggggttcctgctgcatggagggaagaccctctttccacaggggccccagagagcgagaggaaggaggagggcaggtcagtgagtgtgatggtcacagtggagagggaagcagaaagaagtgttcccacaacaagacacacacagtgtccacgctgaagctacagagaggacctctccacctgtgtctgccgcaaagcagtagggcgtcttctggcagcccagagtcacctccagatcccacctgcaccatgcttcctgcggggactgcctgtcttcctaatacactgtcttctgaccagtcttccagacaaatcaccggttgctatatatatatattttttttttaatagctaatatcttacactgatatatttatattatatataaatatttttgtactttatgtttatgctatatatacagatgtagttagctatttatgttatatataatataaacatgatgtatattcttatatttctctggggactcactgtcttaataaactgtcttctgaccaaattcttccagacaaatcagctgttgctatatatatatatatatatatatatatgctatatattttactgcatagaatatataatatattatatagcatagaatatattatatattatatattaattatataatatacattacatattatatataatatattatattattatgctatatcttatatattatatatgttatatatgtatatatatattatatatacacatatacacatacatacacacatgtatattttaatagctaatatcttacactggtatatttatattacatatgattatatacaaatatttttgtactttatgtttatgctgtatatacagatgtaattagttgtttatgttatatgtaatataaacatgatgtatattcttattttcctgtgaggacccactgtcttcttaatacactgtcttctgaccaaagtcttccacacaaatcagctgttactatatatatatatataatatttatatacacatatacacatacatacgcacatatgtatattttaatagctaatatcttacactgatatatttatattacatatagttacatactaatatttttgtagtttatgtttatactatatatacagatgtcgttaggtatttatgttatatataatatattaacatgatgtatattcttatattcttctggggactcactgtcttcttaatacactgtcttctgactagaatattccagacaaatcactggttgctctctctctctctatatatatattttttaatagctaatatcttacactgatatatttatattacatatagttatatacaaatatttttgtacttttgtttatactatatacacagatgtagttagctatttatgttatatataatatatcaacatgatgtatattcttatattcctctggggactcacagtcttcttaatacctgtcttctgaccagactcttccagacaaatcagctgttgcaatatatatatttatttattttttaatagccagtatcttacactgtggctcatgcctgtaatcccagcactttgggaggccaaggcgggtggatcacctgaggtcaggagtttgagaccatcctggctaacacagtgaaaccccatctctactaaaaatacaaaaattgattgggtgtggtggtgcatgcctgtaatcccagctactcgggaggctgaggcaggagaatcgcttgaacccaggaggcagaggttgcagtgagccgagatcgtgtcgctgcactccagcctgggcaacagagcgagactccatctcacacacacaaaacatcttacactgatgtatttatattacgtgtagctgtatataaatatttttgtacttatatgctgtgtacttatattctatatattataaaacattttataaaattatacatgtataaaatgttacataaaaattttaataccattttattgcatatatttctaaatttaatataatgaaattttatatataataatgtataacatttctaaatttattataatacaatgatatataattattttctcatattataattatacataagataatttattataaataaaattttatataatctacatttattataataaaacatataacacatttctaaatttaatacaataaaatactatgtataataatttataacgtttcaaaatttattatataattttattatacaattattttgtacataattatatatagtatataattgtatttatagaaatataattatgcatatacaatatgtaattttatttttacatagtatatatgcataattatgtattaacaaatataataataattttatatacttatttacattaagttacatattatataaatgatgttatatgttatatatattacatatatttttgcttaatatattaaatttaatctataaaattatgtattacaaataaaagtgtattttacatatacactacatataactttatttatataaaaatataaaagtcacatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccaccctaaggggagatgggggagttgggatggacacgttgaccagtgaggactttcctttgctggttttgaggtgtcttagcccagaagctaagacgggaagtgattctggagcaggtgagctgatcacaagcctgagccaagaatccatggagctcataaatagcagaagccaggaccctgtgcaaatccttctgaaatatcccccgtttactgggctcctaggggtggggaagaaaaattccctgacatttcggcctcagggaaagagagagacatcccactggccggaagcctctgctatttttcagaagacacctggggcatcaccctttcccaaatgacggtgattttcagagtggttcactttttggagagacatttctgccctggagatccatacatattgaatccaaacgaatactttttaattaaaaaaaattaaacattagaaagttcaatattgaggcagctacgagtttgaattcctcatttttcctaaatgcatattgtcaaaatctgtattgcatttagtaactacctatgtttctaatgtatataaggttacacaatgttttcttctttttctcctcctcagggtcagaatttgaaataaaagttttggaaagaaaaaacactcttgtctgtttgtgcaaaaataaaagaacccatattttaagaatattttaagataaatacaaattgtgtgtgtgggggggttgcttataagaattcttcatatcctaaatcaaagatagatcttgttattaaccagaaaacaaaatgtgtgtgtataaatgtacaacactcttacactcacacaaacacaggcacacatgcgcacacacacattcacgcactcactgatgtactcacacaaacacaggcattcatgtataaatacacacctaagcatgtatttatggaaatataattatgcacatacaacatataattttatttttacatagtatatatacataattatgtattaacaaatataagatcaattttattatatacttatttacataaaggtatatatgatataaatgatgttatatggcatgtatatatcacatataactttgcttagtatataaaatttaatctataaaattatgtattacaaataaaagtatattttacatatacactatatataactttattatttatatgaactataaaaatcatatgtttatattaataaaatatatttatttatatcaatatattaatataaagtatacacaatgtatatttatataaaaatttttaattaaaaaatattcattttggttcaatatgtatggatcgccagggcagaaacgtctcttcaaaaggtgaaccgttctcaaaatcaccgtcatttgggaaagagtgatgccccatccgttttctgagaaacagcagaggcgtatggccagtggggtgtctctctctttccctgaggccgaaaagtcagggaatttttcttccccacccctaggagctctgtaaaccggggatatttcagaaggatttgcacagggtcctggcttctgttgtaaatgagctccatggattctcagctcaggcttgtgatcaactcacctgctccagaatcactgacacaaatgcaaccacacacttacacaaacacacatcaacacgaagacagaatcacaaaacacactcatagaaacacatggacacacaaagacatgcacactcacacaaacgcagggacacacacacaaacacaattacaaaaatgtgtgtttttttgcacacgtgggtgcacatgcacattgacattctcacaaagcacacaaacatgtatacatacaaagacactcataaacagaatcatgaaaacactctcatataaacacgtggatggctactcacccacaaagacgctcacatatgtcatacacactcatacacacactcagaatcacacaagcacacacaaacacataaatacagtcacacactcatgcaaacacagtcacaaaaagactcacataatcatgtggacacacaaacataaaaattcacacaccggggccgggcaaggtggctcacgcctgtactcccagaactttgggaggctgaggcgggcagataacttgaggtcgggagttccagaccagcctggccaacatggtgagaccccgtctctactcaaaaatacaaaaattagccagatgtggtggcgtatgcctgtaatcccagctactcaggaggctgaggcaggagaatcatttgaacccgggaggcagaggttgcagtgagccaagattacgccactgcactccagcctgggcaacagaacgagactctgtatcaaaaaagaaaaattagccagatgtggtggtgggtgcctgtaatcccaggtactcaggaggctgaggcagaagaatcatttgaacccgggaggcggaggttgctgtgagctgagattgtgcctttgcactccagtatgggtgacagagcgagactccgtctcaaaaaaaaaaaaaaagaatttatacattgccatacagattcacacacatacattcatattcacaaacacacaaatacgataaacacaggggcacacacaaacaccatcacaaaaacacacttccataaaacacaggaatgcacgctcacacagaaacatgcatggaaacacacgttgtcttacagactcacagaaacactcatcatcacataaacaggcacacacagccacacaagcacacacccacacccacatcaacacacacactcccacacggcacccacgcgctcactcacacaggtagaacaggcctgcattacctgataacgcagttaaatcagacgtgatgctgcctaccgaggagacctggaggcttcccatgaatgggctttcagaagagaggtctctgggtgcatttggtgacaccccaggcagtgggggagacgtccaggctggaaggccagccacagccagctctgctcaaggatgccacgtccatttgcttcagtaggatatgcaccctggtaacccaggttcctgcctctccaggaaaccccactgaggtcagcacatccccccaggtttagaaggggtctctgggtgcatttggtgacaccccaggcggggggggacatccaggctggaaggccagccacacccagctctgcccgcagatgccatgtccatttgcttcagtaggatctgcatcctgtaaaccctggttcctgcctctccaggacaccccactgaggtcagcacactgcccaggtttagaaggggtctcttggtgaaatgtggtgacaccccaggcagaaggggggacgccacagccagctctgcccgcggatgccacgtccatttgctttagtagaatctgtaccttggattcccaggttcctgcctctccaggacaccccactgacgttagcacaccctccaggtttacaagcggtctctgggtacatttggtgacaccgcaggcagaggggagacgccacagccagctctgcccgcggatgccacgtccatttgcttcagtaggatctgcaccctgtaaaccctggttcctgcccctccaggacaccccactgaggtcagcaccccccaccccccacccccaggtttgtccagcttcgctgtctggggagagacacagaaagaccacattcggtggaattctggctataaccttttgtggccggcaagaaggatcaccaagctgtcctgttaccttgctggagtgatcactggtttcacgcttggcccccgtgcagtgagtgcctgggccaggctcgatttctggagctccggtgaaatttgggcttggagctcacgcctgcaccatccagaaagcagaaggcagccggcccgggctgtacggtttgtagaatcagagagaacactgtttgccttcatgtctgtaccacaataaatctgccaactgcagtcaaagtctctggattcctgacccctcattttattttgtctattacggagtggaaggagtgagaaagattttgcttcctattttgttttgcaaagtgtttctaagaaaaacaacccatgttctgaaaatgagattctgagtgtcccctgggcgtgatgaaaacaaattttgggaatccaagggcctgagaggcagagtgaatgtcatttgcatttccctgcgaatgacaaagtcactttttatttattattattattatagattcaggggatccacgggcagctttgtgacctgaggatattgtacgttgctgaggtttggggtatgaatcatcccgtcacccaggcactgagcattgtacattcctgaggtatataatgtgtactaaaaataaaatgcatatttatatatgcactaatgattcaacttgattccttgtaattaagaaaaacaaaccccaaattctagaggagttctagaatatataagaagaggtccaggtgcagtggctcatgcctgtaatcccagcactttgggaggccgaggcaggcagatcacctgaggtcaggagttcgagaccagcctggccaacatggtgaaagcccgtctctgctaaaaatacaaaaattaaccaggtgtggtggcgggtgcctgtaatcccagctacttgggaggctgaggtagaagaattgcttgaatccaggaggcagaagttgcagggagccgagattgcaccactgcactccagcctgggtcacagagcgagactccatctcaaaaaaaaaaaaaaaaaaagagagcgagagagaaaacaaacaagcaagaaaatgcaacagaaaaatccgtgacccaaagctctctccagttgctgctttctgcctgaaattcaaagaatctcagggtagtttttcaacccttgtacccccgcccctgcttcctgctctattagtactgagggtctgtggtgccccttcattgtatccaggtgcaggcaatgtttagctcccacctataagcgagaacatgtggtatttgattttctgttcctggcgttaattcactaagcatagtgcccttcagcttcatccacgtgactacaaagggcatgattttattcttgttcatggctgtgtagtattccatgatgcggaaggaccacatttgctttatctaattgagaacatgtggtatttgattttgtttctggcattaattcactaagcataatgcccttcagcttcatccatgttgctgcaaagggcatgattttattcttgttcatggctgtgtagtattccatgatgcagaaggaccacatttgctttatctagtgaagaacatgtggtctttgattttctgttcctcatattgattcactaagcataatggcctctggctgcatccatgtggctgcaaagacaagattttatttttttcatcactgtgtagtattccgtggtgtagaagggccacatttgctttatccagttgaggacatgtagtatttcattttctgttcctggcattaattcactaagcataatgtccttcagctgtgtccatgtggctgcaaaggacatgatattattctttttcatggctgcgtagtattccatgatgcagaaagaccacatttgctttatctagtggagaacatgtggtattcgattttcttttcctggcattaattcactaagcataattcccttcagctgcatccatgtggctgcaaagacatgattttattctttttcatggctgtgcagtattccatggcgtagaagggccacaattgctttatccagtcaagaacatgtggtatttgattttctgttcttaattcattaagcataatgccctccagctacatccatgtggctgcaaaggatgtgattttattctttttcatggctgtgtagtattcgatgctgtagaagaaccacttttgctttatccggtaccctactgatgggcaactaggttgattccatgactttcctattgtaagtcatgctgtgacaaaccttacagggctgggcactataatcccagcactctggagggccaaggtgggcagatcacctgaggtcaggagttcaagaccagcctggtcaacatggtgaaaccctatctctactaaaaatacaaaaactagccaggcatggtggcgcatgcctgtaatcccagctgctcaggaggctgaggcaggagaatcactttaacccaggaggcagaggttgcagtgagccaagattgctactgcactccagcatgggcaatagagcgagactccatctcaaaaaacaaacaaaaaaaaaggaactttaccatgcatgtatctttttggtagaatgacttcttttcctttgggtagatgcccagtcttggaattgctggtgcaaatggtggagcagtttggattcaggaggtacatgtacaggtttcttacatgtggacgatgtgtgatgctgaggtctggggtatgagtgatcccatcacccagatagtgagcataataccccacagttggttttttcaactcttgtccttctaccttcctctctccccctaactagaacccagtatctgttcccttctctgtgtctacctatacacaacatttagctcccacttatagtgagaacatgcagcattctgttaatttacttaagataatggcctccacactgttcacaatagcaaagatgtggaaccaacccaaatgctcatcagtgatagactggataaagaaaatgtagcacatagacactgtggaatactatgcagccatgaaaaaggatgagttcatgtcctttgcagggacatggatgaagctggaaaccctcatgttcagcaaagtgaaacaggaacagaaaaccaaacagtgcatgttctcaccataagagggaagtgaacaatgagaacacatcgacccagagaggggaacatcacacactggggcctgttgcaggggtgggggactgggggagggacagcattatgagaaatatctagtgtagatgatgggttgatgggtgcagcaaaccgctatggcacatatatatctatgtaacaatcctgcacattctgcacatataccccagaacttaaagtaaaatagaaaaaataaaaaataataaaaataatttaaaaagataatggcctccagctacatccatgttgctgcaaaaacaaacaaacaaaaaaaacaaaaaaatgattttgttccttttcagggttgcgtagtattccatggtgtagatgtaccacattttctttgagggtagagggtgggaggagggagaagatcagcaaaaataacctgtggctgggtgtggcagctcacacctgtattctcagcagtttgggaggctgaggtgggtggatcacctgaggtcaggagtttgagatcagcctggccaacatggcaaaaccctatctctactaaaagtacaaaaattagccgggcatggtggtgcacgcctgtaatcccggctcctctgtaggttgaggcaggagaatctcttgaacccaggaggcagacattgcagtgagccgagatcgtgccactgccctccagcctgggccacagagtgggactccatctcaaaaaataatcataaaaataataataataacctgctaggcttaggacctaggttgattccattacaaaaaaaaaaaaagaaaaaactaactttttaaaagaaggatctctctgttcaaaaacaaaaccaatgccctgtcaggaaagatgttctgtgtttctggtaaagctggaaggaacctacaggaaggagtcaccccataaaactagtggagcagcattaccttttgaggtgagggctacttctgttaggccaccaggatgagtgccttcctggggagtgtggttcatcctataccatccaggaagcaattcctgcccccaaatcacttgccagcttctgccccgtaagtaaaatccccagcaagcgggcagcaaggagctgcttgccttggaagtcagctgaagtctctgcccaccacccagactgtgtcctctgggaaaggccaggtcttccagttggatggttttcacattagcggctgcttagaatcatcaacattggccaggcacggtggctcatgtctgtcatctcagcactttgggaagctgaggcgggcggatcacaaggtcagggaccagcctggccaacatggtgaaaccctgtctcaactaaaaaaaaatacaaaaattagcttggtatggctgggcatggtggctcatccctgtaatcccagcactgtgggaggctgaggcgggcggatcatgaggtcaggagatcaagaccatcctggctaacatggtgaaaccctgtctctactaaaaatacaaaaaattagccaggcacggtggcaggcacctgtagtcccagctactcgtgagactgaggcaggagaatggcgtgaacctgagaggtggggtttgcagtgagcccagattgcgccactgcactccagcctgggcgatatagagtgagactctgtctcaaaaaaattaaaataataaaaaattagcctggtgtggcggtgggcacctgtaatcccagctactcaggaggctgaggcaggagaattgcttgcaccccagaggcagaggttgcagtgagccgagattgcaccattgcactccagcctagacaacagagtgagaatctgttgcaaaaaaaaaaaaaaaaaaaaaaaaaaaaggaatcatcaacattgccttggcccaatctcttcccagacttgtcaaatatttaccactggacctccatgttctagtttcaaagctctgctggccacagtggctcatgtctgtcatcccagcactttgggaggctgaggtaggaggactgctcgaacccagaagcatgaatccatcctaggcaacatagtgataatagtgtcaaatgagagccagtgtccagtaattccccaaatatctgagaattttcttttctttaagtcacagtcatcctggcagaaggctgtaggtccctttggggaagactgggaaaaagattaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaacaacaactaagactttggtacagcccattagctctccctgtggataccatggactacacaatgccatgggtgtctgtgagtcaaaccattctgactgctgctttgacactgctttccactgtggtgaccacacccacctcatctttggtgattaaggacagcccatgttccctgccaccccaggattcaattatcctcattttacttaaagatcccagtccagtggctgcagttcctgctgtaacattttgcctactgagagcacaagctcaaagctcttccaggatactgggctcatctcacaatattctttctcatgatcgttgtgaggagtatgttctgtagacccttcagtgtgagtgagcaggtctgacataataaatccagtctccctgagtttttgcatacctttctgtacatataaaccaaggaagttgtggcatctcaactttatgtaccttaggtaaactctgattctgtttcagccaaccaaccaagtcaccaaacaaataagcaaacagccaaccaatcaaccaacaagcaagcaagcaagcaacaaaccaaccaaacaaccaagcaaggaagcaagcaccaccaaccaagcaagcaaccaaccaagtaaccgatcaaaccaacccttggagccctttctaaagctttgacctacaactctgagtccagaatctctgtttagtgggccaacattaataaatttagcctaatccaactttatgttactttcaccatggtgccacacacttaatatccattcccacatatattctccagatttccttctgtataaattgcatgtgtgtgtgtgtgtgtgtgtgtgtgtgtgtagaaagagaggatcaactgaaaaatcacacaattttataaatttagaaaagagagctttatttcttataaaggtttgcagtctgcaaggtggccattatgacaggctgggaagtgtggcctacagccaaggccagaggcaggcatttccagggagggagggagaggacaggaatttgagccaaatgagttggctacatatacatactcaataggatatcagaggagctatatcattttatgagaatactcataaaagaggtcctaacacatgcatattcaataaacatgcatgttcattctggggtggagacttgacatttaaatgtattataattaggccctacacatcaaaaagtgaagcagggacatgaaggtactcagcctcgtaaaggcacagcctctaaaactggccagaaccagtccatggaggatggtctcttatcaggagaaagttactgaaatcagtcccttgtccagagaaagctgtcgttaaggttagtggggcaggagatcagttactcagcatctgtgaactgggtgagttgtaattgttttaatcttctctcacagccatctctcacagccagtgcttgcttggctgctagagaaaaataaaacccatgtggtagctagaatctagttaattctttaagagtagggtacaagacttaaccctcgcctggcatggccctaggtcctgtttataatttgaggtcttattgccacaaagagtctgttctgtcagtctcatgatctctattttaacatcaatgctgttcagttgttgggtctaaaccataagagggagggaggtacagggaggtatgtctgacttcctgtcctgtcatggccaagaactgaattttaagatttatttgaggttccgttggccaacagggggtctgttaagttgggtggggggcttaggattttagttttagttctcaagggagataaaataatttaatcaattggcccctgcgactgtgggactaacatggctatgatctgtcggacagacttcagggtggcacccaggcaaaattctatgctgtagtaaatgcatcatgcacatttgtaacaatatgtacataacaatgtcacaaaatactttcacggtgacacctagattagtattttattgaatagctgatgatataaactggctcatttgatgccaagactgaccattaccaccataccaaggtcatcactgatcagaggcctaacccaaggagggggtcatgtgcagacccagcagtggggaggaaagatgctgcagaggagacagatgcccacagaggcccctgagcagataccatgctcactaagtggtaagtatagactcaacgtaggctgtaaggtctccccctgtgcaaatgggacatccacttgagagtcaagggtctgtttgggtggcagggatagccacttctgaaggtagaaaggaaataagccaccaaattggtatctttctgtgaaatggacatcgtgcttagaatctccattttccccacaacctggaggaataagtactgtcatgtgcattttgtagctgaggaatctgatgcaacaaaattaaattacttgcctaagcaattagcaattaaccaagtctttctgactcagaaactcagctgttgcctgttcatatccagcccctgtattggggtcaagatctggcctgttctcaatgcagcaagatccaggcagatcacactggactcccagcactgaatctggctcaaggggacatcaaatttgactgggtcgtggggctcaggagcatcactctcaaaaatagtggtacaggaagaggcgatgaccctaaacagcatttgcaggcagatcccatgttaatcataagggtcaggactctctcacttttctgtctctctctctgtctctcctctagggctgaccccacattggacaccactgcatccatgtccatcacacaccacagctgccttttcttctgcctgcttatgggaaagtcccctcctctcctccgttttcttctcttcctgccctatcacaccgtgcacttctccctttccttaaagaaccaccatcaactttaggaggagggaaaggggtggctctggcaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacacgggagaggagaatggatttataaagaacatcatctaaatccaacttgaccattgtgtggccacacttgctagattgctttagtctaaatctagcattgtagaaagacgggggagcttggagctgcacaaaccccggtctggaactggctccttaccttgaaaggtgaataatcctggcaggactcttagccttcctgggcctcagtttctttatctgtttcttgggaaggaggatctctgctggttggttgggtgatgtgggggctgtgtgaaaacaacttgtcaatacaagccaaaacaggaatatttctccacagagtatgaaggtcaaatgagagaatacatttaaattaaatggaaaatttaaatggcaaaaaaggcaaagctgtattgaaagttctgagcttctctataaggagctttttgactatgtaagaatcctatactcgttccccctaaatataaaaaaaaaagttgaaggaggcagaagggagagtgatgcacgatgggcgaggacttcacctgctgttgctggctttgaggatggaggaaggaggccacaaacccagaagctggagcccctagaagctagaaaacgcagggacctgattcatcccttgagcctccagaagggacatagccccaccagcaccttgactttagcccagtgagatcctcttaggacttttggcaaccagaactataagacggaaatggaagccactgagtctgtagctgtttgctgcagcagcaatagaaaactaatgcagagcccaagaaatcactggtgatgagatggggaagtgggctcaggaggtctggatctgtgatgagatggggaaagtgggggaggtctggatctgtgatgagatggggaaagtgggctcaggaggtctggatctgtgatgagatggggaaagtgggctcaggaggtctgaatctgtgatgagatgggggaagtgggctcaggaggtctggatctgagttggggatctggagtggaaggggaattcatttgttcattgtctatccttttgcattgattcagttttttttccatatatatatatgtgaatttcacaataaaagttttttccaaaataaaagaaacaaaaggggctttttgcaactcaattcctatctatgtctgagtccacttgtattgaatgagtctttctgctaacgtccttatatttgggtgacaatctgaatgtcagtgaccaatcagagcagaggcagaccttggagtgggcagggcatcctgagggccctgattcctgccatgaggcataaccctttagatgccagaccatggggaggtccaggggttgcaggggagggctgtgcatctgcaatgactctcagggggctcccggtggtggcaattggtgaatctgcacggcagtgtttcaatattgtcacagccctgctgtctctcatgctctcaaaaagcatttctcttacctgtgacagacttcctatacctaacagcttgcaaaaatgttccaggttaacgagaataatctctcggagccatacctccctgcttggggtctcagtttccccaactgtctccagacaagttaggctagaaggcccctgagcctcagcccctctatacccctcctgtcacccagacctgatctggggcttgcaccctgggtgcagcatgacaggggtgggcagggtctggctctgggccagaggaccctttctgatggacttcagctgttggccttccaggggagactgatcaacctcacaagagtcatacggtgagtagcggtgggcaaatccatccccctcatcttagatttatggggagacagagagaaagaggagacactccaggaagacctgcaggtgggagtaccaggttgaaaccaaggacaccttcctggaggagctgctgtttgagccagctctgagaacaggtggggacaggactggagaggagaagggtgtcccctatgagcaaagactggccaccacccaatctaacacccccacagggcccctgtggcatccctgtccagtccctgtcaccacccagtttttccctctggacccaggaattcaaagtaagcaaggaggtccgctgctccagttggctgcatataattacaaccttgagcccaagcagcactttgggtcctggtttgggaccatgaagcggctcggtgagactgagaggtaaggccagggcaggaattgggatagtgggattgaactctccctgggggccagcctcagaaagcctgtggccatggcctcttggtcaacatcagatcctgtggtctggcaatgcctggggtacccagacctcactctggacaggccctgggagggggccctggtgagattcctggcagcctcacagccactcttctgtccatagctacaacatgtcatgccagctggaggctccatcccagttggctgggagcacaaaggccaggaagatagacatcacccaccacaggagccagtcgggtcctgaaccagggcgggcagaggttggctgccttgggatatgggtgggctcagggagtcagacagcaagggactagcctcccatcctactgctgaccagccctgtgactggggagagtcaccttacttctctgggcctcagtttccccctctgtggagtgacactaaatgatctctctggagactgggatcaatagggcactggtgattgaccaggcactcagcacatgcctggagcacacggtgcagggctgtggtggggaggtggcctgagttcctggggagtcacccatgtgtgcctgccgttctgaccagccaccaggcactcagggcagagcccactaccagcagcagctcacaccccgataccagctcagaggcggcccctagctcagcagcagggacatcacggacactttaagctgctactagggtggcttctccagctcccacgtggagaggggtcccagctgagtcccactcacgtggagtctcatgcccatgaaactgccattcaccactggccaggctcatgaggccgcatgaaacgggggtcactgggcaggagatatcgggggaacagagagggtggttgaatttttgtataataggcagtgcaagtgtttaccgtttgggaggggaaaggtttgttattattagcaatgttacacttgaatattatactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagccgagcctgctcctcagagctgccgggactgcgagaattggcatgttcacagggcactgtcacagcctctgaaacatgctgtctttaaagacgtttgcaggctgcatgcggtggctcactcctgtaatcccagcactttgggaggcagaagcggggggctcacttgaggtcaggagttcgagaccaacatggccaacatggcaaaaccccatctctactaaaaatacaaaaaattagccaggtgtggtggcaggtgcctgtaattccagctacttgggaggctgaggtaggagaactgcttgaacccaggaggcggaggttgcaatgagcagagatcacaccactgcactccagtctgggcaacaagagcaaaacttcatctcaaaaaaaaaaaaaaaaaaaaaaaaaacacaaagacatttgcaaggaccatgtcctcacccagaatggtgcctgcctttctacagtttttcaggaagaggaaacattttctgcttctctcgctgaggttttttttaaccacccattaggaacctatagatttcaggatcgaacactgggattccctcagcactaaaggaggaaaattgcaaacagagctgaaagtgcaatgtgcaaaggtgaggctaaggaaggttcttagccagtagaccaagggcaggaaggacactgcctcctcagtctcccactagggaacttgtgattcgtctcccctgacctcagaattccttgtcatgtttgttttgtctccaagggaagggtttgaattacagaatttaaggctagagtgagcctcgtgcagttaacattaaccctctctctccttcgctggccgaggtgaagtccgggaacatgtagttctgacgtccactctctcgggggatcaccagttcacccatctcacctggcaagctgggccctagtttggcgacaggcatcttccacccacctgggaggcagggttcaacactctgcctctgaccttgtttccttcttctgccatctgcttaggcagccagaaggggttgtccagccagcacctgggctttggcactcctcaagtaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatctccctagacttgcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggacggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaatgaccagatgaaaatcatccttatgccagaaagacttgtttttttttttttcattactagaaatgaaacagtaagtatttgttgtattgacatacttaggcttagacctatgtttaacatgaaagcctaataatagcactgtggttagactgcagcctatttttccaaaccatcattttattattaaggaaacgaaggatcaaatacctttcattcatctgatatgatcctttaaaacacattccactaataagtcccatttggaacagctgaaaatcttttaataaaactttttaaagatgagctcatggcttagtgtaaatttcacaagcttaattaggtcaaatggaaggaactcagatgagtagttgcccaatcagagcccatttgtaagtcatcagacccctccatgaccttaaaactccactctgacttaattattgcaaacctatatacaacaaagtgaaaggattaattttcattcatcaacctctcaatcccagattttcaaagaaaaaacctatgtaaggaatacttaccaaaaccagacaggaaaattagagcctgcatactttagagtcaaatttgttccactacagccaggtcgcatacaattacatcatttggttcttcatacactctagaactgactaggacagagtttagcatagaaaaactgtaagaaattggttctgaaacatagaaattgcaaagttcaaaaggctatgaaaaaaactaatgtaaatgagagactcccctccttttgttttaaagaaatagacccatcagagaaatgcaaatcaaaaccacaatgagataccatctcacaccagttagagtggtgatcattaaaaagtcaggaaacaacaggtgctggagaggatgtggagaaataggaacactttcacactgttggtgggactgtaaactagttcaaccactgtggaagacagtgtggccattcctcagggatctagaactagaaataccatttgacccagccatcccactactgggtatatacccaaaggattataaattgtgctgctataaagacacatgcacacgtatgtttattgcggcactattcacaatagcaaagacttggaaccaacccaaatgtccaacaatgatagactggatgaagaaaatgtggcacatatacaccatggaatactatgcatccataaaaaatgatgagttcatgtcctttgtagggacacagatgaagctggaaaccatcattctcagcaaactatcgcaaggacaaaaaaccaaacaccgcatgttctcactcataggtgggaattgaacaatgagaacacttggacacaggaaggggaacatcacacaccagggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataattaaaaaataaaaaaagaaagaaatagatgttctgtaaaaatatacacaatttttacagacaaatacatttataagttgtttttgtcttaaaaattggggatatttcatatttataactaattattgaaccttaagttttcttggccatttctaggctaataaactaagaatcatgtaaactaagccaaagtagaatagacataaaagtcctgaacacttcaacttctatccttcaagaagtatacctcgcaaagctcatttgagagaggaaaatctttcctccaccctctgttttacagcgctgaggcttctcatcacatttctatgacttgtagcttaaatccatgttacatggtcactggcattgttagtgcttctcttttaacactgtaggagataatcaatttggtggtgtatttaattctatcactagaggattgtaaaattacatatattaatacctcactttagaggccacttaatttttttccaaggggatatttgactatatttcacttgtgtcttatttaatgattttataatttaaaccctaaattataaatctagaatttagaaagtatatttccccactggattacatttttggaaatattattttatatgtgcacaaatattacaaaatcactgtagacacctgaaaactatattatcttttaaaggcaatatttacattaaactggtataacaaaattgtttggtgcattttttccagtacattttgtatatattatgtttaacctttttttattcagcaaataatttttgagtatctactaagtgctaggttctgcattactaactgaatttaaagagtgaaataacagacatggtctcagacaataaaaattaacattaggtcacctatttatatatttttaaatggtaattatgaaaactttttgagatttttaactagataacattataataatacacttgatgttgttaatatttgccagtgagcaaaaaagaaaataaaaagatggttttattcaatatacactttaaaattgcagaaaatagtcaagtttctctgctttgcagttgaatgtctatgtgtttttctctgcaacttggcttttgtggagtgaaacaattattcttccagcccaataaaagcagaagagtaacaataaatctgatattttaaatgcttatcaaaagatagtagacatattatttcagaatactgagttcaataagttgacctacaaaaaaagccaaactgacagtattactgaataaggaaaggcccaaagagacaaaatattttttattttgtaacctcggtatgacacaacttaccctaactataaagaccctaaatgaccaagatgggtgcttataatatggagagtaaaaaagtcatttcacttttagcttttttatttctctcagaataaaaagtgtataaggagttgataaagaagttgatactataagttagtactacaatgacagcacttttcaagaaaagacttttttctctcttacaaatatcatgttagcagtatttgttttctccagaaataatgaggaaataaaaacataagtatgtgggtaattagttagtttcttaaagaaatgagttaggcaacaggctaataatgtatacttcactggcttttgaatgccaacaatcatattctttataaagcacagagaagatttttctaaagaataagtatgtgaacctgaaaagtaatcaccacttggtagtgacaatatggatagggtgaagggtgtcatcaagaagcaatgaaaagatacatttgcagttaaatttgaaaaccatgatgtttaatacatatagtaataaagaatactttctcctgtttcaaaatcattttagaatttaagatagaagctaaaatacctagggataatgatatgactatcaaaaattaaaaattaaaggacattttgagtattataagttaagaatgagaacttattacccaatgaacaggggataattcattatgctccatatccattgaattaaaagacaggcccattacgtggataatttgaaagtttaattttatttaaaagtcttgtttcattcatcaagcaaaatgattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtacattgcaagagaataattattttctttattaaaaaagaaatactggatgctaagtccaaaagacataaattattttatactaataactactaacattttattcatgaaaatataaaggtcaaagattttaaaatgatctttaaatgattaataacatgttgatctttttcttctttctgtaaacctttttgagtcttaaaaatactaaactatacaagcaatattaaatggtatataaacttggattaaaatattcaaatttactagaatgtagacattggaaagaatgaaaataaacagaagcataaagcagcagctataaaattaagaaagcaactaagagtgtttaaagtacatattcatctgtagtctaatgtctaccataaaaaatgactcttctcagtaaaacacaaattgttcatgaagggaaaaagcatgttgtattagagaatattcaacataatttctttagtactaacttgtgcctggagtattattggtttttctattatgaacttatgcacttgataatttttttcataaaaattgtatgtacaactctgactgtactaaaaatacaaaaattagccaggcatggtggtatgcacctgtagtcctagctacctggagggctgagacaggagaatcgcttgaacctgggaggtggaggtcgcagtgaaccgagatcatgccacctcactccagcatcagtaacagaatgagattccatctcaaaaaaagaaaagagtgtaatatcggtatacacaggtaatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtaccatataatttacaagtgttatctcatttattgtaggtaaaatgtaattttgaactctgggagtataaatgaattagatagaataaaattctatttaaatggccatcagtaaatcggtatctaggaacagggtgatacagtgcccaagttttctattcttactaaatgttgtgtttcattttcaatgttttcttggatattgctcttttttggtgattttgattttttttattttagaaaactaataaattgactcttcttggtactgactcgggttttatagaagaagaagtaattaaattctgtacatttacctttacctcattttttgtcttttaaatttattttaattgacatataataaatgtacatgttatggggtacagagtgatattttgatatatttatgcaatgtgtaaagatcaagtcagagtcattatcatatccattacctaaatcatgtattatttctttgcagtgagaatattcaaaatcttttattttagttatttgaaaacacacaataaattcccgttaactacagtcacccaacagtgctgtagagaactagaacttcttccttctctctagctgtaattttgtatgtattaaccacagttttcttatactcttctttctcctactctttccaggatatggtaaccaaaactctactatctacttctatgagattaaaaattttagcttccatacataagtgagaacatgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtgctgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaagaacataaaggacaaatctacaactaagatcatactgagtgtggaaaaggtgaaagattttactgtgaacaagaaaaagattttactggaacaagaaaaggatgcctattctcaccaatcatatttcacatagtgaaagtcttaaccaggacaattaggtgagagaaagaaataaaggacatctgaattggaaaggagacagtcaaattgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagattttgacaacaaaaatgacaggtattaatgaaagaaattaaagaaaacacaaaaaaggaaagacatccatgtttacagattgaaataactaatattcttaaaatgacccactatcctatgtgatttacaaatttggtacaatcactagcttgtatttttaaaagcacctttgctgcatattcttaagacattcaacaatgcctggatttaagtttgaggtattattatatctattttatactgggcacaatataatgttatcagaggtaacggttttgattggtcctaggtcatacagtaatatatacattgtgatttatagacatgctgtcttttaatactcaggcatttagaaagttcatttagaaaaagttataaaaacttgccttcctttctgactatatcacctaaaaatcctaatttaagaggtaataacattttttatttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattatgacaaccagcatgaaataactgtcatcacagaagcatggtatattcgattccaaaacatattctttgtaagttttaatatatttatgtattatttatacttagattgtaacccataatgttacaatttatgttacaatattatttttccttcaactcttaagaatattcttaaataataaaattaaaattaatgaattataatttttgttgcttgggaaaaagagtagacacacacgtgacagtgcatcacttcaccccatcatttcatctcatcatttcatctcatttcatctcatcattttatcccatcatttcatctcattccatctcacctcatcattttatatcatctcatcatttcatctcaccatttcatcaaatctcatctcatctcatttccatttcattttcattatttcatttcactatttcatttcatctaatttcatttatttcattttgtcatttcatataatctcatttcgtttcatctcatatttttgatatcatttttcatatcatttttcatctcatcatttcatctcaattcatttcatctcatcatttcatctcctcatctcatcatttcctcctttcattacatttcatctcatttcttctcatctcatttcaatttcatttcattatttcatctcatttcattatttcacctaatttcattatttcatctcatctcatctcaattcatctcatctcatttcatctcatcatttcatctcatcatttctcatctcatcatttttcatctcatcattgaatctcatttcatttcatttcatcatttcagctcatcatttcatgtcacatctattcatttcatcatttcatttcaacatttcatctcatcatttcatctcatctttcaatttcatttcaatatcatcatttcatcatttcatttcatctcatttcattatttcattatttcatttcatttcaaattcatctcatcatttcatctcatctcatcatttttcatctcatcatttcatctcatcatttttcatctcatcatttttcatctcatcatctcatctcatcatttcatctcatttcttctcatttcatctcatcattttatctcatttcatctcatctcatttcaatttcattatttcatttcatttcactacatttcatctcatcattttatctcatctcatttcatctcatcatttcttctcgtctcatctcatcatttcatcatttcatctcgtttcatctcatttcatctcatctcatctcatctcatcatttcatctcatcctttcatttcatctcatcgtttcatctcatttcatctcatctcacctcagcatttcatcatttcatctcatcatttcttatttcatctcattttatctcatttcatctcatatctcaattcaatttcctttcattatttcatctcattcatctcatttcattacatctcatcatttcctctcatcattacatctcatctcatctcatcatttcatcatttcatctcatcattgcatctcatcatttcatctcatttcatctcatcattcatctcatcatttcatctcatctcatcatttccatttcattatttcatcatttaatttcatcatctcatttaatttcacctcatttcatttcattttttcatttcattatgtcatttcatttcatctcattacatttcatctaatttcatttcatctcatttcatctcatcatttcatttcatctcatcatttcatctcatcttttcatctcatcatttcatctcatcatctcatcaactattttcatcttatctcatcatttcatcatttcatctcatcatttcatctcatctcgtatcttctcatctcatttcaatttcatttcattatttcatttcattattgcatgtcatctcatctcatcatttcatctcatcacatctcatcattttatcattttatttcatcatctcatcttatcatttcatctcatctcatttcaattttatttatttatttcaatttcatttcattatttcatttcatttcatctcatcagttcatctcatcatttcatctcatcatctcatctcatcatttcatctcatcattcatctcatcatttcatattttatctcatctcatcatttcatctcatttcatctcatctcatttcatcattacatctcatttcatctcattttatgtcatcatttcatgtcatcatttcatcacatctcatctcatcatttcatcatttcatctcatttcaactcattgcatctcatctcatcatttccatttcattattccatttcatcatttcatttaattatgtcatttcatctcatcatatttcatctcatttcatctcatctcatcatttcatttcatctcatcatttcatctcattttatctcatctcatcatttcatcatttcatctcatcatttcttctcatctcatcatttccatttcattttcattatttcatcgtttcattatttcatttcatctcatttcattatttcgtttcattatgtcattacatttcatctcatttcatctcatcatttcatccatcatttcatttcatttcatcatttcatctcatgatttcatcttatctcatcatctcatttcatctcattatttcatctcatttcatctcatctcatttcatcatttcatttcatcattacatctcatcatttcaactcatcttatttcaatttcattacatttcataatttcctttcattatttcatttcatctcatttcattatttcatttcattatttcatttcatttcatctcatttttcatctcatcatttttcatctcatttcatctcatcattcatctcatttcatctcatcattttatctcattatttcatctcatctcatctcatttcaatttcattatttcatatcatttcattatttcatttcatttcatctcatcatttcatctcatttcatctcatcatttcatctatcatctcatcatttcatctcatttcatctcatctcatctcctttcaatttcttttcaactttgtcatttcgtctcatcatttcatctcatcatttctactcaccatttcatctcaaaatttcatctcatcatctcatctcatctcatcactttgtcatttcatctcatctcaagtcatcttatcatttcatctaagtgaaatgatggaatcatgaaatgaaatggataggatgccctcagtgatgttaaatttaaaaattgtttcttttcatgtatgcatttttatatttatatgtatttatatttatatttacttatatttctttttacttatttttatttatgtttttacttatttctttatttatagacaaggtcctgttctgtggcctaggctggaatgcagtggtgcattcacagttcactgcagcctcaagcaaacctcccaccttagcctcccaggtagctgggaccccaggtgggcaccaccacacctggttaatattttattatttgtagagatggagtcttgctattctgcccaggctggtctcaaactcctgggctcaagcaatcctcctgcattggcaacccaaaatgctgggatgacagatgtgagccacagtgcccaacctatttatttatttatttatttatttatttaatgaggacaagttctcactatgttgcccaggctggtcaactcctggactcaaatgattctccaaacttggcctctcaaaatgttgggattacaggtatgagccaccatgcctggcctaaaaatagtattatatttttgtatcatataattttcaattaggtaatatgaatattctgtacaggaaatacgcccttaattacataggaataaacatttgttacactgagaaaaatctaatagagctaaaaataaaaattaatttggaaaggtcattagatactcatacattcttacgtttatacattctttcatatattcatatattcttttaacagtatcaatggtttggagttatgtgtacaaaaccatgacctatatgtaatacaactaataacaagcacttacaattcaaggcatattatatacaaagctttaacttcctatcaaaatattttggtttttttctttctgttttggcagatactatgaacacaacattcaactcacagacactatggagcccttactaagcataaagtactgtgaaaggccagggctaggagagaactgagacagggccagggataggacagaactggggcagggtcatggccagagaaaaaccaggggcagggtcatagccagggacatgagaggaccaaggccagggccagaagcagggcagaaccagggccagggcagggacatggcagggccagggccatggcaggatcagggtcagcagaaggccagggcagggctagggtagcacagggccaaggcaggacagggtcagtgtagagcaagaatgggccagagtatggcagggcagggacagggaggtccagggccagagtcaggtccaggacatggacagggcagggccagaaacatggcaggacaagaaaggggacagggcaagggcaaggccagagaaggaccatggaaaaaacacggccagggagggtccagggtaagggcaaggccagggcagaaccagagccagagcaggccaaaggcagggccagggcagggcaaagccagggtaggccagggccagtgtagggtgagggtagggccagggcgagttcagggccagggcaggactaagatagcacagggccaaggcagggccagggcagggccaaaaggaggggccagggccaagcatagccagtgtcagacctggggattgtcagggccagggtcagggtcaaggctgggccagggacagggccagagcaaggacagggccagggagaaggcagaaccagagaggatccagagcaaggccagggtcagggcagaaccaggaccaggataaggcaaagccaaggccagggcagggcaaggccagggagaaggcagggccggggcaaggcagtaccagggcagggcaggaccagtgcagggccaatgcagggtgagggcaaggccagggcatggaagggcagggcaggaccaaggaagggccaggagagggccacggcagggtcacggccagaacaagggtatggctggggtcaggaatatggtaggatgagggctgggcccaggctgggacatgcagggcagagcatggcctgtgcaaggcatggccagagccaggccatagatatgggagggcaacaccaaggcagagtcagggtagatccagggctgagcagagtcagggcaggtccagagtcgaggcagagctagggcccaagcagggccatggtagcaccagggcagacgagggcagggcaatggaggactgtgccatggcagtgcctggtcaactccggggcagggccagaagcaggacagggacagggccaatgctcaggccagggacagggcatgacaggaagtgccagagcagggctgggccaacgttggggcagggcaaatcagaccaggacacctccaagtccagctctggccctgccttggccctggccccttcctggcctgaccttgtccctggccctgccctatccatgccctgtgtgtttgaccagtgttttataaccagaatcctacaagaaacttaaattagttctttttgtgcatttttagtagagatggggtttcacaatgttgcccaggctggttccaaactcctgagctcaagccatctgcctgccttggcctcccaaagtgttgggattacaggagtaatctggccaagtatttaacttctttatgcctgtttcctatatttggaaaatggggatgctttaagtacctagcacatagaattattgtgagaatcaatgcctcacatatttacatattgataaaattatattatattcatagaacactactggaagcaaagatagtattagttaaaatttagtgattactgcaaatattattactattacaaacaatatagtatagacattactactaatatagttatcttaaaaatctaaaataaaaattttatgtaatagcctaatgtaatctctcctgctctgccctggttcagccctagtgccggctctgccgctagtcctactacatccctggccctgatccttccctggtccagccgctgccctggcccttcccatcttcaggccttaccatggccctaccctggtcctgaccctgccctggtctggtcctgaccctggccctaccccagagaaggggtatggcagagccagggaagggccggggcaaataagggacaggacacatccaaatccaggaaagggccagggccatgacagagccagggcgagtccttggcagggccaggttccaggccagggccaggaaagggtcatgacagggtcactgtatggccaaggtccaggccaaagccaaggcagtggcagggtcaggtctgcataagggcaggacgagagcaagtgatatggcagggccagggccagggctgtgccaggacagaacaagagcagagcagggcaggaccagagccaggccatagagagagtagggcaaatgccaaggcaaggccagggtagtgccaggtctgaggcgaggtcagggaaggtccagggctgagtcaaggctagaaccaagacggggcaaaggccgaggcagatctagggcacaagcggggcagatctagggcacaagcatggcaggctagggcagggcaatggcaagaccaggtcatggcagggccagcccaggatagaacagggcacaggcagggcagggccagggccatggctggggcaggacaaggaccaggaccggggtccaggccagggcaagggtatggccagggcagaggtagggccagagccagggtctgggcaggaccaaggcaggtctattgcagggccagggttcagaccagggccagagcagggctgggacagggccagggccagaaccaggaaagggcaatgtcagaacaagggccatggcaggaccagcaatggggctggggccaggacagggacagggacagggtcagggatagggccagaatagcatgccaaggtagagccaggccaaattagggccaggacagggtcaggaccagggctggaccagggtatggccttaagtagcgaacggccagggccagggtccatgccagtgccagcgccggtccagggcagaggcagggccatggccaggtcaaggacaaggctggggcagggccaaggtctgggtcagggtaagcacaagaccaggacagagccaggggagggacagggccatggtagggccaggttaaatcagggacaagacacctgcaaatccacttcagggccaggtcagggcagggccagttcagggccagggccaagacagggccagggtcacggctgccagggtcattggcagggccagggccatggcaggaccagggtcaggagcaggggtcaatgccaggccaaggccacacaaaggaccaggtctgtgctagggccagtgtgagggccaaggcagggtcagggcagggacaaagggagggcagggccagggcagggtggagcaggcccagggttgcacagggttaaggtagggcatgaccaaccagggcaggtctatggctggggccggggcagggccagagccagggcagggccaagagagtggcagctccagggcagggccagggttaggaccacggacatgtccaaggccagtgccagggcaagggcaagggcaggggcagggccaggttcatctaagaaccagggacaaagccaggcccagagctgggccaggacaggtacctggcagggctagggtctgggacagggccatggcagggccagggccacaaccaggtctgtgctatggccaggtccaacacagtgcccaggtaaggctagggtgaacgccaaggtagggccagggcagggtcaaagctaggctagggccaaggcagggccagggccggcaaggcagggccaggaaagcatagggccaaggcagggcagggccaggccagtgccaagacctgggcagggccagggccaggacaggtccagggcagggccatgacagggccaggggctgcgttagggcaagggcagggccagggcaaggtaagggtcagggccaaggccagggtagggacagggcaagaaatatggcaggaccaggggcaatgccaaggccaaggctgggccagggctgagccagggctgagtcagggcagggcagggcagggcatggtatggccagtacaggacaggacaagagctggtccacacagagagcagagctgatgccaaagaagagccaggctagtgccgaggctgaggcagtgtcagagcatgtccagggcagggccagggccagggccagaaccgagccagggcacagccaaggcagggtagggcagggaaatagcatggccaggtcagtactgggacagggcagagcagggcaaggcgatggtagtggcagggcagggacaggccaatgcagagccatgttacgccggggccagaacacctccaagttcacttcagggccagggctatggcaggacaaagaccagggccaggatcagggccaggtctgtgctagggccagctccagagcagggtctagcgaagactagggtgagggccaaggtaaggccagggcagggtcaaaggcagagtagggccagggcagggtgatgacacatccagagcacagcagggcagggtaatggcaagaccaggggcagaccactgccagctcagggccagggaaaggccagtgcagagccaggaaagggtctgggtctgggtcagggccaggaacaaggcagagcagggccagggccatggcagagtcagggcaggtccttgacaggaccaggttccaggccagggccagggcagcagcaggggcagggcctggataagggcagggccagggatatggcaggaccagggctagggccagggccaggccatagtgagggcacggcaaaagccaaggcagggtcaaggcaggtccagggcaggtccagggagcggccagcaccaagcagggccaaagcacaaccagctcagggtaaggcagggcaatggcaccactgggccatgacagggcaaggtcagtgccaggagagggcagaacaggcaggcccatggtggggccagggcagggatgggccaaagcagggccaggacatatccaaggccaggtcagggccagaacaagagcaggaccatgaccattggcagggccagtgccatgacaggaccagggtcaggacaaggggcagggccagagccaaggtcaggccagtgcaggttcagggcagggccagtgccagggcaagaccagggaagggacagggtagcacagggccaagacagggtcaggatgggaccagagcaggacagggccgagagtccaggtaacagtagggcaggtacagggcaaggcagggcagtacagggccagatccacggcaggcgcagggcaaagccaggcccattgccaatgcaccagccctccctacaaggctcctaccacctggtcactgctgcagcccgtccattgctgtaagcctgaccctggctgcagccgcctgccctcctagcgtggccgctctcctaccgctctggtgcactgcagtctccgtcactgccacccacctgtagcgaggcgagccgtggtgttgcaggctctaggtgtctcctcctcctcctggcatggagcagctgggcgggcaaagccagaaaagcctagaggaagatgtgaggggtggaagggttagagcctcaccttgtcatgccggccactgggtggcaggggccagtttcagcaaaggcactcacacccaccctccaaagtccagcctctccttttggcccaagctggccgggaactgaggtctggggtgggtgctggagacaccacagcacccagctccccactccacaggaaccattgggcccactggggctgcactccttggggagcaggagaagcagaaaaattcagacccagccagccctctgcacccaggtgccaattcctgttctggacgcttccacgcacagggccctgtcccccgtggtgtccccaggggtgcctggcagcctctgaggcacagacccagagtgcacaggcccaggaaccacggtgggtgtgggggctctgccatgctcaggattcccatgcaaacgctgcgtgccctgccgcattccagtatgaccaagagtgggtcgccctctggagtgtggagtcagggagaggagaaccactccttccttggatgccaactctgttgaccgccaccagcagtgcagcctgatagcaccgaactcgtcccccactccacggctagtcctgccctcaatagcaccccccacctctgtcccccaatgccgccagtagcgtatacctgatagtgccctaacctgttctcctccatgggcattgcagccccagaaagcacccataacccaccttccctgccgtgggcagtgcagccctgtacagtgctaccaactagtacccctaatgcaggcaatgacaccctggatagcgcccccaacccaccccacactgcgaaaggtgcagccctggatagcccctgtcctaccactctggtcatgctgcagtctctgtcaccgccaccaccaaccacagtgaggcaagccagtgggccgcagactctagcacccagcagccaggcatggagcagctctcgctgatggccggctcctaccactctgaccacgctgctgtctgtctctgtggccatcttctttcactacaaaggaataaaaataggtatcaataagaaaagtaattttggaaataatacaatcacatggaagttaaacactaccctcctgaataaatgactagcgggtcaatgaagatactaagacagaaattcaaaaatttcatgaaacaaagggtaatgaacacacagtataccaaaacttgttatgcagaaagcagtacaaaggcagagatttacagctataagtgcctaccatccaaacaaaagaaaaacttcaagtaaacaatacatcttaaagaactagtaaagaacaaactaaaccgaaaataagaaaataaataagatcgtagcagaaacaaaattgaaataaaaacctcacaagattaaacgaaaagttggttttctggaaagctaaacaaaattgacaaacttttaaccaggctaagtaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaacgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacaaatcctgctcaaactattttgaaaaacaggagggaatacttccaaacttattctatgagaccattattactgtgataccaaaatcagacaaaagcatcaaagaaggaaactacaggccaggatctctaatattgatgcaaaaatcctcaacaaaataccactgaatcaaattcagtaatacattaaaaagataattcatcatgatcaagtgcaatgtatccctgggatcaagggtcactcaacatacaatgtgatacatcatatcaaccaaataaacgacaaaaacagtatcatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaatggaaagcttttcctctaagatctggaacatgataaggatgccccctgtcaccactgttgtttaacatagtaccagaaatcctagctaaagcaatcagtgcagcccctgatatggcccccaacccaccctgccccctaccaccagcagtgtcgccccccccccaatagcacacccaacgtaggcaaaccgccccgcctccctgcaccatgggcattacagcaccccatagcgccctcaacccgaaaccgccacaccaccccccacagccgcacagtgcagccctggatagcacacttagcccacctcactgttgccagcaatacagtctgggatagtgcccccaaccggctccccgccaaaggcagtgcagccccggtttgggcccccaaaccaccccccggtgcaggcagcacagccccagatagcacacccaaccagccacccaagacgggcagtgacgcctgagatagggctcccaacccgtcccaggccacccgcagtgcagcctggatagtgcacttaccccgatgcctttctacgctctggctggctgcagtgtccatcgctgccaccaaccacaaacagggctgcaaacaggaagtattttattcaccgtcgatgcggccccgagttgtcccaaagcgaggcagtgccccaaggtctgtgcagagcagaacgcagctccgccctcgcggtgccaccggcccgcccgcccgcccgggtctgtgctgaggtgaacactgctccgccttcgctgtatctccgaagtctgtgctgaggagaacgcagctccgccctcgcaaaggcacacagcgccggcgcgggcgtggcggagaggcggacagcagcggcacggcggagaggcagacagcgacggagaggcggacagcggcgcagaggcggacagcggcggcacggcggaggggcggacagcggcggagaggcggacagcggcggcgcggcggagaggcggacagcggcggagaggcggacagcggcggcgcggcggagaggcggacagcggcggagaggcggacagcgacggagaggcggacagcggcgcagaggcggacagcggcggcacggcggaggggcggacagcggcggaggggcggacagcggcggcgcggcggaggggcggacagcggcggagaggcggacagcggcggcgcggcggagaggcggacagcggcggagaggcgcacagtgccggcgctggcgcggagaggcgcaggcccaggctccactccccagctgtgaaagggtaagaactgagggtggctgagactcggggttgttcagggcggggtgggctctggacccagcaggcctggcacccaggtcagggctccaggggaggccaggtgggcgaaggccaagaaggggctggggctggtcaggaagggctcctggtgaccagagcactttgcgtgagccagcgtgggaggaaggtgggctggatgagccagggaggcgccgggaggggccttggcagaggcgaccccctccgtcagcccccaggccactgaaccctgggtagcgagaaccgacaggggagactgcagacagaggagtggaggctccccggctttgggggctctgagtggaagcatctagggggtccctcaagaggcccccaaacgcttccccatggtgaaaaaagaaggcgcagagaggggcacggcgccggcgccgacgcagaggggcgcacagtgagatttgctgtgatttcttttattgccccaaatgtacttcatcttggtagatttctattggctttaaaaatgtgtgtgttttgctgttggggagtggggtattatacggatgtcagattttgctggttgactgttcagatcttttgtaaatccttgctccttttctgcctagtttcactctgtcacttacactagagtgcggtggcacgaacatgactcactgcagccttgacttcctagggtcaagtacttcccctggcttaacctcctgactagctggtactataggtgtgtgccgccacacctgactaaatttaaaattttttggagagatgaggccttgctatgttgcccaggctcgaactcctggcctcaagctatcctttgtctttgcctcccagagttctgggattacaggcatgagccactgtgcccggcctctgcctagttttaacagttgctaagaggaggatgttgaagtagatgtcttcttggtgggtcaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgcaggctgaggaagcaggcaggcttgatagtaacaagagcacacaatgaccaatggttcccgagggggaatgcaattggcttgtttgaataaattcatgggctggcagacaggtgaagtgaaacttcttaggctgaggtgcaactgttctggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcaacgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttaaagtgtttgctctggatgttacaatatgtgtattgtaatatagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcccgtagtcccatattcatcccttctgcataagaactttctatagccattttttattttgatttttttgttttaattttttgtattgtggaaatgacagaacatatttctgtagccactttttagcatgtctaaattgaccagtgacaaattcctatattctcttcctcggagaatgtctttatttctctcttcatttctgaagggtagtttcatgggatatagaatttgcagcgaacagttttttgtttggttggtttttttgtttggttggttttttttaagcacttgaaaatgttgtgccacttccttctggcctccatggcatttgaattggcgtgtccctacaggcattctgccatttttggtctttgtttttagttttgaaagtttaatcagtgttgctttcttttggtatactttgaggtttgctcagcttcttgaatctgtaagtttatatctttcaccaaatgtgggaagcctcaggaattagttatttgcatgctttcacagctctggtctcctgtgggactcagataacataaatgcgtggtcttttgttatcgtcccacaggtccgtgcaactctgttcatttgttttcaggttattttctctctattgtttagaccgggtgaattctgttgatcaggtttcagcttctctgattctctcctctgtcgtctccacttttactcaatagagcccatccagttagatttttttaaaatttcttttactgtattttatatttctgtaatttccatttgattcttcttcagtttctttgctgacgttttcagttctttgattgttgccataggatttgtagttgcttgttgaagcatttttatactggctgttacaagtgatgagtcagatggttccaacatctgcctatgtaattttttttatttttgcaggcagtcctcctgtttaggtttagtctgtaggtcttggtctactttgtgggctgtgattgcaatggcaatttaatttcagagctttcatggtgttattttggtctgtttggcttatatgtatcactgggattctcccaccagtcccttctgttgcccacctgagggaacaggggagctgccccaggctgggccacctgctgcagctaggtgggtggggaatggtggtggtcttggtgtgtggagctggttttcttgttgtggggaagatctcctttgatctgcagggactgagtctgcctgggttgccttctattgctacgttgggagttgggaaactctgggcctgggtcaccttcctattggatgaggtccagggagacacctggctactatgcattccctagtcctagagtccctcagcagcctttttctgtccaccttttggaattctccattgatcctctcctgtctattatttctacaatttgggttacatttcttaggagggtataatgtgttatcttctctagaccagaaatccttagtggtggtttcgggttgtaactgtgctaaagggagaattggcatatttgtgatgtcgaatctttcttttcaaatgaggacgtatcattattcagtatataatatttacaacacctacttccttgggttgaagaatgtggttaaggcaaggaaagtacttaacgcagtgcctggtgtggagagcacttacgagtgttggtagtgatgctattccttttgtcctttggtagcctattaaagcttttcttcttttttaaaaaataaagttccggtgcacttcttgttaggtttattcctattttatccttttttgcttttattacaaataggagcttcctatcttttataatgtctacctggttctttggcccttatgtgaaaatgttttaatagccttctaaatattgctctcccaaatgagttttaacttgcctctttcttttgttatcctttttttgagacagggtctcactctgtcacccaggctggagttcagtgatgcaattatggctcactgcaacctctgcctcccgggcccccaaagtgctgggtttacagtgtgagccactgcacccagccttacttgtctatttcttttaagagtgggaactataattgagcccagagctccaaaaacaaatgaaggaatgaataagtgaataagctcttcccatgggtttggtgtggtttggggctctactcttaatctaaatgctatgttttatataatctaaaatttcccctaggtgtgttacatgattgtgttgtgttgaacttacattgagactccttttcacatgtactggttatcagcgtgggacttttccattcactctttgaattattcgtttgggggacacagatagacctctgtgtctttcataaagagtgtccattggccggttgcagtggctcatgcctgtaatcccagcactttgggcggctgaggagggcacatcacgaggtcaggagttcgagaccagcctggccaatatggtgaaatcccatctctactaaaaatacaaaaatgttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaatacaaaaatgagccaggcctggtggcaggtgcctataatcccagctactcgggagactgaggcagtagaattgcttgaacctgggaggcagaggttgcagtgagctgagattgtgccactgcactccagcttgagtgacatagtgagactccgtctccagaaaaaaagaaaaaaagaaacaaaagagtgtccattatctatactggaaaaattgagattgggattttgacatgaagtgcggaaatgtggattgggtccatttagtttacctaaacagatgatgaaatactaaccgttttatgaagcattccctagtgcaaagttttgcctgtgtgtctagtgacgggagcagtgagaatgaggcttggaacacagagcgcattgtgggcctgtcgtgggtggggccagcagcacatgcatgccgggctcacagagcagcctttgggtgttcttttcccagaggagctctatggtgactttgaagacttggaaacaggggacgtgcacaagggaaaatcgggccccgatactcaggtatgtctttgttgtagctggctgttcttggtcattgtgttctgagagaggcccatattgagaaatgcaaatcttacttgtgatgtgtgaagattgcagatgggatggatagattccttcctaaagggtggggatgtggagaccaaagagaagctttcttgtttacttgttaagttttggacgacagttactaccgtttcttgccgtagtcatttgccaagtccactgtgatttttcactcacagaagtcttagcttctcagacttacattcaaccattgccatcattctcctctttttaaatttaagtgtcatttaaaagaatgaagtccctgttctccctaatatttctttagaacagggtctgggagcatctgggtgagggacatatctgttatttttattctagtttgtgttcccagccagcttaaggaatagcagctaattgtaatgcagatgtaacaatttcatgtagcagtaccatgttattcagagaccaaggttatgttgtgttttgttttgttttattgataacgataacagatttttgctaagatttttgtttaaatagaactttaaaaaatctaacgtttaaagaaaagaccttcataaacatacacaaaattttttctcctggaaatttaagaatgaagatatagagaaacaagaaagaaattgaccctgatgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctcttagccccttgtcaagactatcacatagtgcaggaatccctgactttctttgggtccctgcttcctatcctgcttctgtgcctttcagttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagtgatctaagacagtgtgttcatttcagtgcaagccaatgctgcctattctgatcgctgctccctgatttgaatggcaggtgatcagtggcctgtgtggcttatggacacacaagagctcccaggggaagtgctctcaaaacatcctggtcagagttcagaaggacatgtggagtataaggtcagatgcggagataagggagatggtgtggccctcctgcctgggggtgctgagcaggttgctggaggcggtgatctcactctgaaggagacagacacagaaacgtgtgtacagttgatggtgagcatctgagttgcgtcttgttagtgaggccaggagtgcctgtgtaagctggaacagattaggtgtatgatttgtgaaacggagtttcatcctaggtcttcatctagtcaaaggactgtttcctgattaggcattagcttagtggttgctagtctgtgttgacctttgaaaggcatgactaggctaactctgaagtttttgcttcacaccatttacaatttaaaattacctagagccttgtgtgccattggaaaagactgaatgtttcactctgaaatgggagtccttggagggttttgagcagaggagagacattcaggtaatcagatcactctgccaagagatcagtctggtagagatcagtccggtggcacaaaccagagggctggcagtggagatgagacaaagagtcaaacctggatagagtttatttggaagctgggtcagtaggatttcctggtggactgaatgtgggatgtgtgagaggaaatgaggatggcggctggaaattcctggaaggatgggttgttgcaggttagataggaaactgtctgcagatgcagttttgggaagatgatgtttggtttggctgggtatcatgcagacaagcggagcgtcaagtctggagagacaggtctggccagggacttagatgtacagccgtcagcatgtagatgccacttaactctgtgaggtagccagggagtgagtgcagagtgactgggaggagcaagactggcatgggcgagatggggcgattgcggctgtgaggcctgagcagtgccgaggagggagagggagaagcagtgtgagcatgcaggcacgcaggagtccagttgtacatggaggcgaagcactgttcagatcccgctgcagtgttaactacggtaaaggcagagttgaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagcagtttttggtggaagaagtggaatcaaaaggttttgagataagagagagaacagagggaagagctgttggaataaaatccaggaagagtggatggtgtctagtgagcaagtgatgtgtggcccggagtaaaggcatggacaaatcatctgtgcctgagctgcccgtagaactttctgtgatcatggagatgcacgtctgtgcttcccagtattgtgacactggccgcaggttgatatggaccacttccagtgtgactagtgtgattgaggaactgcatttttaatattatgtaattgtaattaattttaatttaaatagccacacatagctcctctatgggccaggtcagagctctgataaggctggatatgggaggaaaccctggtagagggttgaccatagaggttcttttggttttggagtgaatcaggaaacagccatcagctgagtgaaggtgagggtggtggtgggtgtttgaagacaagagaaaagtgtgaaagaattgtttggagaggaaggaaagaaggtgtggactggggatgtttccaatgtttgagcacgcagggctccacagttatctacatttgctgtcccttggagcaggagagaagaaaacggttgggacatattctgagcagactgtagaggtaaaatgtgtaggttttttttgtttttttgttttttgagatggaatctcgctctattgcccaggctggagtgcagtggcacgatcttgactcactgcaacctccgtctcccaggttcaagcgattctctcacctctgcctcctgagtagttgggactataggcaggcaccaccacacccagctgattttggtatttttagtagagacggggtttcaccatgttggcgaggctggttttaaactcctgacctcatgtgatctgcccgcctcggcctcccaaagtgctgggattacaggcatgagccactgtacccggccaaatgtgtagtatttttaataggataaagcctacataattttgtccacagttcctttacttagaaattgctcatttgttcatgttaatcctatgtttattacagataacagcatacaggttccccgccccccgccccgtcatgtacagttgaatcatgcagaatttgaagatcaagatgatgaagccagagttcagtatgagggttttcgacctgggatgtacgtccgcgttgagattgaaaatgttccctgtgaatttgtgcagaacattgacccccattaccccattatcctgggtggcttgggcaacagcgagggaaatgttggatacgtgcaggtgggtccttttgctgcatatttggtgcctgaggctctgtggatttcccctccatcaatcatcttaccctctcatccccttcagatgcgtctgaagaaacatcgctggtataagaaaatcctcaagtcccgagatccaatcatattttctgtagggtggaggaggtttcagaccatcccgctctattatatcgaagaccacaatggaagacaaaggcttctaaagtataccccacagcacatgcattgtggagcagccttttggggtaaaatatgattacaataacttgcctattgccgagattaaaccttacaggctgcgttattttagctttgtgcttttcctttcataaaattccactcctaagatttttctcttttctgggagcggggaggtggtttggagtatatatgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggtttgagaaatatatcctgaatgtgggttattatgtacatgagactttaaattgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtatttaagcagtgctcaccatgtgctaagcactatatgaggttatgaggagccatcagagaccacccagacacaagactccctgcagctgtgctggggtagcagtctgttcactccattttcatttgaccagtcacgcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagcctttttttttctttcttttttttttttttttttgagacagagtcgcactctgtcatccaggctggagtgcagtggcacgatcttggctcgctgcaacctctgcctcctgggtttaagcggttctcctgcctcagcctcccaagtagctgggattatagatatgagccactgtgcccagcctcaagtcacccttgttagtttggcttaccaactttaaagttttggattgcttttgtcaaaccactgggttgcaagttcagatggtctctcttgtttttcttagctaattgtcagtaaaattcactttggtaatttattgtgtcacatagaattgaagtttttcttttgctaatattattcctattttcaaattttggggttcctgttagcctgattttcggatagctgccacaggagttgtccttgatctggataaatccataaaaattgtgaagaaattaaagctaactggttttccacttcatttattaaggtctgtatatctatatattctcatatttataaatctccatattgtttgagaaaaggaatgaaatacctctaaaatatgggcctcatttttagaaaagtgtttgaaatcttttataaacttcatattttgtttgctcctttatattctgtattacttaaatatgctcaaaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcggtagaaaaatcgacaaagcatttgcagacaacttggcaagggtacagagaaacggacgtactgtttttcagtatttggggagggtggtttgagcagcatttattgacaatttcattagtggggatgtttctattgaaaacacagagttaggaagtcataaaatgttcttgcaatataaggtaataataccaccagcatttatcttactgttttcatgttctaagtgcatgcatctgagtaaaaggatctgggctgcagtccagtctgagagatgccagcaaaggcttcctaggccaattcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtttttttatcttgctacacctgtagggaatgtttaattctgccttggacgtggccaaatttgaaggtgctgtgatttgaactgtcattgggataagggggcagatcaagaaagcactctgagctccagaaggagctttctgggccagctttgaggataagctgctgatgagcggtgaatgtcttaagtagtattcagggcagggtgttaccattcatgcttgacttctagccagtgtgatgagaggctggagtcaggtctccagagagttgagcagctccagccttagatctcccagtgttatgcggtgtgcccattcgcttgtgtcttcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatgttaaagtaaattacctcttttcagatattgtcttcatgcgaacttggtatcctgtttccatcccagccttctataacccagtagcatctttgttgaaaccagtgggtgagaaagacacctggtcaggaatgcggaccacgggccaactcaggctcgcccatggtgtcagactaaaggcaaacaaggactctctgtataaggtactggtcgtgtgtgtgttagtagagatgaagcctgtgctctacagacagggagtcacacagacacttttctataatttcttacgtactttgaatgttcaagtataaagtctaacgttaaatttgattgaacaattgtatatttttgggatattttggaatggaacaccaaaaaatggtaatagtggttctttctggattgaagacaaacttttcctttttaaaataaattttattttatgtatttgaggttgacaatatgatcttaaaggatacatatagatagtaaactggttactatagtgaagcaaattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcagatatgtggtttgcaaatatttcttccagtctgtaggttcccctttcattttgttggttgttcctttgctgtgcagaagctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccagttttattcttttgcatgtgaaaatcctattattgaagagactatcttttttaccattgtgttgtcttgtttgcccttgtcaaaaattagttgacagtatatgtttggatttatttcaaaggtctctgttctgttccattggtctatttttttgtttttgtgccagcaccatactgttttgattactgtagctttgtaatacaattttaaatcaagaggtgtgatgcctccaactttttctttcacagtaatctgttggctgtttggggttttttgtggttccatatgagtttcaggattgttttttcttttcttttttttttttttttttgaggcaaagtctcactctgtcgcccaagctggagtgcagtggcataatctcggctcactgaaacctctgcctcctggattcaagcaattcttctgcctcagcctcccaggtagctgggactacaggcacatgccactatgcctggccagtttttgtagttttagtagagacagggtttcactatgttggccgggctggtctccaactcctgacctcgtgatccgcccgctgcggtctcccaaagtgctggaattacaggcatgagccactgtgcctggccaggattgttttattctgttctgtgaagaatgccatcagaactttgatgaggattgtgttaaatctgtatatttgctttgggtagtgtgaacattttaacaatattaagtcttctgatccataaacataggatgtcttttcatttgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctaggttatttgtatatagaaatgcaactgatttttatatgttgagtttataccttgcagcttaactgaattgatttagtagttctcacagttttttgtggaatctttggagttttttacataaaggatcttgtcatctgcaaatagagataattttacttctttaatttagttgcctttttttctcatctgattgctcttgcaagtactctattgaataaaagtgatgaggctggccatccctatcttgtactcaatcttagtggaaaagctttagttgttccccactaactatgattagactgtgggtttttcataaatggtctttattatgttgaggaactttccttctatacataaactattaagaggttttatcaagaaaggttgctaaactttgttaaatgcttttactgcatcaattgagatgaccatgtcgttttatctttcattgtgttaatgtgatatatcacattgattgatttacatattttaaaccagtcttgcatgccagggataaatcccactgaaacacgatgtataatgtttttgatgtgttgttgaattctatttgctaaaatttttttaggatatttgcatcagtttttaatttattggagaagttgacctgtagtttttctttgtttggggtgtgtgtgtgtgtgtgtgtgtgtgtgtgtgtgtgtgtgtgttttggtttggcttaggtattaaggtgatactggcctggtaaaatgtgtttggaattatttcctctcgctctgtttttgcgaagagtttaagaagtaaactcccaggggatgggagtgactctggacatgggagtgacatgatagtgactctggaacctgccgtggtgggacacagcagcatctcagtctctgtgaggccagatgcagcatcagcaaggaccccagaatggtggagccctactgtggcttgggcccttaggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccattttcctaggatatgggggtgccatgttggctcatccctggcaggtgtggctgctcagctcagccaagacactgattccctgtgaagcagggcagcgcttcagctctcgtgcagtggggggtgtgactgctcagactggccaaggcactgattccctggaaagcagggcaccaagtcagctcaggctccaaggggcagggcacaatggcagctgggaggggaggggcacagcagcgtagccccacaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcgtacacctgtttcgccttccactttccccatgagatgaagcagcccaagaccctcgccacttgtgctgcccgatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatacagcaacagagcctgaggttggaagaagggtgcggtggctgctccccctgggtgggacatgctcccgaagtggtccaggtccaggagggcacgttgcagcagcagctggtccatgggggtggggcacaatgtcagttccttctctgaggggagtgctggggctactgggcccctcttgcttccttttccctgcagggagatatcccctctgcttcaggctgatccctctgggggagtgggtggtgggggccagatgtttccttccctcctttatgtgactgtcttggttttctgtgctctactggatttctgctactccttgatgcactctggggctctcttttagtgactttcatcaaaatatagttgtttgctgctttgggtgtctttgtcaggggatgagtgcaaggggctattgatcagccccttgctggcgtcactccctcttaaacttttcactgggtactcttttgaactatttttcccccaccgtatccatgtattttttaaacgttaatgtgctaatttctactgaagcaatgtggatttttctgaaagttttaatgttttaataagctttttattgaaatgttaatgtacatacagaagagtgcccgaatcataagtgtgcatctagatggactgtagcacaccaggctgccacgccctggaccaagcagtagccttgacctgtggcctctcccaggcactgctgccccaacacacaaaatagctactttcccagttcctgatgtagatttgttctgcctggttttgatttctataaaatacagcacattctatttagcctggcttatttggttcagtattacagaacacatccatgttcttgtctgtggtagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcaaacgtgcttctgctggaggatccctgggtggggtggagactccagggcacctgtgctctgcttcagtgtggaggcttctgtgtcgtgttctgggagcacagtgtcttggcctccaccaccagcagcagcttaaagagttcctgctgttccacatgcttgccaacaattggcctcttcagtttttgtttttgtttttttttaggttttcagtgcctgcctggacttctgttttcatttagattttggtttcttagaactttcgttattctcttcacagcttaacaatgcatttgaatagatttgttttcatgtggagtattcagttttgtaataagagggttgttcaaggcatcagtctgccactctgctggaaatagaagtctcccaggcatttctttttaaagtagttagtgaaattttgaaccatcttacatgaatttttattaaaatacacttcaggatgtggtgcccattatccattctactcttttgtaacaagtagatttctctgcattcttgaatttgaaaacaactggggttcctaaacagagaatatggaatattattggggatgatgtctttaataatacatttcaagataggagaaaccttttctatatagttgactttaataaaagcctagggcaaaactttcaatatattaacagtatttatgaggcagttaagaatttgggtcatctccgtctccactaaaaatacaaaaagttagccaggtgtggtggtgggcgcctgggctacttgggaggctgaggcaggagaatggtgtgaacccgggaggcggaggttgcagtgagccgagatcatgccactgcactttagcctgggcgacagagcgagaccccgtatcaaaaaaaaaaaaaaaaaagaatttgggtcatctcaattaaacatagaatttaagattacgttgaaaattcagtacagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccgggcatggtggctcatgcctgtaatcctagcactttgggaggccaaggcaggtggatcacctgaggtcaggagttcaagaccagcatgaccaacatggtgaaaccccatctctactgaaaatacaaaaattagccgggcgtggtggtgtgtgcctgtagtcccagatacttgggaggctgagacaggagaattgcttgaacctgggaggtggaggttgtgtgagccaagatcgcgccactgcactctagcctgggtgacagggtgagactccatctcaaaaaaaaaaaaaaaaaaaaaaatccagagtgtttggtagtcaagacaaaaagctagattatttttgttagtctgggaaataagcaccttagtggcccaaagacaaggcctgaaatttccatgaaaagaaactgggatctattcatctgttctgttgagacctcatagttccataccacagaaataggcacagtgggtttcggggggagagttgtaagtataagctctctgttcctctatattggccatctatagaccttctttggagaaatgtctattcaagtcctttgaatcagattttttgttgttgttgaattgtagaagtcctttttatattctggatattaaacccttatcaggtaaaccattcacacatattttctctcgttcttcggggtgtcttttcactctgatagtgtcctttgatgcgcaaaggtattttaattttggtgaagtccaatttattttttcctttgttgcctgtgcttttagtgtcatagccaagaaattaccaaattattgtttagttttttaaaagtatttatgtggttatttggccgatacctgtctctaatgattgacggcacttcttgagcgcggcttttaaacatgcaaatttgatgtcactttccgaggctccttccatggcatccctttgcttctaggccgcagcccttgtctggcctcgctgctgctctggcccctgccctcctctagggcctctcttctgctgcctccagctctggccacagtggcctttcattcctcagtgcacttgcctggggtcctcaacacttgcagttccctctgccgggaatgcggcagctcctacgtccccctcccggcctccacctcctcgctgctccttcggacgctggtcctgagaccactggtcggtgcggccttccctggaccctctccaaactccccagtactcctccacacttttctccaaaaaaccagtggcactcaattgtgccgtccagggacccctgggattttcacgaccctgtcagtggctgagtgaggttgagtcaagaatgtttcgtgacaataaggagatgttattgatctcttttcactggaagtgggagcgtcttgcggggggacagcgggctgaggatgcagctgtgttaggacgtgacagctcgcacaactgaagcaccgccactttcccacggtttttttttttttttttgctttggaaaacatttctcacaaaatatgcaacttatgttaccatgtaatgggcttgcttctgttattttaaaacaaactaataaatctcttaaatgtttctcggctttattttttgttgttatggttcgttttcttctgtttcccccagctttatgaaagtttaattgacaaacttgcctatctttactgctaacagcgtgctgctttgctgtatgtgtgccctgtggaatgcttcgtggtgctgctgcacacctccatcacctactgcggtgagggcccctgggatctgcgctcccggcgctgtgccctcgccccaccgctgtgcctgagcgcccccccatcccgcccggggacccgcgcccgctcctggaaccgcacccatggccagcaccctgtccccaaccccgctttagtttccacccacgcgaagaaactcagcctcggtcctgtttaggcacggaaagggctggagaaccgcgtccttccgaggcgcccccagcgcggctccccacagcgtgcaggaccccggactgtcgcgccgcgcctggggacgcacaggaggtgggatccaggagcgaagcccctgcagcgtcccagactggacgtggccctgcacccccagctgctgggctggccgggacatgcatgagatcgcgcgctttacaaactgttgttctttctgggaaagttaaagaacgcgctgcagccgcttcgcctgctgctgaaaggagccaggcagggctggtcactccgcgccacgccccgtgcgccaacaccggaaggtgaatgttcagaacatttttatcatttaaagccagtataccggctgggcgcggtggcttacacctgtaatcccagctacttgggaggcccaggcaggaagatccgattgagcccaggagttccagagcaccctgggcaacatggcaagaccctatctctacaaaaaaaaaaaaaaaaaaaaagccgggcgtggtggtgcgcacctgtggtcccagcaactcgggaggctgaggcgggaggatgacctgaattcagtaggtctccagcctgggtgacagagcgagaccctgtttactaataaataaagccagtgtacctaaaataccatcataacatggaatcagtataaaaatgattattgaactacttgacattcctgttttgtgctaagtctttgaaatttggtgtagtgttttgttttcttttctcttttgagacagagtttcgctcttgttgcccgggctggagtgcaatggaatgatctcagctcactgaaacctcagcctcccaggttcaagcgattctcctgcctcagcctctggagtagctgggattacaggtgcccgccactacgcccggctaatttttttgtatttttagtagagacagggtttcgtcatgttggccaggctggtctcgaacccctgacctcaggtgttccgcctacctcaacctcccaaagtgctaggaccacaggcatgagccactgtgcccggcccggtgtgtactcttataacacctctcaattcaggtctaaattttgtgggaaataatctatatttaggtttcacagtattcacagttgaaaaaatagatgtatatccccttgtttcaaatgtaactgaacctagtcccttgtttgaaattcaaattaattgaaattaaaaatttccagttcttggcagcagttgcacatttcaagggctcaattgccccatgtggcagtggtcccgtagaggacggcacagctctagacatggtgtaggaagttggagaaggcttccttagggaagcaagtgatggttgagccatgaccagaagttggttaacttggcaaaggctgggagttggggaagcagaagagtgtgtcaagcacaggaatgttatgtggaaaggcctgtgacacagggcatcatgacgcctgcaagccagcgtagctggagccaggacagcggcagagtcctaggagctggggaggaaaatagagaggcaggggatgaggccgccttaagatgctatcttcatcccaagacaccaggaagccctgagagaacatttaaccgggacagcatggtcagattttcatttttcaaaaagcccctttgctactgggtggagatagtttgcagggagttcagggggaggaggcacagagagggagaagtggtgggtgctagagctctgagaggtaacattggaggggtagtgggtctgggggttgtgaggaacaaggggttttcggggagtaccccagggcccccaggtgtctggctgggatgccaggtggagtgatgggcacctgtgggacagccaggtagagacatctgaggcggaagctggggaactgtctggaactccggttgatgtgctacctgggcttaagatgtactcccaagcgttaccaacacctacacttgggagtgggtacattatccagggaggagccaagattgaacacaggtgggtttttgttcagcattttaaaaatttttaatttttttttgtagagacaaggtctcactatgttgcccaggctggcctcaagagttcctcctgccttggcctcccaaagggctgggattacaggcgtgagccaccggtcccagtctgttcagcactttttccactagcttagtatctccacacacctcaaagagatcaccaagtccaactcatacatgcaaaccagtgctcaggaagtccacatgatcctgctgtggttcatttgaccaaaaccgagtggtggagctaagcaaggctgtttcacagaagccagatatataagtggcctcaatacggagggcagtctccatctcccagtgtctctgactgctgcacgcacacttggcaacctgtgctcaggtcagggatagtctgggtgggggctccagtttctgccactcaccagtgatgtgactctgggcaatgtacaaaatctcttgggttttaagtttcttatctgtaagatggggataataaaccaatcttgcagcatgtgaggatttaatgagactacagttcccatgaaggggatggggtgccaaccttcccacacagtcaaaaatccacatataggccaggtgtggtggctcacgcttgtaatcccagcacttggggaagctgaggtgggtagatcatgaggtcaggagtttgagaccagcctgatcaacatggtgaaaccccggctctactaaaaatacaaaaattaggtgtggtggtgcgcacctgtaatcccagctactcaggaggctgaggcaggagaattgcttggacccaggaggtggaggttgcagtgagctgagatctcaccactgcactccagcctgcaggacagagcaagactctgtctcaaaaaaaaaaaaaatccacatataactttcaactcaccacaacttttgttaatagcctactattggccagaagccttaccaataacataaacactcaacacatattttgcatgtgatttgtattgtatactgtattcttacaatgaagtaagctacagaaaagaaaaagtactaataaaatcataaggaagagaatgtattcactatcactaaatggaagtggatcatcataaaggttttcatccatatcgtcttcacattgagtaggctgaagaagagaagaggttggtcctgtcatctcagggatggcagaggcagaaaaggtcagggagatgggaaggaagtcaggagatgcacacacactgagaaattcatcgttatttctgtctgacatttttgctttttcatttctctaaatatgtttctttatgttaccaatctttcttccaccatttgctttagttttggtgtccgtaccatagaaaggtccatgtggtagaagtcacaagtagtcttgaataatcagaactcctctgccagattgtcaaatgtcaacttattttctggcactgcatctacatcctcttcctcatcatctggcactgattcgaaaacactcatctccatcaagtggtcttctgttaattcctctggtgtgatgtctcttcactcttgaatttctccaagatccatatcctgaaagcctacattccccaccttttttgccacaggcacactctctttcatgatttccttgattggccctgttgtaaatcgggaccagttttctccagtaggaaggctgggcactgagagccttcgaaccttctgcttcaccttttgacatatagggcccaattttaatgcatttaaatgttgcctccactccaaaatgaatatgggacgtatgtaatgtgtgaaataggtgtgtctcacccccttcatgaatattaatagagccttctataatctgttgaatatgtacgtttagccaaccctttcagcataacttcctgtctcatctttccctggaagtgcctgcttttggtctttgctggaggctacacttcccagcctgtcaagatggccagcctgcaggctgcaacctttctaagaaataaagcttttgggctggcccagtggctcacgcctgtaatcccagcactttgagaggctgagttgggtggatcacttgagaccaggagtttgagcccagcctggccaacatggcgaaaccccatctctacctagaaaaaaatacaaaaattaaccagatgtagtggcatgtgcctgtcttcccagctaatcgggtggctgaggcaggagaattgcttgaacctgagaggcaaaggttgcagtgaactgagatcgcaccactgcactccagcctggatgatagagctagactctgtcagacaaaaaaaaaaaagaaagaaaataaggctcttggcctggcacagtggctcatgcctgtaatctcagcactttagaaggtcgaggtgggaggattgcttgagttcaagagttcgagaccagctgggcaagatagtgggacccctgtctctacaaaaacaagtttgaaaattagccaggcatggtggcacacacctgtagttccagctacttgggaggctgaggtgggagattgcctgagcccaggaggttgaggctgcagttagtcatgattgtgccactgtactttagcctctccaaatttgtagatctcataattttaagtcaccaacctccaccagtctcattttaggttgtcatataatgacatcagtttttcttgaatcatattagagtctatagatacgcttttcttgtagatatccttcacccagataaaagctgcgttttctctatttctctgtccttccttccttctttcatctttttttttttcaccctgacagagcctcgcttccaggctggagtgcagttgtgtgatcttggcttactgcagcctccacctcttgggctcaagtgatcctcctgcctcggtctcccaaagtactgggattaaaggcatgagctactacatccagccaaaagctacattttcaagactagataaaaaggtatttggcaaaaagagcaaagtttcatgtctgctagcatggctgcagtgatgacactgcgaatttccttttcttattttacagcggttcttaggctggattaatttatcttgaaatggtgggcaaccacagctgcagacctcagtctacagtacatatcaatcaatccatctttttcttgtactgtcttttctctgcttcttggcagcacttccagcatcactagtggcatttcgtacatgtcttcttcaggtttattgtattgcactaaacatgaaaaatacatgagaaccacaagagattacttttcactgtgatacacaatctacaggagagacaagtgctcacgtggagatggctagtgtcacatggcattttaagtggacactggacacctgagctcactgcaatagtagcaggaggggtgacagaattattacagtagtacagtgggctcccattaatttatgcaattatgacttaatactgcatctttacatttgtttacatttctcttgactggcaccatgtactgtgtttgtgtgcataacttttgataaattttaactgtttataattgatatatgtatgtttataaatgatatatgtatgttttatggtggtaaatgataaaaatatgctagtattttatgcattcatgacatacctttttcttaactttttcaatatttctaggctacaaggttcatctgcaagtttcttcaaatggttgcaatgcttactgcaacctccatctcctaggctccagtgatcctcctgcctcagcctcccaaagtgctgggattacaagcatgagctactacatctgtccaaaagctgcatttccaagaccaggtaaaaaggcatttggccaaaagagcaaggtttcacatctgctggcatggctgatgtgaaattttccaatacatttttccaatatatttattgaaaaaaaaagtggaccaggtgtggtggttcatgcctgtgatcccagcaatttgggaggccaaggttgggagggttacttgagtcctggagttcaagaccagtctgagcaacatagcaagaccccgtgtgtgtttttttttttttttttttttttttgagacggaatttcgctcttgttgctcagactggagtacagtggcatgatctcggctcactgcaacctccacctcctgggttcaagtgattctcctgcctcagccttctgagtagctgggaccacaggtgcatgccaccacacccagattttttttttttttgtatttttagtagagatgaggtttccctatgttggccaagatgttctcaatctcctgacctcgtgatctgcccatcttggcctcccaaagtgctgggattacaggcatgagccattacgcctggccaaccccatgtctatttaagaagatttaatttaaaaaaaaatttttttaagaaaaaatctgtatgtaggtggacccatgtagttcagacttgtgttgttcaagggtcacaactgtacctgtggtgactgatacgaaacagatgaccaaaaaatgatagttttatttccccatctggtcccatttaaaagaggtgtttaggtctgagaattttcacacgtacaaggttccacagtcaggatgccgaggaatggcacccctcttgctggagtccagccctccccacccaaccctgctgactgctgatttgccttctatccctgtcacgccattgtctcaggaaggtcatgtgagtggagatatgcagcatgggctctttgtaactggctgctttcgctaagcatcatgtttttgagatccaccccaatgctctgtgtgtcagtgacatgttcctttcaattgtggaatggtgttagcctacacagggagacacaggtggttacctcttcagccatgggaggacgtgtggttgtgtccagatttaggcgattatgcatagagttgccataaacatttctgcagaggttttcatgtgaacacaaattttccttactccaggaaaattcgttatgggactgctgggccatgtggtttaacagaactgtcaaactgctttccagtggcacctcactatggttttgatttgcatttccctagtgattagtgtcgatggtctctcataggctttctgtcttccacatagagcgtcctcttcagtgagggtccaagtcttttacccacttttgtttggatggttttctaacttgattttaagagttctttatatatgtcagactactttcttcgttggatatgtggtttgtagatattctctcccagcctatagctgtcttttcagtgtcttttaatagtgtcttttgcaaagctatattttttattttgatcaagtctaattgacggatttttgcttttacatgcatttggcatcatgtctaagaacaatttccctaacctcaattaatgaagatttcttcctatgttttcttccaaaactttaaacactctctctctctatctctctcagcaaataaggaggaaagtttcatgacaattgcagtcctggtttctgtagctggtcacatggtcctataactaccttcttgcactccccagtctgtattccctttgccttcaggaagcctccactggttgtggtttttaacctggtgggggaaccttcattcctgaaggttctggaccattattaatcctgcctagattgggctgttgtgcttttccattgatcttaatcacagcgcatgccacgagggccctcctgtaccccagacatgctcttcctcagtccattgtgaagcagcagggcagtttctccttggtgatctggaccagccacccccaccagcgtagttaactccttctttacctgttgatccagaggcatgaggagcttggtgccaccagatggcagcctaaacttccagcgcaatggatcatccctctgtcttttggcggcagcattcctccctctggaactaagacctctaggccagcagagcataaggtggtggggacaaggagcaaaacttttgctagtgggtcactaggggtgatggggtttcaccctgttggccaggctggtctcaaactcctgatctcaaatgatccactcgcctcggcctcccaaaattctgggattacgagcgtgagctactgcacccagcctagtgctaatcactttttaaaaagccattctaatatgtagtgatgtctcattgtggttttaatttcaactttcctaatggctaatgttgctgaccatcctttcatgtacaaagaatatttgctttggtcaaatatctgttcatgtcatttgcgcatttttaatttgattacttatttattttatgttgagttctgagagttctttattcttgacacaagttctttgtcagatatgtgatttgcaaatattttctctcattctgtaacttatctttccatcatcccaattgcgtcttttgcagagcaaaaaaaaatttaattttgatgaggtccaatttatcaattttttcttttataaattgtattttgatgtcaagtctaagggctctgcctagtccctgatcctgaagattttcttcttttttttttcctgaaaatattacagtttgacatttaagcccatgatccttgtgttatgttttgtataaaatgtgaaggtcaggccaagcctcatctccttgcctatggatgtctgattgttcctgcagcacttgttgaaagggctatcagtcctctactaaactgctgttgcatctttctcaaaaattaattaagcatatttctggggtgggatctctatcttgcaccagtaattaatgtgtctctccctccaccagcaccatactgagttgattactgtagttgtagagtaagctttaataattggtacagtgatttcttctatttaattattctttttcagaattgtttcagctaaactaggtccacttccttttaatataaagtttacaataagtttgcatatgtatacaaaaaacaatgccaagatttagaattctattaaacctgcaatttgaaggaagctgacatctatgttgagaattcccatccctgaatatggcatgactctccatttatgtagatgtttgatttctttcagcagaattttgtaatttgcatatattctcctgtatatgttttattagatttattcctacatattaatacttcatgtattttgagcagttgtaaatggtattgcagtttttattttggtttccacttgtttattgttaccatagagagatgtaatttgtgtatctgtgttattcttgtgtattgcagccttgatattctcactctttatatcaaggatttttcttttgttccatgggactgtttatgtagatgattatgccacatgcaagcagtgatagttttctttctttcttttcaatctgcatactttttatttctttttctggtcttattacactggttagaacttctagtactatcttgaattaaaatggtgaaagggaacattcttgccttgttcctgctcttaaggggaaagcattcattctttcaccattaagtgtgatgttaactgtagatttttgtaaatgctctttatgaagttggaggaaattaccctctattccaagtttgctaagagtttatatcatgaataggttttgaattttgtcaaaaccttttcctatgtcaattgataagatcattatgatttttcttcagtttacaaaacagaatatgtggattggcttttcaaatattaaaacagtcttgcataacttgagtgaaattcctcttgattgtggtctactactctttttatgcatcactaaatttgatttgctgacactgtcttgaggatttttccatctaagcttatgagcaaaatcagcctgcaaggttctttcctctgtccctgcctccttcctccctcccttccttccttcctttgtgctgtctttgttttgttttgatatcaaaataatgatatcatagtcctttctcttctattttctggaagagactgtgtaaaactggtgttgattcttctttaaatatttggtaaattctccagtgaaaccactgggtctggatatattgtgttcaggagctttttagttacaaatccaatttatataatgattataggactattcaggcttttatatatttcatcttttctgagttgtggtaatttgtggttttcaaggaattgatccattttttcctaggctgtcaaatgtatgagcataaaatttttatagcatttttcatagatgcagcctcttttgtgatatttcttgtttcattcctgatattgctgatttgtgtgttatctccttttatctttgttgatcatgctagaggattatcagttttattaattttttgaagaacctgttttttatttccttaatgttctgcattgctttcctgtttttaatttcatcaatttctgctcttcgctttccgtcctatttgccttaactttattttactattcctcttttagttttttgactactggtttgagaactttccatattactaatataaggatttagtgctataaatttctctctcagctctgctatagctgaatccctcaattgttttttaagacagggtctcattctgtcaccgaagctggagtgcagtagcacaatctccactcgttgcagcctcaaccttctgggctcaagcaatcctccctatctcagcctcccaagtaactgggactacaggtgcatgccaccacacctggataattttttgcagagatagggatttcaccatgttgcccaggctagtcttgaactcctgggctcaaaaagcgatccccctgccacagcctcccaaagtgctgggattacaggagtaagccattgcacccagcctcatccacaaattttgatatgccatattttcattgttacttgctttttaaaaattccctttgagacttcttcttgtccacattgtatataaatgtttactgcttaatttccaagtgtttgcagatttttctcttgtctttctgcaatttatttccagtttgattccattttggtcagaggacactctttgtatgatttcagtttttaaaaatttgttaaggtttgttttaagatctagagtctgttctataagagcttgaaaataatgcatagtttgctgttgatggatagagttttccataaatgttaattttaccctattggctaataatattgtttagttatcctatattcttgctgattttttttctagtaattttacaaattctgaaagtgagatgtcgacatatcccaactataattatggatttttctatttcttttttaagctctatcaggttttgcttcatgtgttttgaagctgtgttgtttggtgcacatatatttaggatcaagatatactcttgctcttttgttattatgtaatatttctcttttgttctagaaattctttttgccatgaactctatctgatattattatagcaactcctgcttttttaaaagttcctgtttgtttgcatgaaatttttttttctgttttttttttttttttttttttttttttttttttttttttttttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgctaccacgcccggctagttttttgtatttttagtagagacggggtttcaccgtgttagccaggatggtctcgatctcctgacctcgtgatccgcccacctcggcctcccaaagtgctgggattacaggcgtgagccaccgcgcccggccttttttctgttctttcacttcgaatctgttaaatacctatgccatggtattagaactgaatatcttatggacatcatataatgggtcatatttttgcatttactctgctatttctgtgtttttcccagatttaaccaaactgcaaagtctgagggcatggttcctaaaatttccctcattcctgacaccaacagcaagttttagaggtttccaaagcaccctaagtttcaatcatttgctggaagaactcacagaagtcattgaaaactgctgtacacatggttactgtttactgcagggaaaggatacaaatcagaaccagcacagagggcagggctaggagggtctgtgaagcctctgttgtcctcaggtgcattactctcccagcatccacgtgtgacaataccatgaagcactgccaacctaggaacctcacccaagccttggtgtccggagtgtttcctggaactgcattgtgcagccataattgactgatctgttggagactggttggaactctgtcttcatctctccctttcccggaatctggggctgacagcacattcctgggagggcccaccatgagccagctggtagcataaacttcaggtatagtctgagggacccaccatgaatagcaaagaccctcctgtcacatggtcttcaggactacttgccaggagccaggacaaaggctagacctcttctttgggctaggccaaattctttaccacacagaaatcatatttaggattcaaatgtgccatttttatttgctttctgcatgtttcttatgtttcctttattctgttttgtttcacttgtcatggattacttaaacagtttttagcatttcattttgaattatttatacttttgggtgaattgctttgtatcgttttctaagtggctgctctaggattgattataatatacccatgtaacttatcacagcctgctggcatcaatgtttcaccacttcatgagaaatatcaaaagcttacttttatttacttccccttttcctcccccacttaaacatgtaattatcataaatatttcctgttcagatgtagagcaccgtagcagatgatgttaatattttttgcttcaaccataaaatacaatttaagaaactcatcatagtctattatacttaccatatgattaccccttctgttgttgctatttctgatttccttatttccttttcgttagtagagcttccttcagccatgtattaagggtaggttttctggtaacaaactatcctagttgtccttcctcttagaatatctttatttccccctcatccctgaaggatacgttcactgaatagggttctgggcagacagtttttctcagcacctggtgatggtgtgtcgccccctctgcctcgtggttttagagaagcccaccatcctcagaaccagcgtcccttaatgcatcgtttttctctggtggtttaaaagatttttttcttcatctttcctttcctgaagttccgttatgatgtgtttatcctatttggggtttgctcagattcttgaatctgcaggtttacttctttcaccaaatttgggacatcttcaaccactgtgcctttgaatactttttcaccacacattccttcctctcctcctgggactctggtgacaggaacgctgggccttttgtcactgtcccacccatccccgaggaggcgttcatttctcagtctcctatctctccatcgttcctatgggccagctctattaattgtccttgaatcaagagactctgttctctgtcgtctccactctgctattgtacccaactgcacattttttcatttagttattgtatttttcagttgtatgattttcattttgttcttgtttcaagaaaattcaccattgttttctgaagcacttttatgatggctgctttaaagttctaacatctgatttatcttggttaatcttattttgctatttaagttgttttttgttttgctctgttatgtttttgagacagaatcttactctgatgctcagactggtgtgcagtagcatgatctcggctcactgcagcctcaaactgccgggctcaagcagtcctcctgcttcagcctcctaagtagctggcaccacaggtgtgtgccaccacagctggctaatttttaaattgtttgtagagacagggtcatgctgtgttgcccaggcagatctcaaactcccgggctcaagccatcctcctgattgaccttccaaagtgctgggattacaggtgggagccccctcaccaggcttcaagttgctttttatgtttcctgatatgacaaataatttcaaatatgttctggagatttcggttattatgtaaggaaactttttatcctatttgaacattccagtttaccatataggccccagcctgctttaggggaaatgtagagtcaatgacaatttagttttcaaagccctcccagtgctattctggtctcgtttgttcttctggatctgctggggctctggttcaatccctgtgcatgttgctggggttgccctgtgcggcgggggtaggttaaggaaacgccgggtgctgggtgtggtctctgcgccgtggtcagcagagcctttgtggcctgggtgtgatgctgagggccaggcttgagcggagctgctgtggcatggatcagtaggaatctcctcactgggtcttcagtgagatacccttctcagtcctttcaccagagaaaataggctcgttttcttttcttttttgtccctgcaggttttggcagttacaggttgcagggttctctgggcccatccaggagatgagagaaaaagaaaactcagggccttgtacagcgtcacccccaaagtcccgaggttcctggacagcctttcttcctctacacttcctatagtcctcttatgtctgttaaattttttccagggtgtctagttgtatttagagggcagatgccacctcgtcatagaatgccggggtccactctccaggcatttggaacgagttgccacgaggtcctcgggagggtgtgacagttcacacgcccaccagcagctttccacgtctccatttcctctgcccctgacagcatctaatgttatgatttttgtttgtaaatttggcttttggttcctttatgaggggattaattaatacaggctgctggctccttcccacgaatccaaaccttggagatgccatcaaagggatgacagttgatggagcccagaacctaagaggacccctgagagccttgcggaggctgggcaaacgtggtggagtctgggacaggaggggaatcacagtctgagtggaggaggccacacagcacaaccggggccagactgcagctctctgctccggggcccacctggggctgtcatctgccagccctgctttcctgtagaagatcccacccgtaccagccccaggaatctaggcaaggccagagcacctcaggagcctcctggagtgagggccacgacacctgggcaggctggctggtggcccctgggcagccttcctccccagcccaaggacagccaattacagcacagggcagccctggacagacagcaccagctagaaggacaggggcgttccctgcagaccagagcagcccccggggatgagcaaagagggccccagtcatcctgccagaggctctgcccccaggagcccctgcctgcctccctgaagcccacaaggaaggtgtcaactggggcctaagacgaaggcagttgaccatacccagggaacagagagcggcctgaggaaacgagacagcgaggggagtgaactccgggagggaaaaaccccaaggtttttccttggaggagggagcagatgagcggataagaccggtaaatccgtcacataccctcaggacgcagggagagcgcggctggaattggcagttatgcagaagatgcagccgggaatactggactggaacatgcgggcgcttaagtgatgaacttggtgggaaggttggagaccagaaaatgaatgagtgaggcaggtcaggctctgagctcttctagaaggagctgaaggggttgaggaggcagaggtgagggaggaaaaatattcagtgcttaaaagaggaaaaatgaatagataagaggaagtatctgaaaaatgattaggaaatttccccaattaagaaaagatgcacatcctcaaactaaaagggcctgcagagtgttaattacattttaaagttaaaatcttatgtgtactttcaaagaaaagcatctacattttgagtcaaaattgctaaaaacttccaaagagaaaaagcaggtaacccgcacaggaacaggagtggtgctgacattagaatcgcggcacagacaacggatgcaagaagaaagggagtgacagcttcagacgcgagaggaaaggaccctggaacccagggctgtgtcctgctcaccgccatgaaatatgggcacgcaggaagccatcctcagtcctatcagcccccttgagagtcaaccccagaaacactcttggagaaatatttcagcaagaaaaaggaaccggggaggatgctgccaggtctagggaggagtgatgcttccccagcgtggatggttcactgccatctaagtaagcaatgacctccgcgtgtgccgcacagtccagcttcctcagaggcggtggtggcctggtggaggaatgtgggctggctgggcggccacagagaattactgtttccattaaaaggaaatgtgttctggccgggagccctggctcacactgtaatcccagcattttgagaggctcaggcgggtggatcgcttgaggtcaggagtctgagaccagcctggccaacctggtaaaaccccgtctctgctaaaaatacaaaacttagctgggcgtggtggcgggcgcctgtaatcccagcactttggaaggcagaggcgggcggatcacttgaggctaggagttcgagaccagactgaccaacatggggaaaccccatgtctactaaaaatacaaaaattagcctggcatgggggcacatgcctgtagtcccagctactcgggaggctgaggcaggagaatcgcttgaacccgggaggtggatgttgcagtgagccgagattacaccactgcactccagcctgggcaacagagcaagaccctgcctaaaaaaagaaaaaaagtgtcacatggagacgtgtgtctgtttgggactgttttccagcctttccacactcttcccctccccatctgtccctccatctccaccaagctgtgttttgatgttgtgtttgcatgatttggtgtatctggcattttaacatttcatccttgccactatttattattttctgtttcttcgtagtagccactaaattgttttcaggtgatatctcattgtggttttgatttgcatttatctaataattagtgatatttagtgtcttttcatatgctcattggccacatttgcctgtttttaaatcaggtaatttgttgatttgttgttgaaccatggagacatatttttaaaccacaacagctatcttgcagattgcggtgagaactaaaagatttatgtatgcaaatcatattacctgtcacgtagtaggcactcaaaaattattacttgtcttcttagggttgttatgttaaataatgttatgttaataacatatgtaaaactgcttcttaaattataaagtgctatgcaaatgtgagttaatactacaaagctgtatgcaaaatattttaatatttttctgaggttctccatacttaaatatataaatctttccatctctagactttattctttttttagctgtaatccctttttttccattttacttcaagttttatcaaaaaaaaaatagcagccaaaatagaacaagtaaagacggagaaacaataactaatttcactaaagcaaagtcagagtaagatctatttaaaaataaaacgtgaagaaaagctgcaatggattacactattgaaaaatcctaagacaaccagaactgccgttccttcagagaatgtgagtgatgttgaaagattaataacatttggataacattaattacagtgatgttataaactctggtattccagttgccataacaacccgctatatgttggttttctaatgacatttcgaacaagtgttgaggcgaactgcatcacttcagaactttgattgctgtcactcagtgattttaaaattgaattgttttgttcttaaagagtcagaatatgtcactgtcttcagaaatattctcaaaattatggggaggaagtgatacacattcctatacaattgtagagcactcaaaaaaaaagaaatgtattttgtttttaatacaaaattaacaggttttttctatagggaatagaaaaaaacagaaaggagaaagattatgcttcctgcttctcagaagactttgttcccttgcagaattatttgacaataaaattctttctagaaaaactcacttttcttgcttatatttctctcgtctccattctctcctttcttttcacctccctatttctttcttccaatgaattcttttagaagccatggattctggtcaaggtagatgcaacactttggagttagtgagaggaggtcattcctccatccagctttctgctttctgatctctcttccctctgctgaccaacccgttgcccaatggatataataaaagaaagactacttgccactggcttatattatattggattttaatattcccaagagaatgtgttaaatatatatattgtgccactgaccagaagcaaagcatgattgtaacagacatgcttctaagtatttgctcagcccacagcctactctgctcctgctgccccacccatccacaaatatgaatcgtttgattaaataggagcaccagaaccaactcatccatatgcattgagctggacaaatacattctctctttttctcctcttttccctctttcctctccctctctacaaattcagctaaggtgaatgctaaccatttgcaatggtgtttaaagcagaacagtggtgttctgtggcagaactctgtgctacaggactctgaagggagattatgcccactgcctccccaaccacccctcttgcccacccccaccacagttccagcagcatctcagtctatacagtgcatctcaggcattggaggtggcatcattccatgtaaagcatattctatgctctataaaccctgagcccaatgcaatgccatcttaagtaggcccaggtctgccccttgtccagatgtgccatcagcaccctttcaacactctctcccctccccctttctctatacttaaagctccctctaccccacccagatatccaaaggcattgatcctaccctcccaaagctcccactgtggccagctcctccgaggcctctcagggaagagtgaagtgagctaatcaccccagcctaggcttctgttgacccagaaccaattcaagatgaaggccatgccttagacagcagctgccagggaaatacatgacttatacaatgacatcagctgaaattcacaaaggtcactgcatttaactcattcctcacccaaggtgatgcaagcatgctaacccttttcctcccagtcttctctggatgatcttctccacttgattttactgggatgtacatgaacaagctagaggagcagcctgtgcctgttaccctctcctccccactgctgaggtcactctccacccttctcatcctactctcttgctggggacactgaactgtatgagtttcatcaatggactcccttgccctttgacctccagttgggttctgccaattagaggtccttaataggagataagagggagggagaaggagtggaggctggggtatttatgcctctggcttgatccctgaagtattgtcttgcagtcatctctatgtgattctctccacccaggttccagtaactgatccctcctcatatcatttctggtgaggagtcatatctgaactcagtggtgctacactgtcctttttggactccataaacactgctcatcatttgtaaacagtcccttcactaaacctccctccaattgttctagtgcaaatggcccaacacattcctcctgggatcctgaaatgattccttaaatgatgtggtctatcctatctccccttcctgcctacaatggccttgggatctgtcctaactctgctgcctttaagattggtctaccctaaactacatccacataaccccacgattgtcccttcatgcctaacccacaaagagaggtgataggagttaggctgaggagtggggttggggaaagacaaggctcagcatggtccctgataacctcgtagcttccaggcagatgaaggcagggtggaggcaggctgctctgagcccagctggtcggtgctcaatcagaaaggatatgggttgagctcagaaagcctgagagcagtggcgctctggagcagatcagaagccaagactctaagaacaacatgcaaatctgtgtagggaacatcagaggctcctacccaggtctgagcaagtgcagacaggctggttgtcaggaggattagggttagggttagggaggagtgaatcaaatatgaagcaaagcaatgatcaattagctcaatctgcagataggaatagattcctacagatagaaatttaagtcagagttgcaaggggatttagaaatcacacacttcaatcacttcacttttagatgaggactaccagactgtagacacaggggtgatgagcgcagaacaaagacaaacacccagaacttgtcacttctagattaaggatttacctgtgaagcccatgcctctaaaaaggtcgattctactttttaaatatttttaaacagagtagctttggatgaaaacatgatgttatggccttgatatttttatatcaagtatattttcaacgggtcactagaaaaaaaaagtagatgtaaaaagaatctacacaggatcaaactgataataactaaaatgatatatgttaactttgatattgacaaaaaactgactgaagaatctcattgtgttggtaagtctcaaaactacaaaagtgaactcttaaaattgcactttatgcaaataacacaaaataaaactgacaaaggtgaaagctttacacagaaaaatttgtaattgacgttaaagattgacaaaagaatcaaatcttcttgtcaaaaattatacctgcaaaatctagcccaggaaaattaggtttggtagaaaatgactacaaaagaaacctcaaaattgctgattggaaaagttggaaagatttaatacggacataaaatgggatcactgaataaagtctaaattatttcagtaaaataaaaatactgaaaattatttaatggcacaggaagaaatttgatcaaagaattacattaattcaagacagttgcttctagaaaataatttcttgataatatttccagaaatgttggaataattctgatgaaaatgtttgttttcattcaataaaaaatgtcctcagggtcaaaacaactgagagagaagtacctgatatgggacttctcaggtagcccccactcttggggcttccagttttacatttaccaagtttaaagaaatctaagatctctttccaggatcctaacaacttgtctagatcaaaataacatgtacttcagtgaatgatttcagctggttgataaaatcaaagtttaccagaaggcatgaaagttcagagatccccttaccatttcaaagggggtttgtactttaaagtcaatctacatgtcacctcacacccattatgatggccactatttaaaaagaaaacagaaaatagcaagggttagcaccaaggtggagaaattagagcccttgtgcactgttggtggaatgtaaaatgatcctgccattatggaaaacaatatggaggttcctcaaaaaattaaagctaggattactgtataatctagtgatatggtttggctctgtgtccccacccaaatctcatgtggaattgtaatccccacgtgttgaaagtggggcctggcaggaggtgattggatcacgggggtggtttctaatggttttgcatcatccctctagtattgtctcatgacagagttctcatgagatctggtttttaaaagtgtgtagcacatcctcctccactctgtctctctctcctgccaccatgtgaagatatgcctgcttccccttcaccttctgctgtgattgtaagtttcctgaggcctcccagtcatgtttcctgtacagcctgcagaaactgtgagtcaattaaaccacttttcttcataaattacccagtctcaggtagttctttataggattgtgagaatggactaatacatccagcaatcccatttctgggcatatatccaaaaaagaattgaaagcagtatcttgaagagatattggtacatgtgtgttcatagcagcactattcacaatagccaagagctgaaaccaacccaaatgctcattaaaagatgaatggataaacaaaagagtgtgtttctttaaatgtgattttatgctgggatcatagagaaccctggattttatgcaaatgagtgggaaaaaaattaacccaacacaaaaaagtaggtttatactgatcatacaggacaacacctttcaagattgtaaaaagttaaaacttttctctcttcacatcacctgtaatgatgacaccccataaagatttttctctatgtatccttagttttgcacaatcccctggccccagtgctgcatccccatatcccaattgagaagaatatgccaatatttaaggacacacaataaggtcagcacatcaagcttcaggacttacaccctccataaaagagaaaattctcctttctcatgccactctctcaaagccagggttcctgaagaaaggatttctggtgtcattacacaaaggagatcctggaaattaaggtttgccatgggttatgtccagtactggaataaacacagaattattgaggtaccttcctctgtcttctttgcaaactcctcgttgcagctccttccttgcaaacccctctgtcttccttgcgaacccctcattatagctcagaactctgctttggcattgcctcctggtaaagcccctgctgcatccacccttccaaccacacttcctcactctcctccgcaccactttggtgctgcaggagttacactttctgttgcaaagatcaagtattctcgggtgacctctggtgttgtgggtgattggaaagatacttaaggcaataaggaagcacaggtatgacactaggcaggttgtagtccagcctcccagagccctgggatgtcagtaagggctcccctttgagtcagtaatggtaatgcccccttgagaagagggacctttggcccctgactcctgacggtgccgtactcacaattccacttctctccttcacctctctgtgcttccgcttctcactagttcagctgttacctccacttttgtttctttctaattctactctggttctgtagttgagtttctcacagtggaaactacctgtgctctcactggttgggtcagtgagttgcctccactattgggcagaattctgctattagacctcccagggcccattggtaaacctaagattgtaaaaatgtaaaacttttctctcctcaacgtcatctgtaataatgaaaccccaaaaatatttatgtatcctgtagttttgcacaattttgtggttacctttgaccaagttacagattcttgatcagttcgatcatggttacttaccagggtcacatgacagaaagtcaacaacttatggaaaaagaacagtctttgctgctttgctcagaaggtaatatgtacaaacttgcattattgcatatatcacaatacagcttgtttctgcatagcccagtcccctacaagactataaccgtgaggccagtggtatttcctatatttgcatgttcagcatgtagcatagtgcctggtacatggtagattctcaataaagctctgttgaagttaattgaaatgaaagtaaaatcaaaatacctgaattctaattttgctatttctttgctatctgaactaagatacattacttaatctttttgaacctccctttcttcttatgtaaaaagatatagttgtggtaaatattaagtaagatgtgggcatacctagcacagttttgtgtgtgtgtgtgtatgtgtgtgtgtgtgtacatatatatatatatatatatatatatatttaaacatatatatatatttaaactgtctctttgttataccactgccatgtattgtaattacattcaaatagatcttctcttccaaacagagagtaagttttaaggacagggtctgtgtcttattaacctttgcacctccataccaccacccaaatttctgcttttggtgggtatttaagataattaatggcatgaagcgccaacggatttataaactgaatgtgtttaaaatctccatatattaacatttttaacaattttttaaaagcaggaaatattaagcatgacaaattatggtcaacccaagtttcaataactctgggtgcctagcaatcttctaagagtcaaacgaaagcaatgttgcctaggttgcagttttccagtgtttgtctccacctactgtatttactggaaagctgctgaagcgttccttctaatcttgaggttttcaagcgtctatctctgggacaagcaaagctctgcattgggcaccacagtctagcacacgttttcaggcaccactagagggcaggctaacgctaacttcggggactactaagcaagggctttagtctcgaaaaaatgggtaaacgcaccacttgtttattgggtctgtttctaaatggaaaagtacatgtgggcatgtccagatttgtatttcgtgttcccttgattcgttatttaatccttcggctcacctttccttttgttttctctttcctccttcaagttctttctcctctggagtgtaacaaacaaacctgtttcccccccggtcaaaggcttaacccacaaaaataaatcaagatgaaggaacagaaggaaacactgcataatttagttagtgaaagttggacagctgaggtttcctttgggtttattctaaaataaaggattttttaaaggttcaacttgcctaatttttcatacttttggcagcttgccaagatgggaagggaaggggatttgcagaaagaagaaaacagagagagagagtgtgagtgtgtatgtgtgtgcgcgcacatagcggggtgcatttctgggtgtaggggatgtttatagggatggaggaaggaaatgaaaagcagatgttgggagttggatggtcacagaacactggcttgcaagtattactgggccaccatgagcagtgctgggacacagctccactggacagccacccctttctgtaacctgagagccgccaccctactcacacctcaggctcctcatcaagcatgtgagaaatttgtactagatgaccttctggttcaaatatgagcctgtgttgagcgagagaaaacatgggggttggaaacgcaggatgaatatttgtggagaatctgagaatgacaaacagaaagcaagcaagccaacaaatacactatgaagctggaagagtcttccagctgacccaagtgtagaaacagttgccccatttagaatatttggaacattttccctcccattatcagggctctaacaccgggctgccctctgttctaccctctggaaagtccaagggaaaaaggtaccaaagcagacaagcaaggatagaaacagtggtggcattgcaggctggtctgcattgcggctatagaacaaaaatttccaacccaaaatgataagataataaaattctaaacacaaaattcctctagccagttaaaacaatggttcaaagaaatacacaccccttgggatcgtactgctattcttccatagttagtgtaagttcagtgttggtttttcatgacttttggaggccactaactttccatttcacctgcacagtttcaattactctaatcatatagctctttaataatcagcctggctatgagttggaagctttaactgctctctgacaataagtagtagctaattaattgctacttatgaactttctgtttttttatcttaatacttctgagagttctttccagataatcactggagaataaggagtttttacccccatgtggctattcctctaaaactagctatatttaactagctctaaaatagatgcgaaagattgttactttgcgtgcaacaaatacacaggaagaattcaaagaattgtattttaaatttgttacatctgcaatttcaagtaaccaccactagggggtggtgctaaatacttaaatggtaattctcagtctgagttcaaaaatgcagatgtctaggtcttggagaatcaggatcttctgagtaagagattaggaaatcttccccttttttattattatactttaagttctggggtacatgtgcagaacgtgcaggcttgttacataggcatacacatgccttggtggtttgctgcacccatcaacccgtcatctacattaggtatttctcctaatgctatccctcccctagctccccaccccacaacaggccccagtgtgtgatgttcccctccctatgtccatgtgttctcattgttcaactcccacttatgagtgagaacatgtggtgtttgattttctgttcttgtgtttgctgagaatgatggttgccagcttcatccatgtccctgcaaaggacatgaacttatccttttttatagctgtgtggtattccatggtgtatatgtgccacactttctttatccagtctatcactgatgggcatttgggttggttccaagtctttgctattgtgaacagtgctgtaattaacatatgtgtgcatgtgtctttatagtagaatgatttatagtcctttgggtatatacccagaattggaatgctgggtcaaatggtatttctggttctagatccttgaggaatcaccatactgtcttccacaatgattgaactaatttacactcccaccaacagtgtaaaagcattcctatttctccacctctccagcatctgttgtttcctgactttttaataatttccattctaactggcatgagatggtatctcattgtggttttgatttatatttctctaatgatgagtgatgatgagttttttttcatatgtttgttggctgcataaatgtcttcttttgagaagtgtctgttcatatccttggcccactttttgatggggtttttttttcatgtaaatttgtttaagttctttgtagattctggatcttagccctttgtcacatggatagattacaaaagttttctcccactctgtaggttgcctgatcagtctgatgatagtttctttggctgtgcaggagctctttagtttaattagatcccatttgtcaattttggcttttgttgccattgcttttggtgttttagtcatgaagtccttgcccatgcctatgtcctgaatggtattgcctaggttttcttccagggtttttatggttttaggtcttatgtttaagtctttaatccatcttgagttaatttttgtataagatgtgaggaaggggtccagtttcagttttctgcatatggctagccagttttcccaacaccatttattaaatagggagtcctttccccatttcttgtttctgtcaggtttgtcaaagatccgatggttgtagatgtgtggtgttatttctgagggctctgttctgttccattggtctacatctctgttttggtaccagtatcatgctgttttggttaccgtagccttgtagtatagtttgaagtcaagtagcatgatgcctccagctttgttctttttgcttaggattgtcttggctatgcgggctcttttttggttccatatgaaatttaaagtagtttttttccaattctgtgaagaaagtcaatggtagcttgatggagatagcattgaatctataaattactttgggcagtatggccattttcataatattgattcttcctatccatgagcatggaatgttttaccatttgtttgtgtcctctcttatttccttgagcagtgatttgtagttctacttgaagaagtacttcacatcccttgtgagttggattcctaagtattttattctctttgtggcagttgtgaatgggagtttactcatgatttggctctctgtttgtctattattggtgtataggaaagcttgtgatttttccatattgattttgtatcctgagacttgctgaagttgcttaaggagattttgggctgagacgatggggttttctaaatatacaatcatgtcatctgcaaacagagacaatttgacttcctttcttcctatttgaataccctttatttctttctcttgcctgattgccctggccagaacttccaatactatgttgaatgggagtggtgagagagggcatccttgtcttgtgccagttttcaaagggaatgcttccagttttgcccattcagtatgatattggctatgagtttgtcataaacagctcttattattttgagatacgttccatcaatacctagtttaaagagatttttaaggggtgctgaattttatcaaaggacttttctgcatctattgagataatcatgtggtttttttcattggttctgtttatgtgatggattatgtttattaatttgcatatgttgaactagccttgcatcccagagatgaagccaaattgatcgtggtggataagctttttgacgtgctgctggatttggtttaccactattttattgaggatttttatatcaatgttcatcagggatattggtttgaaattttttgctgttgttttgtctctgccaggtgttggtatcaggatgatgctggcctcataaaatgagttaaggaggattccctctttttctattgtttggaatagtttcagaaggaatggtaccagctcctccttgtacctctggtagaattcagctgtgaatccgtctggtcctggactttttttggttggtagatgattaattactgcctcaatttcagaacttgttattggtctattcatggatttgacttcttcctggtttagacttgggagggtgtatgtatccaggaatttatccatttcttctagattttctagtttctttgcatagaggtgtttagagtattctctgatggtagtttgtatttctgtgggatcagtggtgatatcccctttatcatttttattgcatctatttgattcttctctcttttcttctttattagtctggctaatggtccatcaattttgttgatcttttcaaaaaaccagctcctggattcactgattttttgaagggttttttgtgtctctatctccttcagttctgctagttctctccattgtgatgttaaggtgtcaattttagatctttcctccttttttagtgctataaatttccctctaaacatggtttcagctgtgtcccagagattctggtacattgtgtctttgttctcattggtttcaaagaacttatttatttctgccttcattttgttatttacccagtagtcattcagtagcaggttgttcagtttccatgtagttgtgcggttttgagtgagtttcttaatcctgagttctaatttgattgcactgtgatctgagagactgtttgttatgatttccgttcttttccatttgctgagaagtgttttacttccaattatgtggtcaattttagaataagtgtgatgaggtgctgagaagaatgtgtattctatcaatttggggtggagagttctgtagatgtctattaggtctgcttggtccagagctgagttcaaatcctgaatatccttgttaattttctgtctcattgacctgtctaatgttgacagtggggtgttaaagtctcccactattattgtgtgggagtctaagtctctttgtaggtctccaagaacttgctttatgagtctgtgtgctcctgtattgggtgcatatatatttaggataggcagctcttcttgttgcattgatctctttaccattatgtaatgcccttctgtgtctctttttatctttactggtttaaagtctgttttatcagagactaggatggcaacctctgctttttttgctttccatttgcttggtgaatattcctccacccctttattttgagcctatgtgtatctttgcaagtgaggtgggtctcctgaatacagcacaccaatgggtcttgactatttatcccatttgccagtctgtatctttcaattggggcatttagcccatttacatttaaggttaatattgttatgtgtgaatttgatcctgtcattatgatgttagctggttattttgcccgttagttgatgcagtttcttcatagcgttgatggtctttataatttggcatgtttttgcagtggctggtactggttgttcctttccatgtttagtgcttccttcaggtgctcttgtaaggcaggcctggtggtgacaaaacctctcagcatttgcttgtctgtaaaggattttatttctccttcacttatgaagcttagtttggctggatatgaaattctgagttcaaaattcttttctttaagaatgttgaatattggccctcattctcttctggcttgtagggtttctgcagagagatctgctgttagtctgatgggcttccctttgtgggtaacgtgacctttctctctggctgcccttaacattttttccttcatttcaaccttggtgaacctgacgattatgtgtcttggggttgctcttctcaatgaatatctttgtggtgttctctgtatttcctgaatttgaatgttggcctgccttgctaggctagggaagttctcctggatcataccctgcagagtgttttccaacttggttccattctccccatcactttcagatacactaatcaaacacaggtttggtcttttcacatagtcccatatttcttggaggcttcattcattccttttcattctttttctctaatcttgtcttcacactttatttcattaatttgatcttcaatctctgatttccttttttccgcttgattgatttggctattgatacttgtatatgcttcacaaagttctcgtgctgtgtttttcagctccatcaggtcatttatgttcttctctaaagtggttattctagttagcaattcatctatcattttttcaaggttcttagcttccttgccttgggttagaacatgctcctttagctcagaggagtttgttattacccaccttctgaagcctacttctgtcaatttgtcaaactcattctctgtacagttttgttcccttgctggtgaggagttgtgatcctttggaggagaagaggcattctggtttttggaattttcagcctttttacgctggtttcaccccatcttcatggatttatctccctttggtgtttgatgttggtgaccctcagatggggtttctgagtggacattctttttgttgatgttgatactattccttcctgtttgttagttttccttctaacagtcaggcccctctgctgcaggtctgctggagtttgcaggagttccactccagaccctgtttgcctgggtatcaccagtggaggctacagagcagcaaagattgctgcctgttccttcctctggaagcttcatcccagaggggcacccaccagatgccagccagagctttcctgtatgaggtgtctgttggcccctgctgggaagtgtctcccagtctggagacatgggggtcagggacacacttgaggaggcagtctgatcattggcagagctcaaacattgtgctgggagatctagcactctcttcagagtcaagtattgtttgtttttaagataatatatagattagtaatgcatatcttgcaacccttttaaagatttcaatagatgatataggatctttacttctttatttcagttcaatccaactcgggtgacaattactgatgcctctcaggcccaggggcttgctggcccatacagagggcttgtggctttgcagactctgaaacttgattctttctgatttaatctttctacttccttcaatccaagggtcacttcctcttatcagttgcacaagagacaccatcccacttgcgtgtcctggcaacagcttgccaaggtgctctaagtccaaagaagaatgccaattctgctttcccttaaataaatctctctgggaaatcttcctttttaaataagtctcctgagtgaatttgaggcaggctaagttagacaacagcaattcaattcattttaactggtttgagttccctcaaccccatccacaaaagaaaatcttcctttagaaaattgtcatctttaactaaaatgacaatatgaatatccacatagagtgtatccacgcccaaccacttttcagcacctctactgaccactgtcatcccttgtcacagacactgaaatcgcctcctaatcagttcccttgcttccatttccctggaatcaatctccacatagtagctggagtgatcttttagaaagataaattctgtcatctcactttcctgctcagaactttctatttactatacatcaccctcagaataaaatccaaatgtcttactgtggcctggaaggccctccatgaacaggcctcggaccgccgtatcattgcctcccctagcaccttccaccttcacgcaaagctcagatccttgagcaagctatttcctcagcccgtccccaagatctgcagggctgactccttcctcctctgctcaaatgtcactgcctcaaagaagcttttcctttgcctcaccacctaccatcagtcctgccagtggtggctgggggccaggggccaggagtcagggagggttattagagacagattttgtagatccttttacaatcacaaagcaggagcatagtatgtgtttgttgaatgaataaatggataaacttaagctaaatctaagtataaagtgggaaaatattaatatgtgtaggtgcaaactgtgaccccctctttattattataactatgcaatggctttttaactaagctttccatacacattcaactttaacacaactacccttgtcttgcctcttaggagtgattttccatagggacttgagggagatggacccttccaaaacaggcatttcagaattttcaagcaccaagggatatataaagttgaagctgcacactcaatatatgtcattataatattttaattaattaatagtgactttaatatgaataaagacttaaagcagatttcaacacaatcttctggtactgtctatccctagggcattaacatgaccctcttccttggagctgaaggtttttggtgtgtggccctccagagccctctccaccctcctctgctctgctgacccagtggcctgggaggctgaccttcatggattattgtatcatatgggtttccttggtctctgtttcattttagggtttggccaatggaaagtatcagcagaaattaagaggatgaaagaaaagagtgtgttatttattctccagctcaccccctgtagattggcagtggctgctttcctctaccaaagggcccagttaagtcagacagcctctgctaaactacaagtctctctagggtccagtaagtgctcccttcccttgcctccttaggcctaaggatggtcatagctctctgcagctactggctccagaatgcccccctaatcctgcttgcacctttgtaaatagccccttcattaatctttcttcaatcactcctttggagtaagcaattagtctactacatggactcagatgactacgctatttttatttttattttttgagacagtcttgctctgtcacccaggctggagtgcagtggtgtgatctcggctcactgcagcctctgactcctgggttcaagcaattctcctgcctcagcctcccaagtagctgggattataggcgagtgctaccacacccggctaatttttgtatttttagtagagacggggtttcaccatgttggccaggctggtctcaaactccggacctaatgatctgcccaccttggccccccaaagtgctgggattacagatatgagccacagtgcccagcccagatgactacactttatgagggtgatgttgctgttctagtctctttctaatgacaaacggatcttaagttgctcaggtgactacatttcagtccttttctctcattgtctccatactgtcttctcttttcattcccctcctgtcccgagctgttctcagcaataacttcactaatgtttacccatgcctgtgcaaaagccagcactcccagaaagtcctagcattctccaactctctacaaaaagggtcttggcttttgttttctttcagaatatttatattttaagcatggagagctttaaaaaagaatcagctactaaattttctttaaaatgactatcccacacctgtcaccctgtttattctcttttttttcataattacacatttgttttattccacattatacatacaacagtctcagaacaataatgccaataccaccaccgctcatgtaattactgaaaacagctaaatcatttttgtatatactttcttcatcttccccacttttaaaaaatagatgtatagcacaattgcactgtatcaacaatgttaatgcatatataatccttgcatacaatatgcttttataattctcatctaatcttagttctttttttttttattgatcattcttgggtgtttctcacatagggggatttggcagggtcataggacaatagtggagggaaggtcaacagataaacaagtgaacaaaggtctctggttttcctaggcagtggaccctgcggcctaccgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgtttcagagaccactgggttgggggtaaggtcacagatcaacagcatcccaaggcagaagaacctttcccagtacagaacaaaatggagtctcccatgtccacttccctctacacagacacagcaacaatctgatttctccatcctttccccacatttcccccctctccatttgacagaaccgccatcatcatcatggcccgctctcaatgagccactgggcacacctcccagacagggcggcagctgggcagaggggctcctcaccttccagaaggggcggccgggcagaggcgcccccccacctccctcccggacggggcggctggccgggtgggggctgccccctacctccctcccgggcggggtggctggccgggcgggggctgccccccacctcccagatggggtggctgccgggcggaggggctcctcacttctcagacggggcggctgctgggcggaggggctcctcacttctcagacggggcagctgccgggcggacgggctcctcacttctcagacagggcggccgggcagagacgctcctcacctcccagacggggtcgcggccgggcagaggcgctcctcacatcccagacggggcggcggggcagaggcgctccccacatctcagacgatgggcagccgggcagagatgctcctcacttcctagacaggatggcagctgggaagaggcgctcctcacttcccagactgggcagccgggcagaggggctcctcacatcccagacaatgggcggccaggcagagatgctcctcacttcccagatggggtggcggctgggcagaggctgcaatctcggcactttgggaggccaaggcaggtggctgggaggtggaggttgtagctagccgagatcacgccactgcactccagcctgggcaacattgagcactgagtgaacaagactccgtctgcaatcccggcacctcgggaggccgaggctggcagatcactcgtggttaggagctggagaccagcccggcaaatatcagcaactgggaagcccataaatagcagcagaggacaaataggatgactcagtaagccctctgagtcagactggcagagactggccttccttcataattatggggcattaaacccgtcatctgtgaagtcacctccaagtctcatctcaccaatatcatgcatctagtttcctttgaagatgtgcaatcttcctccttgtagctactaagaaattaaagtgcttgggctgagagggctcctgtaagctaatagtctatgtcttcagcaattaacccctttctgagattggctggtgttcatgcttttagctggtcctagtcctggcttgggtacccttgagcgtgagtcctcagataagtcacttcatctcactgaacttctttcatctaagatgagataataaaacttgcctagctacagagttgtcatgaagattaaagtcaatttggccaactacatgacatttggaaaaggcaaactatacagacaggaaatagaccaatgattgccagggactcgaggatgaacaggtggaacacatcatatttttagggcagtgaaactattctctatgatattctaatggtggatacatgacattttacgtctttcaaggcccacagactgcacaacacaaagatgagccctgatgtaaactgtggacttcatttaataataatgtatccatactgattgatgaattgtaacaaatatacctcagtaatgccagatattaatagtaaaagaaacttcagggagaagaaaatgtaggtaagtgggaatcctcttcactttcaggccaatttttatgtaaacctaaaaccgttctaaaaataattttttgtgacattaccaggccaaaatgaattaatttaatttaaaaagtaaaatacaaataattttttaaatcagtttggataagatatgtgaaagtatttgacaaactctaaagagctaaataaacataaggcataacacccaaatgatcttaaagaacttaattgtgaaagttcttttggggatctgacaagtagagccccaggtgatgtcttaattacctgtctccatgccttagaagttggttgagatagaagggtgggtaggacttctatgaccagtttgccttcactgctgactgaaaagatttctaccaaatccaaatcatggtacaaatattctacccttcacacaactactacctctttgaaattgctcaggaaagtttaatacacatacacactacctttcagcatgtttccttttgattctctgtggctctcaccctgtccaatatttagcagtcatgtttgattaaggtcacatttttcagaggtgaaaaagcgatgagaagatttcaggattaagttcaggattaagttcagttaggttaggaaggaaaatctttcctccttgtaagccagagaatgcctgacatagacaaagcttcttacagtgtttcgttgttgggactgggggttgaaagggtggctcttgctggagcctggaaaacattatctctgatgcccactatatctgtgtcagttagggaggataaattgtggggcaagaaagaggaccagtggggtcaaaaattagcatagatcatgcagaaatgacagacagggattcaaactcaagagagaggaagctgttgttcaggccttgccaagtgagattagctagctaatttcagccagcttattctgggatagtggtggtcaattgcatttcctctcctggataatgcatgtacttttgacaagaaccttcaaagcttttgaaaaagaccttcagtgttcatcacacaatgatcactggaactctgttctaggagctattaatagacttgccatgaaaaaagaagttctatggtcaaataactaggaaatgcttaacatgatggagccctttgtgaacaattatgacacacattcgtacgttgcaggctctgggcaccctgcagctaagaaaactatttagttttgtttaactccaacatgtcccaggtttatgtgcactttgagcacattttactgtatgcttactaacatttcctagaatatcagcataggaaaaaattggttttaaaaaaggaagcaggctgaacatggtggctcacgcctgtaatcccagcactttgggaagccagggtaggcagatcccttaaggtcaggagtacgagccagcctggccaacatggtgaaaccctgtctctactaaaaatacaaaaattagccgggcgtggtggtgcatgcctgtagtcccagctatttgggaggctgaggcacgagaatcacttgaacccaggaggcagaggttgcagtgagccgagatcatgcaactgcactccagtctgggcaacagagtgagactccatctcaaaaaaaaaaaaaaaaaaaaaaggaagcaactaatggtggaagtaaagccaccctgacatgataacaaaagcgtcattttggggaaatgacctcatatcagcagtttccccactcatccagaggtgagtatggtgtactctccatgtagtgacaataaatatatttattaaataaataaatcctgtgtccatgatttctccacaactccatgttagatcctgttatcatccattaggtattaaagtgctctcagccaaggagcactcgggggttagctctagattctgaggtaatactaccagaaactagaaaacgaggagaaacaggtgtctgaaaagagaatcagaatctgatgcgaggaactgaagaaaagcaagctgcaaaactgacatctcttgcactgcctccactcactatctgactatgtagacagaaacatctaggttttaggttggtgcaaaagtaattgcggtttttgccattaaaagtgtatttaagaattaacatccctaatgaaaggtactagaagtttaagccactctaaatactaataagatacatagtgtttgcacatagaaggatggaaaaacaggcaatgagaaagacttctttgctgcacgtaactgtcaatgaatgtggaagcttagttgttcggaatctaatagttgagaccagttttcaaaaccactcccaatttcagggcgcagaatgtcttagtaacacctacaagtttcatctaacgaatatgactaaagccagaaagcagccctgaggtttttccacagagagtccgccctgcctgggtcatacatgcccctatgcaaagtgggcccagcactgtcccctcctggtgctcgcgctgcgggggagcagagccagggtggaaacctgctatgggcagaatgaggctgtgctgggctggaatgagccactcctttagagaatctaaatgaggataaagaatttctgaaccagctaggggccaaaacccatccaagaatagaagtggaagggactcaagctttttaagtttcttccacagcaatccagattccaacattgtttctaaggaggcttttgtttccctggagaactctagtttcaaagtggactttcttgcacaaagagcgcttcaataaaattggttgcgtgagtgagtgttaagtgtgaattcaaagaagaatattaggctgggtctcaggcatatgttactattacactatgtatcttattagtattcagagtggcttaaacttcaagtacctttcatttgggatgttaattctaaaacatacttttatggcaaaaactgcaattacttttgcaccaacctaatacctagtttctgtctacatctcagaagccagaggtgcctcatgagaacactgaggtacccagacaaggaccacatccagacaggaagagcacacagcacagtggctgtgagcatgggttttccatgagatagacctcagttagaatctcagcctcaacacttactagccatgcaatcaggggaaatcttgctgtatgatcctgctgagccttggtttccttaactgtagagagactaagaatctctaacttacttggggattcaatgcaataatatgtatcacagaccaggcacagtggctcacgcctgtaatcccagcactttgggaggctgaggtgagtggaccgcttgagtccaggagtttgaccaccctagcaacatggtgaaaccccatctctaccaaaactacacacacacacacacacacacacacacacacacacacaccagccaggcatggtggcacttgcctgtagtcccagctactcagggggctgaggtgggaggatcacctgaactttgaaatttgaggctgctgtgagccaagatggcaccactacactccagtctgggagacaggagtgagagcctgtctcaaataattataataatacatgtaatatttagcattttacctggcatatcagtacttgatatattgtagtcattataaaggtcaaatttctctctaggactgggttagaaaatatgaggaaaatagataagttcatagaactaattagaaaagagagaaagttaaactctcctatgacttgataaaatgtctgtagaaaaagacaatttcagcagggttgcatcagataaattgaacccatcccctgccacatttgttcctgggcctttatatcctcagcatgacattgaactgataggaccagaaggtactgggagaaatgtaaagatgggatgtgactgaatttggggtgggtgctttgcttcgtaggaattctttggtttttggagaagaaggccaaactgtgattttgtcatgaagctgtcatgaaactggcattttatgatcatttttaaacttccattatagttttaaataagttcctggcagtcttcaacttttacaaagtcttcctggaaacagggtcagaaaacaaaaagggtgaagccaaatccctttcccctgacatttgctgtgctagaaagacagaccggggtccctctcaaagctggctgcccctcacttcccagttcccctggttcctgtgtgccattcagacaccccactgcagtgctttcagcccacaggatagaaaggaaaagctcatggctattgttataaaacacagttataagatcaatggaatggttttgaatgcatttgcttgctaatgggaatttttacaagagggaaataaaagagaaattagttcaaatttccctagacagatgtcttaaagaaatctgagccttccaaaatgctaccaaaaagcttttctaaattctgcaaacgaagcaaaattgttgttagttaaatgcgtaatgtttattatcaccagcatattagttttagagaaaatttacaccacagtggagttgtattttcatgtactacgagtacattttgtcaatcattagggtccctgctaaaatcaaagtaacaatatagtaagcccattttaaagaagctagaaaacagttttactatttttttattggtttggaaacttgtgctgttgtgttttttctttaatgacatcattaagtatccggccaaatatccctgtccaaggaattcagtctttaattattacatttttccatgggaataaacactgtcactgagtgttacaacttagtttctaaaagtacatggtggccagaagcctgctagcctcagaggtatttccacaagtttagcagtgtcaaaactaactgagttacatcagctatttgttgaaagagtcccaccaaaatctgataaaaggcccataaaggaatcagaatgtttgcttatttgtctgtttaaagtagtgtcagagtaatagatcaatacaacataggggctgcttatattgttcagaggaatagtatattaaaaaatgctattcttgatcaaagtagacccccaacatgataacacataagagaatctggaattctaaaactacaagaaacggggagagataggaagtaagcacaaaataaggagaaaccttcaataatcagctttagtttagctgatcattgaacgacaatatttactatagtgttttctgtctttgctagtttaaccacatgttctgtttttcaattcaagatcagggcatttttatattcactttggggaaatcatatgtcaagaaacatttacttgtatatccccaaacattcagatttcatggtaaaaattaatgtacatgacatacatttagacaacagctactggttgccccctccaaaaaaagtcaaggtgccacaaagactgagctcttgatgtgaggaaaacagtcattataagcagtcctgtggtccctgagaaaaaggattccttcactctctgaagaggaatttatttatacagcatgaacaactatctgctgaattttaattctgtcctttctcagaaataagtttgggctctgcttttaaaaacaagcccaggaaataacagtttgcaggggcctgaaatcagaagcctgcagactgctggcaggaaagttcaatattcatattcattttcattctacaatcgacctcatgtaccagaaggcttttcctcaacttgaaatctcagtgttccctcaaacaagtcgcagcatgtgtttgcctcacacatgacactaactcttacttttggactgaaacaaaagccaaaggtgaatcctggtgaccgtcaagactccaggaatgacccagcattgattatgggctccttggagaaattcagacaaatatgagaaaacaaataggggtggagccagaatttaggttggtggggcactgagaaactttttttctcatttgcatattttccattattgttgtaacacatgcttcattcacagggtatgtgacaatccagaaggacaccactctccaggatgacctgtgtctgagtgtagagtttcagagaccaggccattcacttggcacagttaccaagaatggtcttttggagtttttcagagtggttggagtttctcagagatacgtcctcattgtttgattttcttacataatatgtactcccttggtaatcacatctgcatttttaattattaactatattcaaatcctctggcccctccactgagcaccaatgatatatagccaactcttgtggacatccccactgctggtcctacagcccatcacattcagcaatgcttgcatcatccccccctctttcccaaaccactctccttcctgtctgttgcctaagcaaataccacttccatccagcaaagctcctcagccagacacctgactttctctccctcacaaccacccatgaccaagcctgtcaatttcacctcctattaataatttcccctgaaccagtccactcccctccatctctatcaccaccatcctgggggaggagaccactaccatctcaaacctatgttacacacagtcttcctaactgaaatgctgagcctcttctaaagcactagaactttcaaaggctcagtcctacctttctcaccctcctgctcaaaacctactcccactgccatttgtctaaacaaaactcttttatgtggcatgaaaggcatttcttgatctatctcctttatcttgaaaatctcatcccttgcactccataatctagtcatgctacaacctagtcacagtatttcgattacctgttttgttttaattttgttttttgtggtttttttttttcagagacagtgtcttgctatgttacccaggctggagtgcagtgactgttctcaatcctgatcatagtgcaccatggcctcaaattcctgggctaaagccatcctcccacctcagctccaaggactacaggctcacaccacaacacctggcactctgtttacttctctttttcccctaccaggttataaactcctccaaggcaaggatttagtcctgctcacagttgtaacataacacctagatcagtgcctgcacatagcagatgttcaatcattaaactaaaatttatttctcccataattttttcttaagttttggtggttccaattgaaaaaaagacaacatgaatgagcattaacaaataaataaaaagctcagatgcatgagacctgcctgcatccttataataaaagctgtattttctccaagtaattttttcctgttttatgtgaggaattaaatatatcaatatgtcatagtgttagaaaaggagaactttggccttcaggtaatacaacacctaaaaaagttttatgtcatttgtattagaaaatgtcacgttcctaggctgcttagatactcaggattcattagctatttctcattggaagtgccagaaaagtgccagaaatacaactcaatcaacttagacactccaccctcacaaaaactgataatcggttcatgtaatccaagaaaagattgaataaccaatacacagaaaggacagtcatgcatttaggtctcagaaaggactcaaaaccaagattcaaaagctatcagactcactgtgacgcttctctcaaaaaaaaaaaaaaaaaaaaaaacctgcatactctcactagttctctccactccatatgatgagaaaaaaaaaaaacacaacacagtattattttctagggctgctataataacacactaaaaatgagttgtcttaaaacaacagaaatctattgtcttacaattctggaggttagaagtccaagctcaaggagttggcagggcacgcccactcagaggactcggggagaatcctttctggcctctcccagcttcccatgtttgcgggcaatccttgacagccagtggcttttagatgcgtcactccagtcacataaccatctcctccctgtgtctcttcgcatggtcttccttctgtgtgtgtctgtctctgagtctaaatttcccttttttattatgtaaggacaccagtcctattgattagggcctactctaatgacctcattgtaacttgattacaggtataaacaccctatttccaaataaggtcacattctgaggtactgggggctaggacttcaaaaacataccttttttcaggagacataattcaactacaacaacgaataataacagtttccaatatttgcatctaaagtctcccctaccagaggaaaagtctagaagtccttgacctggtttatgtggtgtccccaacccctgggccaaacaacagagatgggggcagcagagttctataagaacatgattgtttctgtggtagtcatatagatggggaaagtggtactatggaacagctatgctcacatctgcttcccttctagtgacaaggagatgggttaatgttagagggtaaaaaaaagatacagacactcagcagagtgacaggtaaacattcacaaggagaggagtgttaggaaatagatcaggaaaggagtgtgtgccatgacatatcaaatgtcttctttaatactgtaagtgggaaacaaagcaaagcgtttgttcaatttactgctgccacaaatgagagatgcattatttttctttttcaggggttatggtcaacccaattttctccctacatacagcattccattacatatattttgctcctaacttattttatattctggaggtgaaagcatataagaacaaatcagtaaaaactgtggtgatattttggcaccagaaattaagttcctttttaacattatgaactatggctaaaccaggacaaaggtgactcaaaatttccttaacttaagctgggtatggtagcaacggcctgtattctcagctactcaggaggctggggcaagaggagaggatggcttgaagccaggagttctaggccagagtgcactgtgatcacacctgtgaagagccactgtgctcctaggcaacaaagcaaggccctgtctttaaaaaaaaaaaaaaaaaaaaaaaaaaaaaagttaaaaaaatttcctttacttaaaggtttgcatgactatttagacatacattgaagccaagtgtggtggctcacatctgtaatcccagcattttgggaggtggggcagtgaggattgcttgaggccaaaagttcatgaccagcctgggcaacatagcaaaatcctgtctctacaaaaatttttaaaattagctgggcctggtggcatgtgcctgtagtcctagctgcttgggaggttaaggcagcaggatcgcttgagcccaggagtttgaggctgcagtgagctatgattatgcagcctgagtgacagagcaagaccttgtctttagaaaatataaaagtaaaaataaaattaaaataaaaacatacattgcaattgttctaattgtcaaatttatttgctccaaaataaaactgggcaggtctattttggataccatttaaactccaccattaaagcaactattttaaagtattttttaattatagaaaaataatatttgttaatttatagacattttggaaaaatctatgaaagactgtttaaaaaataaaagtcacctataatcccatcactaattaccgttaacatttcaatatctttacttagttgttttctctatttacataagtacatttttaaaaactttacagagttagatttatattatacagtttttgttttttgtttttttgagacagggtctcactctgtcacccaggctggagtgcagtggcatgaacatggctctcactgcacctctgcctcctgggctcaagggatccttccacctcagcctctagagtaactgggaccacaggcatgagccatcacacccggctaatttttgtattattttggtaaggttctgccatgttgcccaggctggtctccaacttttgggctcaagtaatcctcctgcctagcctcccaaattgctgggattacaggcatgagccgctgcacccagccagatacatattaaacagtcttatgtcctcattttttcattttatattttggaaataccatgtttaatcacagcataatattctatggtatgccataattcatataaacactattttattgttggacatgtaggttgcttatttttttattataaggatgttccaaatatatatatatgcacagttttattgtaagcatagctaatcacccctaaaagagatgcaaagctttctgccatcactaagcaaatttcaatttattctatacaatctgcctctaaaatgagataaaatatcaatcatcacaagaaatataccaaaatgcatacatacaattaacaaagatatctaattcctaattacaaattgtctcatatattgaaaagcacagtgttcaagttccttgagggcaggcacagtggctcacacctagaatgccagaactgtgggagaccaacgtgggaggatcgcttgaggctgttacagtaagtagctagtcagacataggtggagcagggcagggcaggagaggggaggagtgggcaggagagggaaggaatgggcaggagagggaaggaatgggcaggagagggttcccccatccccagcccaggagtcttgggcaggcgagggggttgttaactgtctctctaaagtaataattggtcccagccggtgctagggaaaggcaggctcacaataaatagaaaacacctgaaactgatcaacttctggataagctttcaggagtggggagaagtaacccaagatcctggaagtatgccgatgtataaaaccccaaatcaaaaggtcaaaccacacatttgtctttcaggtcacccacttgggcctcttccaagtatattttcctccctttcattcctgctctaaagttttttaataaactttcacttctgctctaaaacttgcctcagtatctccttctgccttctgcccctcagtcgaattctttcttctgaggaaacgagaattgaggttgctgcagacctgtgggatttgccgcagtaacaaagccaggagtttgagactagcccagaaaacgtggtgagatcttgcctctaaagaaaaggggggaaaaaagtttcttgactctcttcagatcttttggaaatcttatcccttgctaataaatatttgtagagtcagaaagaggagatggcattaatttctgcattgatgtttatattttggtgctatatggccgggtcaaagggctacatattccacctctgctccagagctgcttatccaagttctctgggatgtagctggtatacctaggaattatgtccctagaaagacgcaaccctgcagcagctagaattagtgcaatttagtgagaagagcacaggactttctctacacctgggttcaaatttcaatgccagcacttctgggagcaagtctttgggcaactcagtgtttgtgagtcaatctactatttctaaagtagggaaggacacaggtgaacattcattgaatacagaggctttacacaagtgatctcgtttaactctcactaaaaaatgactgatccttttaaaaataagacaacaggctcagactgggtaagtaattactcagactgataaggaggcaaggcaggatttaattccagatctgtctagccctaaagctcacattccctgccccacttgacatgttgcttcctggactcacttggattgtggagaaattagttggatttgaatgtctcctctagcgtagtcagcatagttttcattcctgtagcagtttttgtattatagtttgttgggatagagggttgggaccagggccaggaataggttaaggcaagcgaaacactaacctcaggcagaaaatataaggggcggggcacaaaaaactcagtcgtcaagataaataatattttaatataatatttttttaaatctaaattaatgcaaaaatccataaagaacaaaataacattttaaatgaaaacaagaactgatagttccatgttaagccatattggagcctacaacagaaaaacatacaaccctattcacatgtttttaatgtatttttgatgtttaattatgataaatgctatgtaataataccttggccaggcacagtggctcacgcctgtaatcccagcactttgggaggccgaggcaggtggatcatgaggtcaggagatcgagaacattctggctaacacggtgaaacccgtctctactaaaaataccaaaaaaattagccgggcgcagtggcaggcgcctgtagtcccagctactcaggaggctgaggcaggaaaatggcgtgaacctgggaggcggagcttgcaagtttgtgccactgcactccagcctgggcgacagagtgagactccatctcaaaaaaaataaaataaaaataataccttaagcagatatgaatttttttcagagcactagttttaaaatattgaaacaattgaaaagtagatatctacttttcaattaaataaaactcacattttaagtatttgatcagaatttattataaatttattttgctggttttaatggaagcaaattcataggtggtatttttatctaagtcaatagcctttttttttttttccaagacagtttcactcttattgcccaggctggagtgccatggcgccatctcggctcactgcaacctcaagcgattctccagcctcagcctcccgagtagctgggattacaggtgcccgccaccatgtccagctaatttttttgtatttttagtagagatggggtttcatcatgttagccaggctggtcatgaactcctgacctcaggtgatccacctgcctcagcctcccaaagtgctgggattacaggtatgagccaccgcgcctggccgccaataactggttttaaaaatacgtaaaatcatgtatccagttatatagtatgtagtacacatccttccttttgcaacatggctcagcacagcactggctggaactatgacttgcagctaccagcctcaaagattttcaggactctgtaaatggaaacagaacatctgatcatatctgactcctcaggtctcctatcacagctcctttgggtagtagtctctcttttcatagaagaatatcactgtcaggctgacttttagggtcatgttcctaaaggccaataaagacaagctgtgttctcatgacaacaggcagaaatcaacctcacacatctgctgatgctccagaacatctatgtggacttccaagcactaaatatctgagagttactgtcttttaaatacccccaaatgaaggttttgaataacctttctggagcacatatgttcatttaacatttattgaagactacatccctactaaataaaacagcctatatctgcgtttgcagattctattatccagccttatgttctttaccaattagtagtgtatgtcattatatcttttgtcatttaaaaagcatgtattatgcatcttttattacagtaagggctatataataatgccttatgcttttacgatttttcacttgcattcaatgcttatgaaggttctatgaggtaggtagatattttatagaaattaatgtattaactttttctttgaagctgcagattatctagtgatcagccctctcactttttactcactgtcctctgattccagttctaatgctctttccacactgccaagttgcctcttctaacagacagcctaataacataggatttcagatagacaagtgtagacaaaacaggactgtacggtggaatataggatgtctaaagtgatcaaatgaatatgaaattatgatataacctgccaaggaaaagatgaattttccagaagggagagtgaagaggagtcatagggtaactcagtccccgacactgccacagagctggggaggcccgggtctgccggagaggtgatgccatgtgtggttaccatatggctgggggcagaggcatggtcagcagcacaggcagagctcagagcatgacagcctcaccagagacaaaaagttgagtcacaaacctggcctaatcagaatcaagaaacagagcaggccgggagcagtagctcatgcttgtaatcccagcacttgggaggctgaggtgggtggatcacaaggtcaggagttcaagaccagcctggcaatacaatgaaaccctgtctctactaaaaatacaaaaattagctgggcgtggtgacggctgcctgtaatcccagctacttgggaggctgaggcaggagaatcacttgaactagggagacagaggttgctgtgagccgagatcgtgccaccgaactccagcctgggcgagagagctagactccatctcaaaaaaaaaaaaagaaaaagaaaaagaaaaaagaaacagaccaattctcagaatgagtgccaatgagaagacctaagaaaacaagagacaggccaggtgcggtggctcacgcctataaacccaacactttgggaggccgaggcaggtggatcatgaggtcaggagactgaggccatcctggccaacatggtgaaaccccgtctctactaaaaatacaaaaattagctgggtgtggtggcgggcgcctctaatctcagctactcgggaggctgaggaacaagaatcgcttgaacccaggaggcggaggttgcagtgagctgagatcacaccactgcactctagcctggagacagagtgagactccgtctcaaaaaaagaaaaaagaaaacgagagacaaaacagactactgtccgtgatttctttaaaaaaccaggaggagaagataaaactgttctggagatggataatggtattggttgtacaataatgtgaatgtttaatgtcactgaactatacatttaaaatggtttaaatggtaacttttattatatgtatatttttaacattatatattgtgttatatataattgtgtatatgtgcaccatttttaacataaataatttttttaaatcagactcaagttgacctaattctctgtacctcagaggaaaatcctcccaggtccaaaaaagaaaaacagtcaggagctgcttaaccagtgattgaggtgaaggcaggggaattttacccacctaaagggacaatttgtaagtttgtcagtatttgggggttttggtttatttttcttttttgagacagagtctcactctgtcacccaggcttgagtgcagtggtgttatctcggctcactgcaacctctgcctcctaagttcaagcagttctcgtgcctcagcctcccaagtagctaggattacaggcacatgccaccacgcccagctgatttttgtatttttagtagagacagggtttcactatgttggccaggctggtctcaaattcctgacctcaggtctgcccgcctcagcttcccaaagtgctgggattacaggcattaagtcaccatgccgggcctagtttgtttgtattttggctctaacaatgaatgaggtacaactggctggggtcctgggattagagatgcccaataatatgtgggtcagtcgtgcaaaaagaagctgtctcatgtcagacatgagctttgaatgtctttcaagtagaggaaaaacctatttacaatgatgtgagcctaaaacctaactttaatttacacataaaacacaaaatacttttgagtagttttaaatgcactgaattttctaggaatacaatttataaatgcaaagaaaattggacgttgcctcactgaatttttaggaatgcactttataaaggcaaggaaaactggatgttgcttcacgcataacttaacccactgtagttcatcattctggaaaattacaataccaatggtgatgccccctgtggtatttgagtcatcgatgtatcactccagtaccagtctgcatttgtaggtgtcacattcacaacgattctaggtataagtacaagcatctggctataatgtatgtttactataaattaaatttttaaaatttctcctttatgttatgcttaggttatgtgtgagattagcttgtactttctattcaccttcttttagaatagaagatatttatgaaagaaaaagggtattgagactggtgaaatgtatctacatccaaccaggatggcttggagtacacagctactggggattttccaagcactttgggagaatgcatgcattctattgtttgaacagagacaacccatttatcactgacatcctgtatcccttttctgctgctatcgggggtctaaccttgtccagacaagccagaaatatctcgttttctcttccaagtactctgcagcatcttcactggaaaagaggaatttcagatgtttgactattagaggcttgacaagggcagagagagcagacacctagcacagagtttagtcagtaggaactctgaggaaaagggcaatgatcagttaaaaaaggtcagctataatatgtttcctatcctcaaagcctgctgctaaattaagggaaaaaattttaaagatgtatgcaaaaaatttattgtacacaatcaaaaggaagttgaatctaactacaaccgcaattattcatgaggtttatcaatttgtagatcattttgaagaattgacaaaattttgtatgctccttggggagacactgaaaaagtcattaaagcaaaggaatctcattagcaaacatggtctctgccctcactgaaagttaaagaatgactcaactgacagatagtttccatacttcctttttaatagccataccttatatcagtttgctctcatacatgagaattagagaccacatattttttcagagcaatttaaaaacaactgtttcgccaagcgcagtggctcatgcctgtaatcccagcacttttggaggctgaggcaggtggataacgagatcaggagttcaagaccagcgtggccaagatggtgaaaccccgtctctactaaaaatacaaaaattaaccgggtgtggtggcaggtgcctgtaatctcagctactcgggagactgaggcagagaattgcttgaacccgggaagcagaggttgcagtgagccgagattacaccactgcattccagcctgggcgacagagtgagactccgtctcaaaaaaaaaaaaaaatctgtttctttctacaaccacttaaaaaaacaaaccatgcccaaacttaatatcataaacttaattgcactactaaaaaccaaaggttaattggaaaatttaaattttcattattttattgcagagttgtttgtaatagtaaaaacaaaaatggaaacaacctaaatgtctcagcagaaacatagttgaataggagacggtgcattcataaatggaataccatgcaatctccaaaatgatcttatagaattaccaatgttattgaaagatgtgcatgtgccaggcatggtggctcatgcctgtaatcccaacactttgggaggccaaggtgggtggatcacttgagcctaggagtttgagacaagcctaggcaacatggcaaaaccctgtcccaacaaaaaatacaaaaattagctgggcatggtggtgcacacctgcagtgccagctacttgggaggctgaggcagaaggatcacttgaactcaagagatgggggttgaagtgagccagaattgcactacattcaagcccgggtgacagagctagaccatgtctcaaaaaaaaaaaaaaaaaaaaaaaaagcaagaaagaaaagaaagaaggatgtgcatgatatatttaatcatgagaacattactgaaatcctttaaaaatgcatatatttacacatatgtgcttagagaaaaaaggatacacaccaaagtgttacaagtcattgtaacattgcatttgtgtaacaacattttctttggcttgtctgtaatttctaaattgtctgtgtatatattacttttgcaataaaaacaatgtcttatcaaaataaatacatttaacttttattgacaatattttctctggggctgtcatatttttttctaaggcctcaataaactaaacaactagacagaacagaaggtaaaaaagtgaagctcattttctttattagttgtttatgaccatcatcatctctactcatcaccttcaagcaccaagctggttcttccccaccatccctgcctcatgaatggcatcacctcactggctgcccaagtgagaatctgttacctttactcatccccaatccaggggcccacctctgtctaatgtttctccataatagctcccaaactctaacaccctccttatcatttctaccatcttgttgctctatgactgcagcaagccctgtaactggcctctctgcctccaggcttctcccgacctagacttgcttacattgctgtacaagtgaggtttttgacattctcagtcttgtcactcactgcttaaactcctcaagagtttttactcccttcaggccaagggctatatgaagcccttcagatgtggccattgcttgcatctccagccccatctctcagcagtgctcttaacactcccaaccatcatgagctaattactatccttccaacacgccatgctctttcacacccctcttgctttgaacacactgactcttctgcctgaaatacctttcccagttcccttctgatatggtttggctgtgtccccacccaaatctcatcttgaattgtagttcccataatccccacatgttgtgggagggacctggtaggaggtaattgagtcatgggggtgattaccctcatgctgccattctcatggtagtgaatgtgagttctcacaagatcttatggttttataaggggcttctctcccttttgctcagcacttctccttgctgctgccatgtgaaggacaggttttcttccccttccaccatgattgtaagtttcctgaagcctcctcagccatgctgaactgtgagtcaattaacttctttcctttataaattacccagtctcgggtatgtctttattagcagtgtgagaatggactaaaacacccccttcactcacttttcagtcttcaaagtgcacagccatcctttactgccccgtgcagcaccttcaggccttgagctctatgcagggaggtaagccacagaagtcacaagcacatcttttatactagtgcacacagctgaaaactcacagactggtaccaaaccagcttggttctgttctgcttccactgcctgtcaagactgtgtgctctgggcaaggtacttcaaccactgggtcttggcttcctcatctggaaaatgaaaataaaactgcaactttataaagcttttctgaaatcaaatgcagcaatgtacataaaaggcaaataagctcactctatgttttacctaattttctttttatcctgtctgtgtatttcttaagccaaccatcttacttcctttttagaatgcatcaggatagacacaaataaatggaaacaccattacaaagcccctgctcacacttcagaattcagattgcattacctcctccaggaagtcttccttaatcactctctgctcgagtctcatttagatgatctcctgtgtgcttgcatatcgtctgtgcatacctctgtgttgagaggagtggtaagagatggggctggagactcaagaaaaggccacatcggaagggcctcgatcctttcccctgaagggagtaaaggctctccaaagactttcagcagtgagtgaaaagaccagccgagaatgtgaaaaacctcatctggacacaaggcaaaataactattttctcccttggttacctttcccattccctttcttcaagggaaagaaccatgtcttattttacttggcatcagcagctctcagaacagtggcttgaccaataccaagcattcaataaatgtttattgaaggaatgaatcaatggccacccacaacctatacctcttacagcccatttaatgccctttagccccttccataggtatttgcctggaatgtttgtaagatttttgaaaatctcagaaacaacaccagccctccacccatgggaagatgtgtttcaggctaacacctgtgctattgttgatgccattgccccaaagaagaccaacctctccttcttgcccatataagttggctctaatttcaatgctgctgaaaacctctcctcttccataaattattttttcagattgctccagcccattgtgatctttcatccttcaaactcctttaacatctagggcctacaccattaatctgacaatcaccatatactgcttaatattgttgtagtctgctatttaccttcagtctgcaatttaacttccttaagtttatttcttgttccccattgtagagaatatctcccttaaatagctgccaagtcttgccaatcatggcctttcctgtagtgttttgcatgtgtgtgcacacatgtgtttttaattcacttgaagacaaagagactccccttaggaagctttattttctgtttgccacttccctaggacccaagataccctgatccccctcaattcattctctgcctttccctgctcttcttcccaaggaaatgaacaccttccaactttatcaccagggctcctttgccttctggcttgcatttgtgttcaaccaatagaaggcacagataggtaatagatgggtgggaggacagtggtagggaatgtcttcccttgcttggcccattctgtagtgtttgagcccttccaggactatggcttctctagggcagcccctcttcaaaagctgtgccccccagataagctccaatggcatcatttcttccctttaccttttcaggcctggtgcctcaacatccttttttgatgctcttaactctgcccacacttctgtaaatagtccctttattaaagggacttttatctcttcaaaaatccccacagaatattctgtttcttgctgggatcctgactaacacaggaactttccatttagttgggataagactatgggaaccttataatttatcatccaaaccaggacacttctgagagtgaaagggggcactattaattaaaccatggcaacgggcgcaaatcagaactgttccaggctacctggaatgaatgagcatcctaggtaagtcagtcacataaaaagataattgttataatgaagagataaaaacatttctaaaagagataatattacagcatagattaaggtaagtgccaagggtggaatagacttgcagtgctacagccattccaagacaagagagattatttctcctggggaaaggcatttgagatcagcgggttgctcagttctcctccaactaaatgaagtcacacaatccatgtgtgcttggccgattttgtagattttctccaagaaatttcagtcccagttgggtccccccctccacccctcacacacccagtgtaactgttcctatttctttctattgtttaggctctgagtttttaaggaaagcaaattaatttaaatcttagccaattattccttttaaaaaataccaaatgcattcctgattcaattataaatcattgtaaatatcttatatttttgattctttaaaccacgttttagcttcattttgcaaagatatctaagaggtgatttataagctttgcttgcaaatacaaacatttctgctagtaatcacataaagcctaagtaaccctagaaagcttctctatgtatgcatgtatgtatgtttaccttgtctcttaaacaaaagagtttgacaattaaccaatactctaaagccttgtcaccctgagcaaagtgaacccagactcattgcacccccactcctagctgattcaaggctacttggccaggaaatgtttctaatgctcacgttgctagcagaagcaagttactatgagccccagtgtgtgacttcaggcttgccaaatcactgctttgttcaggcatttcatactcaagagaatagtatataaaaacacccacatccctgcccaggagcagagagcaccatgtagattagggcagccagagttcctgctctacttcccaaccagctggtgctggttaggattagaccagtgggagttggggttgaaaaggtccctcttgagagagtcagaaagggttctacaagaacaaggcaaacaggaaaagaaagcagtaactagagacaaaaagcaatggcagatgtacaaatcacacacaggaaatagcacaaatcaacacagatagtgttaataaatgcagatagtgtcagatagtgaaccaagtaggtccatgctatgcccaacatcaaagaaaacagttaagtatgccccaccatgtagctgaaaggcagatagctagaaggcttttgctattgacactagcaagactctatctcaaacaacaacaacaacaaagtcaaatagagctttaaacctgaatcatttacatctttacttcataaaatgtaaaactacttttttacccaagacttaaaatatagaattatgtaacttctactttaaacaaaatgaaaaatgttttgagtatcaaacagtatattatctaccttgtagacagcatcttcatctaacactgccactgtgttagcaattcttaaatgacatcaaactagaagaaaagctgctcctacgttgtttttatttaataagacaaatttggcactagactttttctagaaatagcattcatagtatatcgatataatagtaacatcttgttttaggttaatgaattcctattaggaagcagcactttgggacagtttttagtgacactaatttaattctatcattatagtcctctgacctgccttaattccaggatcatctgaattctaggttaaggaatgattattagccaaacctggaaacaactacaaattgtattattataggtaaccccaatttaatagtgactaaaagtcataactgtcaccattaaaaatagccatatttcatatcttcaaaactattctatttacaatactttatataataaataacttacagcagtatagtaacacgcctcaaaaaagttcttttttcactaattcctagaggtttcttggttactttccttcataaaaacacatcaaatgtgagtttacgctatgagaaaaacaggatttgaaaatagatagatattttccattatggcacaaatgtttaaggccgagtcagcaccagaaatgttcggggcctgaacgtgtttgtttcctcacattagtatgaagaactgtctgagttgagaaggctgaaaggggagggcagcttcttcttgacctgaggccgtgcagccccgaccgatgggaggcacaaggtgctggctgacttctgtctgttcttgttggtgccccaactcaggaaggaaagcttcttggagattttctgggttttatcagttttgttgtcatcatcaatggctaagcagatcatggagtacgttttctgcattcccacggagtatgtggcactcttattatgctgcacatagaaaagaaaaagggcgtcagacatcatcaagatagatgataaaaactacgaagtttggccaggcgcagtggctcacgcctgtaatcccaacactttgggagtccgaggaaggtggatcacttgaggtcaggagtccaagaccagcatggccaacatggtgaaaccccatctctactaaaatacaaaaattaaccaggtgtggtggtggatgtctgtagtcccagctgcttgcaaggctgggcacgagaatcacttgaacccaggaggtggaggttgcagtgagctgagattgcaccactgcactccaacctgggtgacagagcaggactctgtctccaaaaaataaattaaacagacataattcggaaactcaggtgaccaatgcttatatagaattaggttcttaaaacaaggacaaactgtttttcttttttgagacagggtcttgctatgttgcccaggctggtcttgaactcctgggatcaagtgatcttcctgccttggcctcctgagtagctggggctctaggtatgtgccaccaggtgcaacaaggataatttttgtttgtttgttttttgtttttgttttttttttttttaagacggagtctcactctgtcgcccaggctggagtgcagtggcacgatctcggctcactgcaagctccacctcccgggttaatgccattctcctgcctcagcctctctgagtagctgggactacagatgcccaccaccacacctggctaattttttgtatttttagtagagacggggtttcaccagggtctcgatctcctgacctcgtgatccacctgcctcagcctcccaaagtgctagaattacaagcatgagccaccgcgcccagcccaacaaggataacttttaaggaatgtactcaatagtaacaatttaagcttaggagccacaactcacattttaaggttcttcttctatttgagaaagtaataatactaatggtcacgaatatgaaagtataggatggggcgtggtggctcacgactacagtcccagctacctgagaggcttagaggggaggaatgcttgagcccaggaggttgaggctatatagtgagctgtgattgtgccactgcactccagcctgggcaacagagtgacacctctgtctcaaaaaaagggcgggggggaagggaagaggggaaaggaaagggaagaggagaagagaagggaagagggaaagggaaggaaaaaaaaaagaatatgcagtgagcaataggtctccctgtcacctgggcttctaggccctccatgttatacttctagagatgatgtgcatgtacaggtatttctgtatgtacataagtatattaccattcattttcttaaaaggaatatactgcactattctacacctgattttcttttttctttttttttctttttcttttttttttttttttaagatggagtctcgctctgtcgcccaggctggagtgccattttcatcattttcaagtgtagagttcagtggcattaactacattcacatcattatgctccactgccaccatccatctctaaaactttttcatcttcctcagctgaaactttgtaccattaaacactctctactgttaactttccaagaatcatgtaggattcaaactggaaatctaaggaagcttgctttctgaagacttccacatgggctatcaccagcttctaaggtttgcctaacattgagattgtttagttcgccacatgtttattgatggtctactatgttctggcactaacattaggcatacaatatatcgctgcaatagttgaggacattgttcctaatataaaccctaagaggggccgggcacagtgtcttacacctgtaatcccaacactttgggaggctgaggtgggcagatcacttgaggccaggggttcaagaccatggtggccaacatggtgaaactccatctctagtaaaaatacaaaaattagccaggtgtggtggcacacacctgcaatcccagctactcaggagctgaggcagaagaatcacttgaacccaggaggtggaggttgcagtgagccaagatcacgtcactgcactccagcctgggtgatggagtaagactctatcacaaaaaataaataaataataaataaataaataaaataaaccctcaggaatctgagttatgcagcaataaagtagggggtactttgagcccctaaggatggagatgcctcttccttttctggaaaactgaccactaactccaccatgttttacggagcacatacaatgtcatttaaaacaataataaaacgaataatcctggagacagatgtgaggcctgaaagcatttcccaaccctcagctgctcaaagtccattgtgtatcaaaaccactgccttataaataccctcagttctcttccatctgcccccagcaatgctaacttgctcatctccgccctctgcctcccctagggcctgtatctgaaaggttgtgcattgctggaggacactcaccaaggcttcccttggaattctaacctgaccccaaacctctaataggcacccatttcctggcactcttgtgtgtccctagtaatttcgtttccttttctcctgtatacttgtttcttatcttcgctctcctcctgaagccactcacacaccctcctgaaatccctgccgtatacttcatggcatccatcccccaagaccaagcccttctgtgtgcctggatcccattccctctctcctccaggaacccttgcctcccagatctctacacacacacacgcacacacccctctctctctacacacacacacactcctctctctacacacacacacacacccctctctacacacacacacacacccctctctacacacatacacacacccctctctctacacacacacacacactcctgcaatgcataccatcacattctttgaaaagcctttcttggccaggcacagtggctcacgcctgtaatcccagcactttgggaagccaaggcgggcggatcacaaggtcaggagattgagaccatcctggctaacacggtgaaacctgcctctactaaaaatacaaaaaattagccgggcatggtggcgggcacctgtagtcccagctactcgggaggctgaggcaggagaatggcatgaaccaggaggtggagcttgcagtgagctgagatagcgccactcactgcattccagcctgggcgacagagcgagactctgtctcaaaaagaaaaaaaaaaaagtaaagcctttcttgaccctattcccctccaggtccaccccagtatcatacccacatacactctctctcactcctgcaatgtgtaccactactttctttgaaaagccttttttttttcttttgagacagagtcttgctgtcaccaggctggagtgcagtggcccaatcttggctcactgcaacctccacttccaggttcaagtgattctcctgcctcagcctcccaagtagctgggattacaggcacatgccaccatgcccagataatttttgtatttttagtagagtcagggtttcaccatgttggccaggttggtcttgaacttctggcctcaagtgatccacctgcctcagcttcccaaagtgctgggattacaggcttgagccactgtgcccagctccatttactatttctttccctgccacccactcctcgctcaaatccaccagggtacccctgtagaactcttaggactttacagagcacagtttaaaaccactgtgtaggcctaactcttccatcctctggatgagaaaactgaggcccagggagggtatgaacgtgctgaaggttacacagcttgtgaacggcagtcagggcgtaattccagagcttgattccaagcttagatttgttcagttagggatccccactgtagtcaagagggtagccaagggcagcaggtcatcggttcagccagagtgctaggctaaatgctctctttatttgattttgtttgaaaggttcagtcgctaaaaacagtgcttggctgtcattatctaaaatccttatcataaaaattaatagacaaaaataaattattttttaaaaattatttttaaaaaaccaggggctgggaatggtggctcactcctgtaattccagcacttttgggaggccaaggcaggccaatcaccggaagccaggagttcaagatcagcctggccaatgtggtgaaaccccatctctactaaaaatacaaaaattagccaggcatcatggtgggtgcctgtaatcccagctactcgggaggctgaggcaggagaattgcttgaacccgggaagcggaggttgcagtgagccaagattgtagcactgcactccagcctggatgacaagaacaagactctatctccaaaaaaaaaaaaaagagccaggtacagtgtctcacacctgtaatcccaactattcgggaggctgattcaagagggtctcttgaggctaggaattcaagatcagcttggataacttagttagaccccgtcactacaaaattagttaaataaaagatgaaaggaaattacttttggcctggtgcactggctcattcctgtaaaactaacactttgggaggcggaggcaggaagattgcttaagcccaggagtttgggaccaggctgggcaacaaaatgagactgtcactacaaaaaaaaattaaaaattagctgggtatagtggtgcacacctgtagtcccagcaacttgggaggatttttttttttttttttgagatggagtctccctctcttgcccaggctggagtgcagtggcatgatctcggctcactgcaacctctgcctcctgggttcaagcaattctcctgccttggctgcccaagtagctgggattacaggcacccaccaccaccacacccaggtttcaccatgttgaccaggctggtctagaattcctgacctcagatgatgagaagggaggatcttttgagccctagaactcgaggctatagtgaactatgattgcactattgcactccagtctgggcaactgagtgagaccctgtctcaaaacaaacaagacaaaacaaaaaacaacaacaaaagaaattatttggccgggcatgctggctcatgcctgtaatcccagcactttgggaggcaaggtaggcggattgcttgagcttagaagttagagaacagctagggcaacacggtgaagccccatctctacaaaaaatatgaaaaattagctgagtatggtgttgcatgcctgtagtcctagctactcaggaagcagaggtggggggatcacttaagcccaagagtaaaggccacagtgagccaagatcgcgccagggcaatgagagcgagactgtgtctcaaaacaaaaaacaaacttttttttttctagacagggtcttactctgttgccccggctggagtacagtggcacgatctcggctcactgcaacctctgcctcccaggctcaagcgattcttatgcctcagcctcccacgtagctgggattgcaggtatacaccaccacatcctgttaattattgtatttttagtagagatagggttttgccatgttggccaggatggtctccaactcctggcttcaagtgatccacctgcctcggcctcccaaagtgctaggattataggagtgaaccactgtgcccagactaaaaacattttttttttttgagacagagtctcgctctgtcacccaggctggagggcagtggcacgatctcagctcactgcaagctccacctcctgggttcacgccattctcctgcctcagtctcccaaggagctgggactacaggcaccagccaccacgcccagctaattttttgtatttttagtagagatggggtttcaccatgttagccaggatggtttcgatctcctgacctcgtgatccacccgtctcagcctcccaaagtgctgggattacaggcgtgagccactgtgcccggcctaaaaacattatttttaaaaaaattaaagacatcctgctgggtgaaaagaataaacatcatgatcatggttatcatcattataatgtctattgtgaattgaaatgtagctcatgtttggccctcttggaagggctttatgtaaactcagtttatcctgaggctcacagctattccctgacttgctgaaggccacacaatggtggtggaaagccaggatacacatctagactgtctgagtgcagaacccttgcttttagctattacagcagccccttccttggcctggtgtaaagatgtcacaggcttgaaagtcaagcctttgcacctctcacagggggcagggcatgccccataaactcaggcctctgctgatggggtccctactccaaccttcagtgtatggttcggctcttttctctaacctccttttggacaaacttcttttctgtttctgctggggaccttaatcacttgtccataaactccatgcattttgtccctaaaaatataatttcttatgatcccttctcccaagatgctctgagtcccttgactttatcttcttttaaaatttgaagtatatcaggtgcggtggctcacgcctgtaatcccagtacttcgggaggccgaggtggatggatcatgaggtcaggagttcgagaccagcctgagcaacgtagtgaaaccctgtctccactaaaacaaaaattagccaggcagagcggtgcccgcctataatcccagccactcaggaaactgaggcaggagaatcacttgaatcctggaggcagaggttgcagtgagccaagatcacgccactgcactccagcctgggcgatagtgtgagactccgtctcaaaaaaaaaaaattttttttgagatataattcacatacatgcataaaattcaccattttaatacccttctgtggcttttatttattatttttgagacagggtcttgctctgacacccaggctggagtgcagtggtacaatcatagctccctgcagccccaacctccctgggctcaagtgatcctccggcctcagcctcccaagcagctgggactacaggtgtgtgccaccatgcctcgctaattttttttattttttgtagagacaaggtctcgccatgttgcccaggctggtctcgaactcctgggctcaagcgaacatactgcctcagcctctcaaagtgctggaattacaggtgtgagccagcatgccaaaacaccagtgattttttagtatattcacaaagttaggtgaccatcactactacctaatttcagaacatttccatccccccaaaaagaaaccttctaccttatgacccttcagcagtccctccccactcccattgcccagccccagcaccatctactttctgtctctggatttgcctatgctgagcatttcatatccacggactcaaaatccattggctctctggccctctctcaactgacttctgttgccacctctccaccaaagtgtcttttcatcctgctgccaaatacaataggcacagctaagccaacctcattctccacctctcaactgcattcaatgcaacccatcactctctcactgcaaagctttctcctcttaatttgagaagttcctttcctccgacatctctgaactctcctgcattttctttgcacttgcttctcttccaactgatctctaaatgtttagacctcagccctagcccccttgcagggagctgcattttgtctcacagcctcaaatatcatccctgtgcaatgattctcaaatatttatttctagctctgatttcttcctcgaactgaagacttcacatccaatctcctcctttatgcttacgtctgactgctaatagcttctgaaacattcaaaacatgactcttgatttctctccttcacctccctcacacccattacccatcattatgaaaaataaccaggccgggcatggtggctaatgcctgtaatcccaacactttgggaggtggaggtggaaggatcgcttaaggccaggagtttgaggccaaccttggcaatatgtcaaggacccatctctaccaaaaaaaatttacaataggtaaataaacaaattagccaggcatagtggtacacacctgtagttccagctactcgggaggctgaggcaaaaggattgcctcagcccaggaagtcaaggctctagtgagctatgattgcaccactgcattccagccaagcaacagagtgagaccctgtctcaaaaaaaaaaaaaaaaaaacaaaaacaaacaaacaaaaaaaaaaaaaaacaagagaaaaaggaaattaaaggtagaaaaataaccactacccatgagattgatcaagccaaaaactgaggcctcacctccctgttcactgtctcctttacacaaatcatccacaaatcccccatcagctctacctccaaactatgtcccagggacactcacgtctctccaactctacagccacccccatcacctcagccactaacgtcaccagcctggacaactgccatggccagtctccggcagcagacgcacttctaaaacaaacatcacaccatgccgctccccttctgaaaaggcccagtggcttccaagctcccaccactgccaccgaggcctccttcctacctcacttcccacggctcccttccttgtcctggtgctcttgccaaaaggcctttctttggcctctctggtaggagaagcttattctgctgcaggggccctgtacctgtaggtgcccctgcccagaaggcctttcttgtctctctgccactggctcgaacctcctggtcactctcatgtctgttccagccctgcctagatagagtctcacctcctccccagtcattccaccccattacaggtcttttttcctttacaacacttatcaaaatcctgaccatttatttgctgacttagtgccagcttcgtggggggcggcagggaccttacctgtgtaatgtaaactggagctctgacacctaagagagtgtctggcacccaattgatcctcaatcaatatttgttgaatgaataaatgactgttgttacagagggaaggtcgagggtacgtcattaagtgtggcaaagtgcagaggagaacgtcattgagtgtggcatgaacgctagcacttggggaaaattttagggtttttttgcagacagagtctcactctgttgcccaggctggagtgcaatggcgtgatctccactcactgcaacctccacctcccaaattattctcctgcctcagcctcctgagtagctggggttacaggcgcacaccaccatgtccagctaatttttatattttcagtagagacagggtttgccttgttggtcaggctggtcttgaactcctgacttcaagcaatccacacacctcagcctccaaaagtactcagattacaaacatgagcaccgtgcccagcctcacctggggaaaattaaaggtggtaactgtgcaggtgaacttgagagactcaaatgcttcccaaatctcccagaacatggctgacattgcctctagggtgtacagagggattgtcttaactttcacaggtcatcttaagctcttctgtaccattagaattttttttttgttttttgtttttttcactatgagtatgtattacttttgtaattaaacaatttgatcagaaaaatagatcagttgattattttatctacaggatatttttaaaagtttgctagcagggtgcagtggctcatgcctgtaatcccagcactttgggaggccaaggtgagaggatggcttgagcccaggagttcaagatcagtcttggcaacacagcgagaacctgtctctacaaaaaataaagaatgggctgggcatggtggctcacacctgtaatcccagcactctgggaggccgaggcaggtggatcacgaggtcaggagatcgagaccatcctggctaacatggtgagaccccatctctactaaaaatacaaaaaattagccaggcacattggcaggcgcctgtagtcccagctacttgggaggctgaggcaggagaatggcgtgaacctgggaggcagagcttgcagtgagccgagattgcacaactgcactccagcctgggtgacagagcgagactccatctcaaaaaaaataataaaaaaaaaaatgaataaataaataaataatgagccaggggtggtagtgggtgcctataactccaggtgctcatgtggctgaggtgggaggatcacttaaacccaggagatagaggctgcagtaagccatgatcataccactgcaaaccagcctgtctttaaaaagaaaaagtttgccaattttctctttgacccaaggtgagcacattacagtgattacaagcctgggagtccagtcatttgtaccatgttacacaggcaggagacagagggtctgataaacacctctggggctgaactcatgcagatttcactccacaccactactgactgcccagggaggtgtcagtgctcaccatggatgatgtggagtccaggaggctcacaactttcatctcgatctcgtcctcaccaaagctcttcagcagcttcataacctcactcaccgtcagccacttacaatccacaagctgaatggagacaatataatctcctccccgggctcctgccacctgaaaaagtattgttgaaaataagtcaacgttttgttcactcaaatccttgaatcagtccccattaacaaaataggtatttgcgtaagttcgcatcaagaaagcaaaaattcactttgggtggctgagacgggtagatcacttgaggtcagtagttcaagaccagcctgaacaacacggtgaaacccatctctactaaaaatacaaaaatctgccaggtgtggtggtgggcacctgtagtcctagctacctgggacgctgaggcaggagaattgcttgaacccgggaggcagacattgcagtaagccgaaatcgtgccactgccctccagcctgggtgcaattaaaaaaaaaaaagtcaaaattggccaggcacagtggctcacgcctataatcctagcactctgggaggccaaggcagacagaatacttgaggccaggagtttgagactagcctggccaacatggcaaaaccccgtttctactaaaaatacaaaaattaggccgggccaggtggctcacacttgtaatcccagcactttgggaggctgaggtgggcagatcacaagatcaggagatcaagaccatcctggctaacacggtgaaaccccgtctctactaaaaacacacaaaaaattagccgggcatggtggcacgcacctgtaatcccagctactcagcaggtggaggcaggagaattacttgaacccaggaggtggaggttgcagtgaaccaagatcgcgccactgcactctagcctgggcgacagagcgagactgtgtctcaaaaaacaaaaacaaaaactaaaattagctgagtctggtggcacgtgcctgtaatcccagctactcaggaagctgagacaggagaatcacttgaacccaggaagcagaagctgcagtgagccctgagatcgcgccactgcatgatgacgactcactgcagcctccacctcccaacgtctaaaaaaatactaaaaacaaaataaagacagtaaaaattaatccttttcttttagggaatgtagcacccatgaggcctttcacatcaagtcaggcctttgacgtgggtgaacccgccctaaattcaatcacccagatatctgtatttgctgccaaccaagaaaagcatgtgcttaccaaggcagagcagtaaggatccaggaagtgaacctcaacgggggcgttccctcttaaggtgaaccccaagtccccttcttctgcggtgaagcggttgcttcgaggaggcatccactgcttgttagccaaaaacacagataaggggccctttggaagagagcatcgttaggtgtaggatttgaaggctagatcagacgcttgaaagctaaagggaattttgcctgctgtccttgaagatctcacttggccttgttcagggacaaatgacacatctgggggcatacatgctacagcagtcatgcaagaagctggaaagccatcttctcaaacatacccaatatattttcaataaaattatcttttagacattgtattaattatctttttcttttctttttttttgagacattgtctcactctatcacccaggctagagtgtggtggtgtgatctcggttcactgcagcctctgcctcccgggttcaagtaattctcctgagtagctggaattacaggtgcgaaccaccatgcctggctaatttttgtatttttagcagagatggggtttcaccatgttggccaggctggtctcaaactcctgacctcaggtgatccgcccgcctcagcctcccaaagtgctgggattaaagacgtgagccactgcacccagccaaaattatcttaaataaaatctctaatataaacaatttaagaccaggcatgtcatgcctgtaatcctaagcactttgtgtgaccaaggcagaaggattgcttgaggccagaggtttgagaccagcttgggcaacatagcgggaaccattctctactaaaaacataaaagaattagccaggcatggtggtgcacgcctatggttccatctactcaggctgctgaggcaggaggacttcttgagcccagcagttcgaggcttcagtgaactgattgtgccactgcactccagcctgggtgaaaacagagttagaccctgtctaaaaaaaaaaaaaaaaaaaggaaaaaaatctcaggtcaggcatagtggctcatacctgtaatcccagcactctgggatgcctaggcaggaggatggttggagcccaggagtttgagaccagcctaggcaacatagcaagaccccatctctacaagaaataaaaattagttggacgtggtggtgtttgcctgtagtcccatctactagggtagctaaggtaggaggatcgcttgagcccagaaggttcaggctgcagtgagctatgaccatgccactgtaatccagcctaggtgacacagtgagaccacatctctaaaaaaaattaaaaaatattttaaaaaatttcaaatagacaatacctaaaaactacttttaaaatatgctatggggccgggcacagtggctcaggcctataatcccagcactttgagaggccgaggtgagtggatcactggagcccaggagttcaagatcagcctggccaacatggtgaaaccctgtctctactaaaaatacaaaattagctgagcatagtggcacaggcctgtaatctcgactactcgggaggctgaagctggagaatcacttgaacctgggaggtggaggctgcactgagccgagatcgcaccactgcactccagcctgggcaacagagtgagactctgtctcaaaaaacaaataaataaaaataaatgaataaaataaaatatgctatggtctgaatgtttgtaccctcccaaagtttgtatattaaaacattaaaattttattaatatttattaaaatttaaaatgtatattaaaatcatcaatgtaattattaggaagtggggcctcttgagaggtgattcagtcttggggtggagccctcaagaatgggatacatgcttttaaaacaggcccaagggagctcatcaccttttctgccatgaggacacaggtagaaggccccacctataaaccagaacatgggccttcagcagataccaaatctgccaataccttggtcttggacttcccagcctccagaactgagaaatatatttctactgttcataagccacccagtttgaggcattttgttatagcagcccacatggactaagacaccatactcaccaaagtgaagagctgtccctttaggtcatttatgtagagagctttcaacataccagcttctagaagaagtccgtgactgtcagcttggagaactggggtaatataatgtcaacctcttgctcagttttagctagaatagaggattagaaatgggaggataaatgtttctgtaattgaaagtgatccttatagcccggtgttgtggctcacgcctgtaatcccagcactttgggaggccgaggcaggtggatcaatgaggccagaagttcaagaccagtctggccagcatggtgaaaccccgtctctattaaaaatacaaaaattagccaggtatggtggcaggcgactgtaatccgagttacttgggaggctgaggcaggagaatcacttgaacccaggaggcagaggttgcagtgagttgaagtcttgccactgcactccagcctggtgacagagtaagactccagggggggaaaaaagaaagtgatccttgggaaggagacagtacagaactttctcttagtcacacatccttcccctcggtttagacaagtagtacaagaagatggaacacagctcaacccccgacctaggttgaactctaccttccatttgggtacctcctgtgagccataggaggtataactcattcctgagctgggaccaaggagtgataaccagacacattcccatggggtttcctgatatttaaggggcttagtgggcttctctggcactcataaaaccctaatgaggaggctgggcacgggggctaatgcttgtaatcccagcactttgggaggccgcggtgggaggatcatctgaggtcaagagttcaagaccagcctggccaacatgatgaaaccccatctctactaaaaatacaaaaaattagccaggcgtggtggcacgcacctgtagtaccagctacttgggaggctgaggcttgaaccagggaggcagaggttgcagtgagctgagatcacaccactgcactccagcctgggtgacaagagcaaaacgacctctcaaaaacaaacaaacaaacaaaaaacctattgagaagtcatctatgtttcaagtattattgttatggaagttccatgcctcactggacacagtcctgggatattgagctttctgttttcaacattattactattttgagacagggtgtcgctctgtcgcgcaagctggagtgcagtggtgcgatcacagctctcttgcagcttgacctcctggactcaaatgattctcctgcctcagcctcccgagtagctggaactataggtatgcaccaccacacctgatgaattttttttaaattttttgtagagatggggtctcactatgttgcccaggctggtctcaaactcctgagctcaagtaatcctcctgcctcggcctcccaaagtgctgagattagaggtttgagccaccgtgcttgaccttttcattattaatgtggtatgaggatttcccagtgaaaaggaggtttggcaaatcataaccattgacagctacatacccccaccagcatcttcacagcaggctcggactacccttaacataaggctggtcaatttctaacaaaggatcccagggcaggctgattctacacgagaacaaatagcataaaaagtgtatctaggccaggtgtggtggcttactctggtaatcccagcactttgggaggccaaggcaggcggatcacttgaggtcaggagttcgagaccagcctggccaacatggtgaaaccccatctttactaaaaatccaaaaattagttgggcgtggtggtgggcgcttgtaatcccagctcctcgggaggctgaggcagaagaatcacttgaacccgggaagcagaggttgcagtgagccgagatcatgccactgcactccagcctgggcaacagagcgagactccatctcaaaaagaaaagagaactccagggcgaaataagcacctcggtccctgccctgtgcagccctccctgtgccaagcacacagcgagggctcgctcaacccccacaggccaggcgtactctttccgcggcacaggcacccccacagagggaacacagtctaggttactcaccaacaacactgggggcgtggatcaggttcagcaggtcatcatcctcctggtgctgggcgtacgtgagccgggagcgttcctgtgcggcacacagcaccttctgtagcacctcaatgctccgcagcttcttgcagaggctggcctcccgcactgactcctcgtgatgagccatggctctgtgcaggtgggacttccccgcagatggaagccagcacccacgtgacctgcagatccaccaagcagagcataagggcccaaggggcagcccaagaggttggacgttctcttttctaaagaatctgcctggatagctagagcccgtgataccctaccttgttttaacctgagtgactctctcctagcagagagagccggacagactccattttagtttcttcacttgcagccccctttatcccccttaagggaataactagtgtaagctgactccaagcacatccaggaacgcaaactgctgataagatactgaggcaggctgtaccagcagctcctggggatgtgctcagtggcaggtacctaaagcccctgcatttatctctcagtgatagtttaagcccctgcacctggaactgtttattttttgtaactgcttctataaccaattactttttttaacttcttgcctattctgcttctgtaaaattgcttcagttaaacccccctcccctatttagaccatagtataaaagaaaatctagccccttcttcaggcccgagagaatttcgagcattagccgtctctcagttgccggctaataaatgactcctgaattagtctcaaagtgtggcgtttctctacaactcgcttggttacaacaagccttttattaaaatattattttatttcattttatattttatatttagagacagggtctcactttgtttcgcatgctggagtacagtggtgcaatcatggcttaccacagcctcaaactcctgggctcaactgaaattcccacttctgactcttgagtagctgggaccacaggcatgcaccaccacacttggataatgttttcattatcattatcatttcattatcattgctatgttgcccaggctggtctcaaactcctggcctcaagcaatccacctgccttagcctcccagagtgctgggatgacagacgtgagtcaccacgcccagcccaagcctcccttaaatgcatatgtaataagctcacttgtgtccataagatgttcactcaacaaatatttaccaaatgtgttaggcactagagataaagcaacgagtaaacaaactgcccccacattcatggagtttacatgtagtgattgaagacagataactaacaagacaagaaatatgtaatggatggggtggtgatgaggttatagagaaaaataaagcagggtaagcagagatggtaggagaagactgggaatggggttgtcctatgatgggtgaccaagaaaggctttttttttttttttcttgagacggagtctcactctgtcacccaggctggaatgcagtggcacgatcttggctcactgcaacctccgcctcccaggttcaagcgactctcccacctcagcctcccaagtagctgggattacaggcacacaccaccacatctggctaagtgtatttttggtagagacggggtttctccatgtcgcccaggctggtctcaaactcctgacttcaagctatcctcccacctcagcctcccaaagtgctgggattgcaggcatgagccaccacacccagccaaggaaggctttgtgatatggtctttgtgagcagagccctgatggatgtgaaagagcagcaggtgcgagggccctggagcaggggcacgcacaggtgttcaagggcaaggagaagctaaggtgtgcctggaggcagggagggcgggacagaatgagtgcagggaaggagcaaggccagatcatggcggatctcacgcgtgcaagataagggctctcactcctgttctgcttgagatgggagcccactggggtgtgagcaggagactgatgtgatctggcctgcatgaccagactctgaaggggcagcaagaaaaccagctatgagcagggcaagccacgtgaccgctctgggtctcagtttcctcagctgtaaaatggggatgccatgagacccacctcatagtgttgcgtggggtttaagtgagtaaatgtttcttacataagcactgtacacatgtggcttccaccagggcagcagggttaaagtggccagatttgagtgtgtcttctaggtacagccaaagggatttgctaatcaaatgtagggtgagaaagtaagacaagaggttaggtgtggtggctcgtgcctgtaaacccagctctttgggagacagaggcaggaggatcgctggaggccaggagttcaaaaccagcctgggcaacatagtgagacggcatctctacaaaaacctttttacaatattagccgggcatggtggtgcatgcctatagtcccatctactcagcaggctgaggcaggaggatcacttgaagccaggagttcgaggctgcactgagctgtgattgcactactgcactgcagcctgggggacagcaagacgctgtcaaagaaagcaaatgaaagaaaaggaaagaggaaaggagggaagaagggtagatggggaggagagaaagagagaaagaaagaaagaataaaggagaggaaaggaaagggaaagaaaaggaaagcaacaaggaacaagaaaaggggaggagaggggaggggatgaggggagaggggaggggatgaggggagaggggaagggtgaggggagaggaggaaggatgagaggagaggggaggggagaggaggagaaaggggagtgaaggggaggtgggagaggggaggagaggagaggaggggaaggatgggaagggaggggaggggagaaagggaagggaggggaggagagggaggaggggaggagaggagagggaggaggggaggagaggggaggggaggagaggggggaggagagggaggaggagaggagagggaggacagaggagagaggagagggaggacggtggagagaggagagcaggggaggggagaagagaggggagagaaggggagaggaggggaggggagggtaacagaggggagggaagaggaggggagagaacgggacaggaggggaggggaggggagcagaggggagaggaggggaaagaggaggaaagaaaagaagagtggagagtgagtccaaggtttctggcctgagcacctagaggggtgggagttgccatcactgagacggggaagctgcgtatgtgtgcgtgggggcagattagggtggtggaggtgaggtctgcacatgggaagagatagtcacactgagacatggcagagaccaaaccaggacacttcattaccagtcattaggtgttcttggtaattcagccatgcataaagaaatcaacaaacgtttccttccctgttagcatgatacaggccaccctatggaccccaagggagatggttaaagtcctggctccacagtgggaggcctgggtgctatggaacccatgagaacacagcctgggaagccctctgaggctcaggactgcacctcatgacttctgaacccaaagtggccacgatgacttggaacacccccctctcccaggccctcttcagggacctctctgtggctgtctgtgagcaggatcagctgggcacaaagtgggacccacatgtggatgcagagggacacacacccagctgtcggcgctgctgatcattcttcagtgtggccaagggtgtcagcccctctggcatgtggtcgtagagctgggacaggcacttctcctggtggtccagatccatgcctggcttcactgcaaagagaaccacaggttaaatcccctctcatggatctggccacagacccacatagagatttctctttctaccatgtctctagtttcctttcttctgcagtttcacaaggcatttgggatcctcgctctcctttctgcccctggacacaccccaggcagtctgaccctcaagctttttttttctttgagacggtctcactctgtcactcaggttggagtgtggtctcactctgtcaccaggctggagtgcaatggcacaatcatagttcactgcagccttgaactcctgggctcaagtgatcctcccacctcagcctcctgagtagttaggactacagacatgcaccaccacatgccaggccaatttttaaatttttttgtaaagatgaggtcttgctacattgcccaggctggtctcaaacccctgggttcaaatgatcctcctgccttagcctcccaaattgctgggatcaaatgtgtgagccaccatgcctggctaccccgaagctcttgctcattggaaccagtcatgctccagaggttcagaattttttttttttttgagatggagttttgctctgtcgcccaggcttgggtgcagtggggtgatcttggctcactgcaacctccacctcccgggttcaagtgattctcctgcctcagcctcccgagtagctgggattacaggcacgtgccactatgcccagctaatttttctatttttagtagagacggggtttcagcatcttggccaggctggtctcgaactcctgacctcatgatccacccagctcggcctcccaaagtgctgggattgtaggtgtgaaccaccacacccggtgaggttcataatttgaccctgagcccccacacgctacctcctctgactcacccaccacacagaacctcctagcatagcccagaccctgtcatgcctggcctgcacccctctgcaggcctgcacccctctgcaggcctgcacacctgcagcacagccccttcctgcttcaaccacaccctccctggtgcatatcctgctctcaaacctcacaaaaccactctccacttccccagcaccctcggcctctattcctgtgctcagacactttactccctctaggctgaccctgccctcctgtgcagatggaaaagttgaactcaaatgtcaccgcctctgagaagccatcaatgactgcaccatggagtccaccttctgctgcatttgtgtctctgcagcaatcaccaaggcactatatggtatttctatttgtttccacatcttgtctcacctaatagactgtatagtactaggagtggtggctcacactttcagagaacctacagcatataaagcattattgagctttgcatacaggcccttcattttcatgacagcctgtgaggtagagtctctccatatacccattttacagatgagaaaatcgaggcagaggacagctaagtaacttgcccaaggtaatacagctcattcatggcagagctgagatatgaacccaggaagtctggctccagaggctgtctttttaattcctcaggaggctgcctggattagtactcattagatcaaaaatccctggccaggcaccgtggctcatgcctgtaatgccaacactttggggaggccaaggcaggacaattgcttgaggccaggagtttgaaaccaacctaggcaacatagtgagactccatctctacaaaaaaaatttttttcaattaactggtgtagtgtcatgtgcctgtagtcccaggtattcaggaggctgaagtaggaggatcgcttgagcccaggagttcaagaaggcagtgagccatgatcataccactgcactccagccccaccccaaaaaataaattaaattaaattaaattaaattaaattaaattaaattctgatcatcacagattttttttgcattaatttttattttattattatttgtttttttgagatggagtcttgctctgctgtccaggctggagtgcggtggcacaatctcggctcactgcaacctccacctccccggcccaagccattctcctgcctcagtcaccagagtagctgggattagaggcacacgccatgcccggctaattttcgtattttcagtagagacagagtttcaccttgttggccaggctggtctcgaactcctgacctcaaatgatctgcctgccttggccttccaaagtgctgggattacaggcgtgagccactgtacccggcctgcattaatttggattcttttaaaatattaccttaaaatgttacctatcttgatgccagcatttttggcattcccttagattctagattccaggtgaaaattcatcctcttgcacacaggcagaattaaaggtgcctcctcttcctctctctaaagaagcttataacccctaaccccaccatggcctgtgcagcagctgcctcagtcatgggtcattctcatcctctgccttcagcctgtgagcatctccagggaaggcagttagctctcgctcagctcagaatcacccctggggcagctggaccacagccctggccaaacccctgaaccccacaggccttaccctggtggtcaatgaggaggatggcagtgaagtagtgggccagcgccgtgtagtggtgggccttcacgcaggccaagctggcccaggagtaggggatgttctctttcaccagcgcctggctcatggctgcgtgcagctgttggtagacctctcccacctgaaatagaaggggcattgggaaggggcagcccggcacaagggccctcatgaacccatttgcagagaaagagccctttcttcttctcatgcaacagcccctgccaggggctgctccagaatctgggagcaactccaagcaacccctcattctgtcactgtcacagttaacagggggatcaggctgctgtcattatgctggtttttaggttaagctgcacatggaatcagtgatccgtatctgaaacaccaacacttgccaagaaaactcaagccagcagtactggccggagctggcacaatgcccaggtcacaggcaagctcccgtgggaaggccccgctacttccagtgctcctgtgccagcatttaccgcccactccccaaagtcacaggaaccagggagtcttaccttggcagcctcctgagccaccttcaccagcatgaagaattcattccggatcccaggaaggctgattttctcaaacacgctttcttgggcttgtgtaagcatcattttgacaagcacgctgagcatggcagggctcatgtcgtaacttggagtatgggtaaatgtctctttcaggtagtttaaaacccctaaaagtggaaaatgttttgcccattagttcgggtttacatttacttcatcacgttgctgtagagaaagataggaggccaggtgcggtggctcatgcccataatcccaacactttgggaggccaaagcgagcagatcacttgcatcaggaatttaagaccagtgtgggcaacatggtgaaaccctgtctctacaaaaaatacaaaaattagctgggtgtgatggcgtgcacctatagtctcagctcctctggaggctgaggcaggaggattgcttgagcccaggagacagaggttgcagtgagctgatatctcaccactgcactccagactccgtctcaaaaaaaaaaaaaaaaaaaaaaaaaggaaagataggagaaaaaaaaaagaaccagtgtcctacaacatattaaaaagtttgattctcaattatatggtccagcaattccactcttatgatatatatccccaaacagttgaaagtgggggcttaaatgatacttgaacacctgtgttaatagcaacattattcacaagagctgaaaagtggaaaccacccagacatccatgagcagatgaatgattaaacacaatgtggcctatccatacaatggaatatttttcagccttaaaaaggaatgaaattctgacatatggtacagtgtaaataagggcattatgctaagtgaaacaagccagtcacaaaaggaccaatattgtaggattccatttagataaggtacccggaatagtcaaattcacagaaacagaaaggagaatagaggttagctggggctgggaaagggggcaatgggaagttattgcttaactgagtaagtacagagctttgcttatccatcatccagatggaaaagttccggagatagctggtcacaggggctgctgcctataatcccagctacaagggaggctgaggtgggagggttgcttgacattaagagttcaagaccagcctgggcaacatactgagacccctgtctcttaaaaaaatatatactttttaaaaatgtatttattttatttatttttgagacaagatcacactctgttgcccagactggagtgcagtggcacgatcatgactcactgcagcctcaaactcctgggctcaagaggtcctcccacctcagtctcctgaagagctgggactacagccatgcaccaccccacacccagctaattttaaaattttttgtacagatggggtgtgcctatgttgcccagactggtctccaactcttggattcaagtgatcctcctgactcagcatcctaaagtactgagattacaggtgtgagccaccttgcctaaccaacaaaaaaaatttttaacttccggagatgtttagtggtaatggctgcacaacactatgaatgtacaaatgcacttaatgccattgaactgcacacttcaaaatggttaaaatgtgcttctggttggcagataattttaaaattttaaaaatttaagataatcattaaaatggtaattttatgttctgtgttattttactataataaaaaactggttaaaatagtccattttaagttatatatgtatattttaacactatttatttatttatttataaataagcgcccaggctggagtgcagtggcatgatttcagctcaccgaaacctctgcctcccaggttcaagcgatccccctgcctcagccccccaagtagcagggattacaggtgcccaccaccacacctagctaatttttgtatttttagtacagacggggtttcaccatgttggccagactggtcttgaactcctgacctcaggtgatctgcctgcctcagccacccaaagtgctgggataacaggtgtgagccaccccacccagccttttaacccaattttttaaaattggattgtcttccaaaacacttacatctctattgagtagagaaaccagcctgctccccacaactcctgtgtcacctgggacaaaattccatcatgacaggtatggagatgcaagcagacagcaggcagaaggactgaggggctcacaggcggccaggctcacacataagatctgagtcattcagcagtccagggcttttcccctggacctcaagaaagatctattctggccaggtgcggtggctcatgcctctaatcccagcactttgggaggccgaggcgggtggatcacctgaggtcaggttcaagaccagcctggccaacatggcaaaaccctgcctctactaaaattataaaaattagccaggcatgatggtacacacctataatcccagctactcaggaggctgaggtaggagaatcacttgaacccgggaagcggaggctgcaatgagccgagatctcaccactgcactccaacctgggtgacagagtgagattccatctcaaaaaaaaaaaaaaaaaaactcaatccgtctgctccaatggaaattttcatgctgcagccttccactgacttctttatagtttagaaaattaactgtccaaagcgctaactgacaatcaatctggaactgaaatagagtctctcatatgaatcccatccaactgggtcctctggttttgttgctgagcaaaaaaaaaaaaaaaaaaaaaaaaaaaaaatccccaccctgtggagggatggcacctgctgttttgagctgtgagctccgtgggggttccctcaccctccccactgttctcccacttgcttcatttcatctataatttgtctccactgctataatctcagtgacaggacacagagtgcctgcctaagattccccagaaagatgagtccagaaaaaagatttacaacaaaagaaatcaactcatacttggaatcttagcatatcgcttcatcccaagagaccaatctttcatttttttaattaattaattattttttgagacaggttcttgctctgtcgcccaggctggagtgcaatggcacgatcttggcttaccacaaccttggctgatccttccatctcagcctcccaagtagctgagactacaggcatgcaccaccaggcccagctaatttttgtactttttgtagagatggagttttgccttgttgcccaggctgatctcaaattcctgagctccagcaatccacccacctcagcctcctaaagtgctgggattacaggcatgagccaccatgcctggcctatttcttgaattaaaaaaaaaattctttttgacaatcatagctcactgcagcctcaaactcctgggcttaagtgatcctcctgtcttagcctctggagtagctagaactatgggcgtacaccaccatgcctggctaattttaaatattttgtagagacagggtcttcctgtgtggcccaggctggtaggaccaatcattgtaacatcagaaatttcacaatgagttgaagtggcaaagctctggttcttcacaagcttgcagggcaaagtgatatcaaacaatgatccacatgggtggaaggggatcacaccccaaagcagaatgtcgatgatcaacctagaaggcaacacactatagagctagtgtggagaacacactgtggtctacactgtgccctgctcttgcatccatccccacggggagtctgacccagacacaggccctgctatgggggagcaaggcagaacccgtaggcaagggtgagccgtgccaggctcacccacagcactgggtctggtgaccccggtcctctacaggtgtaagcactaggttgcttttctcctcgaccccgcacctcgttctcatactaggattacctgaggtcaggagtttgagaccagcctggccaacagggcaaaacctcatctctactaaaaatacaaaaattagccgggcatggtggcagacgcctgtaatcccagctacttgggaggctgaggcagaagagttgcttgaacccagcaggcagaggtcgcagtgagcagagattgtgccactgcactccaggctgggtgacaagagcaagactctatctcaaaataaacaaataaataaaataaaataacaaaagacagttcccagaagaagggaactgagctatgagacatcctttgaatgcatcacttgaccaagggttgagaacacccacctcatgctggagaagttggcagaatgcaggtgacataaaggcatggaggggcagggtgcggtggctcaccctgtaatcccagcattttgggaggctgaggcaggcggaacacctgaggtcaggaattcgagaccagcctggccaggatggtgagaccccatctccactaaaaatacaaaaattagccgggcgtggtagcgagtgcctgtaatcccagctactcaggaggctgaggcaggagaatcgcttgaaactgggaggtttcaagcagtgagccaacattgcgccactgcactccagcctgggcgacaagggcaaaactccatctcataaataaataaataaataaataaataaataaataaataaaggcacggagagtaatatgcacagatagggtacacctaatacaagaaaaagaagcctacagtttcactatttgggaaaagttattctgctcttcatgacagtgttgaaagaaacagttatgcactgccatcccagggccacttgtctggaaaagatcaatcatcagccacaggattcaccatgtacatcagccatcccagactgaggtctgaaccaccaagcaagtttcttttttttttttttgagatggagtctggctctgtcgcccaggctggagtgcagtggcgcgatctcggctcactgcaagctccgcctcccgggttcatgccattctcctgcctcagcctcccgagtagctgggaatacaggtgcccgccaccaggcccagctaattttgtgaatttttagtagagatggggtttcaccatgttagccaggatggtctcgatctcctgaccttcgtgatccacctgcctcagcctcccaaagtgctgggattacaggcatgagccaccgcgcccggccagagcaagtttcttaatgggaagttacaccagagctgaagactggtctggcccttgcaggggacgacctgtagaccctcttcagtggggggtcccctggtgccaccaggcggggccaaggctctgtccagtcagccctggaggagacatacctgcagctctctgaaaggcatctatggcactctgcagcccagcctgcatctgccaatagcgccacgtcccaatctgggtgtagagggccccagtgttgaacaggacactggccttctccagcagcaggttctgctggctgaccagaaccccattgagggagtcatacctatgtgaaagaaatgcattcagggagtacagattacttggctagttaatgctacttttggatgcaagtggaaaaaattattattattattttatttatttattttttttgagacagagtctcactctgtcgcccaggctggagtgcagtggcgtgatctcggctcactgcaagctctgcctcccaggttcacgccattctcctgcctcagcctcccaagtagctgggactataggcacccgccaccacgcccagctaattttttgtatttttagtagagacagggtttcaccgttttagccaggatggtctcgatctcctgacctcatgatccgcccacctcagcctcccaaagtgctgggattacaggcgtgagccactgtgcctggctctattattatttttttaagagtcaggatctcactctgttgcccaggctggagtgcagtggtgtgatcatagcttactgcagcctccaactttagggctcaattgatcctcccacctcagcctcatgagaatagctgggattacaggtgcatgccaccatacctgcctaatttttttttttaatttttgtagagatggggtctcactatgttacccaaactgctgttaaactcctgggttggctgggtgtggtggctcacacctgtaatcccagcactttgggaggctaaggcgggtggatcacctgaagtcaggagttcgagaccagcctggccaagatggtgaaacccagtctccactaaaaatacaaaaattagccaggcatggtggcaggcacctgtaatcccagctactcaggaggctgaggcgggagaattgcttgaacccgagaggtggaggttacagtgagatgagattgcaccgctgtgctccagcctgggtgacaataacaacaacaacaaactcatttcttcaataaaattcaagaatgcacatgcactgaggcttttgtttccaagcaagatgacaggactaatcgcactgaccgccacagccacacacacaaatatctgatggggtaactttataaacacagcatgggacatccagacaatggactattactcagtactaaaaatggagccttttcaagcaagccttgaaaagatgcagaggaaacattactaagagccaacctgaacgttgctacctactgtatagcacgctgtgtgagtccaacattctgaaaagccaaaaacccgggagacagaagaaagatcaggggttgccaggacttagggggagggagggaggaacggcagagcacacggaggatttttccagcagtgaaactcttctgtacgacactgcaaagatggatcactgtcactctatgttggccaaaagctgcagaatacacaagtacaagaatgaaccctaatgggaactatggactctgggtgataatgatgtgtcaggtaagttcctcaattataaaaaaaaaaaaaaaatgcgccaggtgcgatggctcatgcctgtaatcccagcactttgggagcccgaggcaggcagatcacaaggccagggattgagaccagcctggccaacgtggtgaaaccccatctctactaaaaatacaaaaattagccaggcgtggtggggcacacctgtagtcccagctactcaggaggctgaggcagaagaatcacttgaacccaggaggcggaggttgcagtgagccgagatcacgccactgtcctccagcctaggcaacagagcaagactccgtctcaaaaaaaaaaaaaaaaaaaaaagggccaggtgcagtggcttacacttgtaatcccagcactttagaggccaaggcaggtggatggcttgagctcaggagtttgagaccagcctgggcaacatagtgaaacccctctctaccaaaaatacatggtggtggcatgtgcctttaagcccagctacttgggaggctgaggtgggaagatggcttgatactgggaggcagaagttgaagtgagctgagatcacaccaccacactccagcctgggcgacagagtgagactccgtctcaaaaaaaaaaaaaaaagaaaagtgtgtgtgtatatatatatagcttctcctaaatgaaatatggcaattactaacccctcataattctttctgaaatctaaaacctcaggatttgttttacttgtttattttttcagaccaagtctcactctgttgcctaggctggagtgcagtggcatgatcatgactcactgcagcctcaacctcctgggcttaagcgatcctctcatctgatcctcccaaggagatgggactacaggcatgtgccacccatgcctggcacattttctctaattgttttgtagagatggggtctcactgtgttgcctagactggtctcaaactcctgggctcaagtgatccaccaacctcggcctcccaacatgctgggattccagatgtgaaccaccacacccagcctaggacttgtattatttatttattttttttttaatttttattttttgagacaaagttttgctctttcacccaggctggagtgcagtggcgccatctcagctcactgcagcttctgcttcccgggttcaagcaatggtcctgcctcagcctcctgagtggctgggattacaggcgcccaccaccacacccggctaatttttgtatttttagtagagacatgtttgtcaggctggtctcgaactcccgacctcaggtgatccacccacctcggcctcccaaagtgctaggattacaggtgtgagccaccgcacctggccctaggacttgttttaaagtttactcatgaaccaaggggtgtgcagacagcttctccctaattcatgactaaggagaaaccacctttcaccatgcagacagcctggtgcattgttaggaaaagtcatccccctttcctttgctttcaatgaggaaggcatcagtagccaaccatcggctatagaaacattcaattctgatatgccccgaccttctaggatgtactctcctttcactgacactcctaaaaacactcagagaaggggtgcagcatctccaaagtactttttttttaggttgttggtgtttttttttttttttaatacagactctcactctgttgcccaggctggagttcagtggtgcaatcttggctcactgcaacctctgcctcccaggttcaagtgattttcctgcctcagcctcccaagtagctgggactacaggcacgcacaaccatgcccagctaatttttgtattttttagtagaagcagggtttcaccatattggacaggctggcctcgaactcctgacctcgtgatccacctgcctcggcctctcaaagtgctgggattacaggtgtgaaccaccacactcagcctttttttttcttttttgaaacagggtttcactcctatcacccaggctgcagtgcggtggtgtgatctaggctcactgcaacctctgcctcccaggctcaagtgattctcttgcctcagcctcacgagtacctgggactacaggtgcataccatcgtacccagcaaatttttgtattgtttgtagatatggggttttgccacattgcccaggctggtctcaaactcctggggtcaagtgatctgcttgcctcagcctcccaaagtgttggcattataggtgtgaaaaccactgtacccgggctcccaagtatttaaagtatactaatctttgaaaacaccaattgggtctacggccataccaccctgacgtgcctgatcttgtctgaaaataccaattgtggagaagaatcaaatcctctacttccattttttaaatctgatccaagctgagtgtgtagctcatgcctatagtcccagctactcaggaggctgaggcagaaatatcacctgagcccaggaattcaagactaacctgggcaacacagtgagatcccatttcaaaagaaacctgatctatttctgtttggtgcttttgtctcactggacaagacctgattttctctctctctctctctctctctctcactcactcacacatacacatgcatgccccagtccaatctgagacaagaatcttgcttctgactaattccatttcagagccctgtgcttccccagtgatacaacaagcaagaaaaatgtctcctctccttggctcacctgttctgagaagcaagaggccacagtctgttggggccatctccctcggatcaccttcataaataaataccaatgtattgatatctttctagacttccctggataaatgcaagataggaaagggggctgaggtgcacaggggtgcaccccggataaatgcaagataggaaaaggggctgaggtgcccgcagaggggcgtctgtgatgctgaggctccgaaactgtggctgccataacacgtgaagcaccagcgcagacctcaagcacctaccaggtgaacaggagtcccatctgccgcgtgggtgggaagaatcaattctcaacaaagcccagctggatgaagtatgtcatcagcagttccaccctggcctcatcccggctgggcgtccgacaagcctgcgaggaaaagaaccccagagggcatgagcagaggaggacacagctgacagcccttcccggaaggtgccctgcacataccagcaggtgcctgtaactatttctgcagtatgacgacctcactgctggcatcataaactctaggaggggtggaaagaacctggcaggaagtcagaaatcctggaatccagtcccagccctgccaggaggcaggtctctccccttctatggttttcctttttttttttggggacggagtcttgctctgtcacccaagctggagtgcagtggtgcgatcttggctcactgtaacttccacctaccaggttcaagtgattctcctgcctcagcctcccgagtagctgggattacaggcgtgtagcaccatgcccggcttgtttttgtatttttagtagaaacggggttttgcgatgttagccagtctggtctcaaacttctgacctcaggtgatccacccgcttcagcctcccaaagtgctggaattaccagcatgcaccaccacgcccagctaatttttgaatttttagtagagacggggtttcaccatgttggccaggatggtctggaactcctgatctcaggtgattctcctgcctccgcctcccaaagtgctgggattacataggcgtgaaccaccgtgcccggcctccttctacagttttcttatgcagcaaatggaatggatgattccagcaccccccaaccatcacctcaatctacccacgattctgttaagaccacaagcatgcaataatggggttccccgaagacttggaaaaactaccctcccctctctgctgcacacaaaaacttacttgtctcggatccataagatctgtgatttcatcttcatataaatagccatcttcactgtaatgttccaggataaaatccttaaagaaaaataaggttagatactataaaatgtgattgaaaaccatgtatgtgcataacagtaatatgtcatttgtgacctgtttctaaaaaggcagaataaagaaaaacttacagtgattttcaaagtgggggaatttattttcttaatttatgtagttttttttatatggagtcttgctctgtagcccaggctggagtgcagtggcacaatctcggctcactgcaacctctgcctcccaggttcatgcaattctccttcctcagcctctcaaggagctggggttacaggtgcccaccacaacgtctggctaattgttgtacttctgacctcaggtgatccacccacctcaccctcccaaagtgctgggattacagatgtcagccacagtgtccggccatagaattttttttttttttttttaaaacagggtttcactcccattgtccaggctagaatgttgcgatctcgggtcactgcaacctccacctcccaggctcaagtgattctcatgcctcagcctcccaagtagctgggattacaggcatgtgccaccatgcccagctaatttttgtatttttagtagagatggagtttcaccgcattgcccaggctggtctcaaactcctgggctcaagcaatccatctgcctcagcctcccaaagtgctgggattacaggtgtgagccactgcaccccatgcctatgtttttaaatgctgtgttgcttcagtaaaagtgagagttgaagttaattttttgcttaaaaatgtctttgtgtctgcgcatcatggctcacatctgtaatcccagcactttgtgaagacagggcaggtaaatcacttgagcccaggagtttgagactagtctatggcctatacattcaactatactgcaaacactgcagatattcaggggctcagacttgcaattctgggcctccctcaggacccagacaagtttcccagcacagaccctgagggtaggactgtcataacagtccccagatacaggtttcctttgccaagaagacccttaaccatgttataaaggcattttattttattttatctttgaggcagggtctcacttggttgcctaggctggagtgcagtggtgcgatcgcggctcaccgcagcctcgacttctctgggctcaagtaatcctcctacttcagcctcccaagtagctgggaccacaggcacgtgccacaggctaatttcatttctgtattttttaatagagatggggttttgccctgttgccccacccccgcccctacaagtgctggctcccccaagctgcaagaaaggtgatcacatagatggctcaattatgtcttcccaagtgactgtgtaacctctttacacaacttctacattaaagctcctcctgtttttgtgtgttcaacgtacacacacacaaacacttgtcttacaaaaatggatttgtactaaatatacaactttgctgtgccttctttttctaagagatgagggtctcgctctgtcatccaggatggagtgcaatggtgcaatcatagctcactgcagccttgaactcccgggctcaagtcatcctcccacttcagcttctccagtagaggggactataggtgtgcaccatcacactcagctaatattgttatttttcataaagacagagtcttcctatgttgcctaggctggtctcggactcctggcctcaggtgatcctcccacctcagcttcccagagtgttggaattacaggtatgagcaactgcgctcagctgactatgcctcttttctttaaacttggccatgggctgggtatggtggctcacacctgtaatcccagcgctttgggaggctgaggtaggtagatcacttgaggtcaggtgttccagaccagcctggccaacatggtgaaaccctgtctccattaaaaatttaaaaaataaaaaataaaatagctgggcatggtggttaaaaggggtcaggtgtagtgactcatgcctgtgatcccagcactttgggaggccaaggtgggagaatcacttgagaccaggagtttgagaccagcatggacaacatagtgaaaccccatctctacaaataataaaaaattagccaggcgtgctgaggcaggaggaggatcacttgagcccgggaagttgaggctgcagtgagccatgatcacgtcactgcactccaatcttatgttcacctcataaaagtcaaagaggattttgattaaattatatatgtgatcctgaatttgaaacttagtaaactagggtagattaacgtacttagtgggataaaaaaaattatctaactggccaggcacagtggctcacccctgtaatctcagcactttgggaggccgaggcaggtggatcatttgaggccaggagttcgagaccagcctggccaacgtggtgaaaccccatctctactaaaaatacaaaaattagccaggcatgatggcaggtgcctgtaatcccagctactcaggaggctgaggcaggagaatagcttgagcccaggaggcggaggttgcagtgagctgagactgagccattgcactccagcctgggcgacagagcgagactccgtctcaaaaaaaaaaaaaaaaaaaaaaaaaaaaaaaaaatcctaactgaaacccactgtaaacattagggacaaaacaagaatttctaccatcactgttattacttagcctaattccaaacattctctagcccacacattaagaaaaataagagacataaaatactggaaagaaacaatcaaaataattttttgcaacacaacagcatgtttataaaacccaatagcatcaactgaaacattactaaattaataagaattcaataaagtggcaaagaagttagcacatgaaagtcaatagtaaaaaagaaaagtcaatattcttcctttcttatacaagcaataaccaattagacaaacttaacagacagccaggtgtggtggctcatcacatctgtaatcccagcagttttcaaggctgaggtaggcagatcatttgaggtcaggagtttgcgaccagcctgaccagcaaggtgaaaccctgtctctactaaaaatacaaaaaattaggtgggtatggtggcaggtgcctctaatcccagctacccaggaggctgaggcaggagaatcacttggacctggggggcagaggttgcagtgagccaagactgcaccactgtactccagcctgggcgacacagtgagactctgtctcaaaaacaaacaaacaaacaaaaaaaacctaacagagaaacaatacctttcaaaatagcaacaaaaatacatttctagggataaaattaatataattaagcagaaaactattaaactttactgaagaacagatgtgatttcattttctttcattgattcgatttttttttttttttttaatgagacaaggtatcattctgttttccaggatggactgcaggggctcaatcacagctgactgcagcctcgacctcttgggctcaagcaagccacctcagcctcctaagtagctgggactaaaggtgtgagccactgtgcctggccctatttcctcaaaataaaacaaaatcagccagctgcagtggctcacgcctgtaatcccaacactttgggaagctgaggcgggtggatcacttgaggtcaggagttcgagaacagcctggtcaacatggtgaaaccctgtctctactaaaaatataaaaattagctgggtgtggtggcggatgcctgtaatccctggtactcaggaggctgaagcaagagaatcgcttgaacctgggagagggaggttgcagtgagccaagactgtgccactgcactccggcctgggcttcagagcgagactccctctctaaataaataaatacataaaataaaataaaacaaaatcacactgtgaagcttcactgattattaaaaatatcacacggacacacaagtcagatttgaaatggaattgccctaattcagtctgctgaaccacttctgcagtacctgtgtttctctcaaatatggaagggaaaaaatacaacagaaagcccctcaaacgttctcattttcatatgactgacatttgtagcgtctcttttaggctaaaatgacatggttggaagcctgtgccgaatggcagttggccatgtccacaacatgtgaatattttcatttgctttaatgtggaattcagaacatgacccagttgaatccttaaaaatgcctataaaattcctaagtttctccaagagactcttcctttaaaatgcttgcattcttggccggacgcagtggctcacacctgtaatcccagcactttgggaggttgaggcaggcggatcatctgaggtcaggacttcaagaccagcctggccaacatggtgaaaccctgtctctgctaataaaaattagctgggtgtggtgacacatgcctgtaatcccagctacttgtgaaactgaagcaggagaatcacttgaacccaggaggcagaggttgcagtgagctgagatcatgccattggactccagcctgggcaacaagagtgaaactccatctcaaaaaaaaaaaatgcttacattcttgtagcccagcaccatgcaacagacaaattaaatcgtaaagaaacttctacaatagcaacagacatttccagacacgtggattgttttgagtcccacagaccagtggcaagtcacatctatttttgcatttatatatacacacatatattttaaataaaaatagagatggggctgggtgtggtggctcacatctatgatctcagcacttttgctggaggtggaagcaggaagatcgcttatggccaggagttcaagaccagcctgggcatcatagtgaggagaacccatctcttaaaaaagaaaaaaaaaagagagagagagaaagagatgactgcgtggtggttgacacctgtaatcccagtactttggaaggccaaggtgggcagatcacctgaggtcaggagttcaagaccagcctggccaggatggtgaaaatctgtctctactaaaaatacaaaaattagcctggcgcagtggctcacacctctaatcccagcactctgagaggccgaggcaggtggatcatgatgtcaggagttcaagaccagcctggccaggatggtgaaaccctgtctctactaaaaataccaaaattagccagcatggtggtgggtgcctgaaaccccagctactcaggaggctgaggcagagaattgcttgaacctgggaggtggagtttgcagtgagccgagatcacgccactgtactccagcctgggcgacagagcgaggcttcatctcaaaaaatatacatatatacacacaaaaattagttggccatggtggtgcatgcctgtagtcccagctgctcaggaggctgaggaaggagaatcacttgaacccagaaggtggaggttacagtgagctgagatcgcaccattgcactccagcctgggcaacacagtgagactgtgtctcaaaaaaaaaaaaaaaaaagagagagagagagagggaaggcctcattctgttgcccaggctggtctccaactcctggcctcaagctgtcctcttgcctcagcctcccaaagtgctaagattataggcgtgagccattgcatctgggcataagtctcacgtaaaagttcaggcaggctgtggcagtgtggcataaagctgcaattcctggattgttttcattgctttctacccagaacataaactttccggtaaacttgagtcctgaaacactcagaataccaacttcccttctccagttccaaaataaaccccaaactcacaggatttaaacaaggcagcagtaaaaaaggcctctatttatgtcaaacaactcaccgtctctgagaatgaaggtcaagtgcttccaaagtattaaccaattgcttttaaaagtagtagttggctgggagcggtggctcacacctgtaatcccagcactttgggaggccaaggcgggtggatcgagttcgagaccagcctggccaacatagtgaaaccccatctctactaaaaacacaaattagccaggcatgatggcaggtgcctgtaatcccacctactcaggaggctgaggcaggagaatcacttgaacctgggaggtggaggttgcagtgagctgagatggccatcactgccctccagcctgggcaacaagagcgaaactccagctcaaaaaaaaaaaaaaagaaagaaagaaagaaaaaaaaaagtaacagtcaaaatgtcataagatgttttcttttctaaactaaaagtagtccaagatgagccaactaagaggattatcatggaaagtaaaataagccaggcacagtggctcatgcctataatcccagcattttggaaggctgaggcaggaggactgcttgaacccaggagtttgagaccagcctgggcaacagtgggaaactctgtctctatgaaaaatacaaaaattggccgggcatggtggctcacgcctataatcccagcactttggaaggccaaggcaggtggatcacctgtggtcaggagttcgagacccacctgaccaacatggagaaaccccgtctctattaaaaatacataattagccaggcatggtggcacatgcctgtaatcccagctactcggaaggctgaggcaggagaatcgcttgaacccgggaggtggaggttgcggtgagccgagatcatgccattgcactccagcctgggcaacaagagctaaactccatctcaataaaaaagaaagaaaaatgcaacaattagccaggcacggtggcacacgcctgtagtaccagctactcaggaggctgaagtgggagcatcaactgagcccaggaggcaggggttgcagtgagccaagatcatgccactgcatgccagcctgggtgaaacagtgagactcggtctcaaaataataaagaaaaaggaaaaaaaagaacacaaaatatttcttcgaagcaattttcgcaatgctaggattaattcctataaccaatgcctgggctgcatgatgcaatcttgggccaccctgcacctcatcccctttcccctccttgatggaatttggaggtgactggttaaaaactcaaattgatggagttgaagagggaaggaagaggagggtattccaggcacaggacggtctcccggccccagcctccgggcacggtatctcctgtgttctccattgaagcaccccttccacttcccacttgaatcccccactgacccaagggccccgcaggcagtgcttgtggcacctctggcacccagcacagtgccaggcacaggtgggcttatgaggatctgccaaatgggagaggagtccagatacccaggaatgtggcagggggacacacaagcaaagactctggttattcaaatatttaaggggagtgaattgacatctttgatttcctttgaaattgcatcacaaataagacagattgatattagccattactttcgttctcttttttttttttttttttttgagacagtttcactgttgcccaggctggagtgcagtggcacaatctcagctcactgcatcctctgcctcctgggttcaagcgcctctctcgtgcctcagcctctcgagtaactgggattacagtcatatgccactatgcccagctaatttttttttttttagatgggatctcactctgtcgcccaggctggagggcagtggcgtgatctcggctccctgcaacctccacctctacctcccgggtttgaacgattcacctgcctcagcctctgaagtaactgggattacaggtgtgcaccaccacgtccagctaatttctgtacgtttggtagagacaggggttttaccattttagccaggctggtcttcaactcctgagctcaagtgagccgcctgcttcagcctcccaaagtgctgggattacaggcgtgagccactgtgcccagcctttagccattactttcaatggcaaaaactgcaattaccttcaaaccaacctaacagacacaagaatgcacagatggacaaatatgtcaggaagcaatgctggcagtatgttctcggaagaagtgagtacacaggggtttgctataaaattcttaaaattttttgaaaagtttggaaattttcataatcaaatgttagagaaaaaactttagctattcttccaaagacataacctaaactggatacatgacttaagaaacaaatacactattaataaaagaggatgtaagttttaaatttgaaagcatatccactacagaccctttgacttggcctctcagggaaggccctcctgggtttccaacctgccttgtccaagacccaggaggagcttcagaagccatcaaaggcaacaacaaaaatatggcaggaataaacatatcaattatgcatgtagctggctgagaagggcctcagggtcactctgtagatatcaactgactctgcctgttgagcctaaggccattgcaagggatacatattttctctatatccatttttttgcttttttttttggagacagggtctcattctgttgcccaggctggagtgcagttgtatgatcacaactcactgcagcctccaattcctgggctcaagcgatcctcttgcctcagcctcccaagtaactgggactacaggcatgcgccactgcaaatggcctatttccattttaaacactgagtccagtgcccatggctttgagatttaccttgaggatgactgaaaagtcgatgtctttcgtttccttcaggccaagaggaatcaggggaaccgtaaatgcctccctatgaggaacacaacaaggtatgtatgaacacccccaaccggacccttgtgcatgccacagccttgccctcagcagcccagctcaggtgtgtgccccctccttgccccatccagtactcacctggctgacaggctcattttccataaggatgactctagtcatgccccaccctctgctctaaaactgaccctgctccctaagactgctggaccaccctgcctaacacatcaggcccctggcatcttgacactgatttatctcccggtttcaatgcctaaatggttcctttcttattttatttttttttgagagactcttgttctgtcgcccaggctggagtgcaatggcgcaatctcagctcactgtagcctccgcctctcaggttcaagcaattctcctgcctcagccccctgagtaactgggattacaggcacaggacaccacacccagctaatttttgtatatttttttagtagcaatggggtttcaccatgttgaccacgttggccaggctggtcttctgacctcaagtgattcgtccaccttggcttcccaatgtgctgggatgatggatacaagcctctgtgcccagctcaatctcaatgcttcttttggcagctgtgctgagagtctattgtgtgccagggcctgtgcatggtgcacttgctgctcccacctgggtgcaccaccctgctgccctgcgcctcctttgtcagctcctcaccccctcctcctctgctcccctcagcgggccccacagctgtggcagctctccaacaccctcacattcacaactctgggttcgtaggggcctcttctttgggaagtgtctaggcgtcccaccaccagcacagaagatgccatcagggcaggagccccatccgacaccgaagtgcacctgcctcccagcccagggtcagacaccctccacctcctctcccccagctgaccactctgtaaccacaggtcgcctggggagtgctccctgagcctacattcctaggggcagggacagcaggaagtgaacggagctcaggctgtgttttgcaaacagggattcagctccctgacctgtaacaggagacctccttgggctgctcagcccagccccacaagaaggccaggaaggctgggcagggcgaggggacaatgcagctgtaagctgaacctggctctgcagcacagccatgctacggccaggtgagacccatcctgggggcatggaaagccgaattctgctgaaggctcctccaggctacgcagggtgggaagccaggtttgtggctgtccaggcaacaacaagaggaggagcgactgtcctgagtcccaactccagggcaccccagccccagtgtggcactgacagcaccctctaggtgccctccggcttccctgagttttcccatgagggagggaaataacctcatgcaccatgagggagggaaataacctcatgcaccatgaggttatttctttcccgcctacctcctagaagactgtaaagatcaaccatgctaagaaagaaacagtctaccttgaaaaaagaatagtgcaggccaggcgcagtggctcacgcctataatcccatcactttaggtggctgaaacaggcagatcacgtgaggtcaggagttcaagaccaacctggccaacatggtaaaaccccgtctctactaaaaatacaaaaactacctgggcatggtggtgtgcgcctgtaatcccagctactcaggaggctgaggcaagagaatcacttcaaccaggaggtggaggtagcagtgagccaagattacaccactgcactccatgcctgggtgacagagcaagactccgtctcagaaaaaaaaaaaaaaaaaaaaaaaaaaaaaaaaagatcaaccatactaagaaagaaacaatctactttgaaaacagggccgggcatggtggctcacgcccataatcccagcactttgggaggccgaggcaggcggatcacgaggtcaggagattgagaccatcctggctaatggtgaaaccccgtctctactaaaaatacaaaaaattagccgggcaaggtggcgggcgcctttagtcccagctactcgggaggctgaggcaggaggatggtgtgaacccggtaggcggagcttgcagtgagctgagatcacgccactgcactcctgcctgggtgacagagcaagactccgtctcaaaaaaaaagaaaaagaaaaaaaaagaaaacagaaaagcgcaggacccaaatgcatggtgccgtgttgaatctgcacagctctccctcttcccagtgacacagggcagtgactggccactctagagcccagggaccactccagagatcttcggttcactctgtgggaagccctgtgttgcacatccccactcttcggcacagcaaatgagagtgtgggacagccgacatttattaccaaaccttggccccatctcgcctcctccagaacttgaaccttttggacaaacactgtaattgaacaccagagcataggctgggagaaccttccattagctgtcacactgactgggtgttcaaaactgcacagtaggccaggtgtggtggctcacgcctgtaaacctagcactttgggaggctgaggccggcagatcacaaggtcaggagctcgagaccagcctggccaacatggtgaaaccccatctctactaaaaatacaaaaaattagctgggcatggtggcatgcgcctgtagtcccagctactcaggaggctgaggcaggaggattgcttgaacctgggaggcggaggttgtggtgagccgagatcatgccactgtactccagcctgggtaacagagagagactccatctcaaaaaacaaacaaacaaacaaacaataaaaaccgtacaggagcccacaggtaagccaggcacggggtatcacaaagggaagagccagcgagctttcacacactgacacttcccctccagctctgaaaccaccctggtgccctgtggaggaccagcaccaggaaacacacattccataggtgacttaaggttcccaaatccagggagctattttccgactgagtttaccctggggcccacctactttttgagaagtctcatgcccctactaaaaaagcacgtaaacccttctttgaactgtctcaaagttatttctccttaaaaagaagcatttcacttagggttttgttttgtttttgtgttttttgagacaggacttctttctgttgccattactgcagtctcgacctccctggctcaagtgatcttcccacctcagccttctgagtagctgggactacaggtgtacaccaccatgcccggctaattttcctattttttgtagagatggggtttcactatgttgcccaggctggccttgaactcctgggctcaagcaatcccccatctcagcctcctgaagagctggattacagacatgaggcaagaggggcatttctttcatagttagatctccatttttggagatgcattgcaattctgagggatggtgttgttggctttcatcttgcagaaatcaattccaaaattgagttatggagaatgatacgatagagtgccttcaaaactgacctaggagccaggcacagtggctcacatctgtaatcccagcactttgggaggccaaggcgggcagattacttgagaccaggagttcaagaccagcctggccaacatgatgaaaccctgtctctactaaaaaaaaaaaaaaaaaaaaaaaaattagccaggtgtgatggtgcacgcctgtaatcccagctactcaggtggctgaggcacaagaatcgcttgaacccagaaggtggagattgcagtgagctgagatctcgccactgcactcccacctgggtgagagagggagactctgtgtcaaaaaaaaaaacaggaaatacaaccttaaaaggagactggtgtgttactttgttttaatttggatttttctgtttcagtttgtcacctccagctaggaaacagactgcagtccagcatctaagtacagtgcacagaatctctgtgtgtgcatagtggcctccccttacagggtcaattttggcctttggccttaatcccgaagtatttgtgtatgctttctgttccttggcaaataaatgagaaaataattagccaacattggaaaggtattgtcctaacaatgtccctttaatgtttcttaggaaaattatgatgacccactaaaatatccttgctcaatgtctgttcagttgaatttaataacatatcttgctaatgtttgcatgtctatgaaatgtgactacgcggaattactgaaacttaactataaaatccaaggcatctaacttttaaacttatcttggttcatcacgtatatttacactagattttatactgtcttcatttgtttttttttgtctgtttgttttgagacagagtcttgctctgtcagccgggctggagtacagtagtgtgatctcggctcactgaaacgtccaactcccgggttcaagcaattctgcctcagcctctgagaagccaggattacaagtgtgcaccaccacatctggctatttttatttttagtagagacggggtttcatcatgttggccagactggtctcgaactcctgacctcaggtgatccacccgcctcagcctcccaaagtgttgggattacaggagtgagccactgtgcctggcctcacaaatgcctttttgtcactgcagatatttcccaacactacagatatttcccaacactgcagatatttcccaagaaatgggctcatcccttccagtctagcacctcactcaaccccaaacctgatggttctctcacttcccaaagctggggctgccacaccccagtctagaaccctatctgccctgtttgtgcagatagggttcgtacccaggtacctcttcataccctggatatatgaaggatctctggctcagaggcttctggaaggtgtgctgctcccacttactctgtgttctgatagatgcccactgagatgttcagcccctccagctcttccttgagcatctgcaggtctgagttgaccaagctcagctccagccgcacttgttcccgcacctttgggttcgcggccactctgttcaaagagaagagggagagaagtgccctcagccaggtatcccggcttctgggtgagcagaaccaatccccagtccctgcagggaggatcagggcacggcttgcagaggagggccaggagtgttgggtaaggtatcccagggacacggagcacctgcccagcttgcagtacacctgccagtacgtggagctgcggacacaggcaatgacactgtgagctgcagacatgaactctatgacatcctgcaaaaactccaccttgagaacagaaaacaaaactgctcccagccatgccctaaaataccataagatatccacttgaaaagaaatgaatgattctggttgggcgtggtggcccacgtctgtaatcccagcactttgggaggccgaggcaggtggatcagctgaagtcaggagttcgagaccagcctggccaacatatagtgaaactctgtctctactgaaaaatacaaaaactagctgggtgtggtggtgcacacctgtagtcccagctatgcagaaggctgaggcttgaacctgggagataggggttgcagtgagctgagattgtgccactgcactccagcctgggcaacagagcaaggctccctctcaaaaaaaaaaaaaaaaaaaaaaagaaatgaatgattcctttcggtaggagaaatccaaataaataaataaataaacataaaatttgttttaaaaaaagaaagaaatggatggttagctgggcatggtgatgcatggctatagtcccaggcaggaggatcgcttgagtccaggaggttgatactgcagtgagctatgatcacaccaccgcaatccagcctgggtgacagggcaagacactgtctctaaaaactaaaataagataaaatgaaataaaatataaatatatatatatatatatatatatatatgataaaaagtaaaataaaataaatgaatgagaaaatgaaggcagaggtaatgcttcctaattcattctgtaagactagtattagcaacccaagcctagcaacatataaataggattatacaccataacaaagtgggatttatcccagaaatgcaaggttggtttaacatctgaaaatcaatataatataatatattatattaacagaataaaggacaaaaaacacatggtgacttcaacagatattgaaaaaactatgtgacaaaatccatcacagattcataataaaaattctcaacaaagtaggaataaaagagaatttatgaaatctgataaaagacacctacaaaaacccacagttaacatcacacttagtggtgaatgactgctttcctcttctcaccacgaacaaggcaaagatgcccacttttgctatttctaatcaatgaggcaaataaagaaattaaaggcatccagattagaaaggaagaaataaaactgtctttatttacagatggcattatcttatatatagaaaatcctaaggcatccataaaacaaatattagtactaataaatttagcaaggtcacagggtataatcaatatacaaaaatcaattcttttttttttttttctctagacagggtatcactctgtcagccaggctggagtgtaatgtcaccattatggcttactacagcctcaacctcccaggctgaagccatcctgcagcctcagcctcccaaggagctgggactacaggtgcacaccaccacactggctgatttttgtatttttttgtagagatggactctcactatgttgcccaggctggcccagaaatcctgggctcaagcaatcttcctgcctcagcctcccaaagtgctgagattacaggcatgagccactgtgcctggccaattcgatttctatatactagcaatgaacaatcttgaaattgagaaaaccattccattcacaatagcatcaaaaagaataaaatactcaggaataaacaaaagaatcacaagacatgtaaactgaaaactacaaaacaatgctgagatatattaaaagaagagctattccatgtttacggatgggaaggctcattattgtcaagatgtcaagcctccttagttggtacattcattcaatgcaacctcaatcaaaatcccactaacctttttaataaaaatcagcaagctgatcttaaaattcatatggaaatgcaaaaaaaaaaaaaacctacagtaggcaaaataattttgaaaaataagaacagagttggaagacatattgattttaaaatttactaagaagctgggctgggcatggtggctcacgtctgtaatcctagcactttgggaggctgaggtgggtagatcacctgaggtcagtagtttgagaccagcctggtcaacacagtgaaaccccatctctactaaaaatacaaaaaatgagccaggcatggtggtagatgcctataatcccagctactcgcgagcctgatgcaggagaatcacttgaacccggaaggcagaggctgcaatgagccaagattgtaccattgcacaccagcatgggcaacaagagcaaaactccatcccaaaaaaataataaaaaataaacaataaacttactaagaagccatagtcatcaagatagcatggtactgacataaagataggcaatgaaacagagtaagagtccaggaataggttgggtgtggtagctcacacctgtaatcccagcactttgggaggccaagacagacgggtcatgaagtcaggagatcgagaccatcctggctgacacggtgaaaccccgtctctactaaaaatacaaaaaaaaatttgtatttttagtagagcgtggtggcgggcatggtggtgagcacctgtagtctcagctactcaagaggctgaggcacaagaatggcgtgaacctaggaggcggagcttgcagtgagctgagatcgcaccactgcactccagcctgggtgacagagcgagactccgtctcaggaaaaaaaaaaaaaaaaaagagtccaggaataaatgtttacatttatgtagcaaatctttacaactgatttgaacaaaagtgccaaatcaattcaatgtggaaaagattattgtttcaacaaatagcgctaaagcaggcagacatccataggtatgtcagggtccctaaaaccacccccaagttcagtgttaatctaggaggacttgcaaaagtcatggctgtggtttactacagcaaaagacacaaagcataatgagcaaagggaaaggcatatggggtgaaattgggaggaggcccggcccaggcttctaggggtcctctcccagtggaatcccacagaccatgcttaactcccccatcaaggagttgtgacaacacacgtaaaatgccaagaaagcccccagaaagttccaatcaggactcaggtcccactgggaggtccctccctagctgacttcttgggctccctcccaaagtgggcagaagggtctgggtgagggacccgagcctggttttcacttccctaagcccgagggtcctcttcctggcacaaggccttgaggaggcttgggaagccagccttcaggtcccgctgttttgttattttgctaaagcatgtcccgtctgtaagtttgccccctcgggtcactttcttcaccttatcagcagggcccatgattccttctgctttccaacaagacgccagagcatatttttagaccaatgaagtcggtgggacagtgggtgggacccagagagtgacggacagtgagtcggcctggagggtgggaaggcgaagtgagttcccctcctgggacggggctgggaggggacatggaatggtctgtcagctatgagtttgtggaaggcagagtcagtgactttcagctgacctgcctcggtctggaagattccagtagagaaagggagggccaggggcctggaggctggttccaggtctgggtgctgggcctgagagcatttccaaagcactgagcctgggactgaaggtaattcaccatgagggttcagctggggaggactgtctgtgtgcttcccccacctcccagtccctcaactcacccccagtccccctacctgccttaactcaggaaaaaggcctccctcgtgagcactggcagctgcctttggaggcatgtcacggtcacaccccaggacacaacgcagaatctcaggctggcaggggacatttgagatcagccagcccagcctctcattttacagctgggaatgggtgcacaacggccatggctgcccaaggtcacagagcccgggagggagcagcaggcacagtggaaaaagtaaggtcacgtgagccaggtctgggcaccgggtccaggcctgccactcccccgcatgtggctcaggtcgatggctcagactctcagcctcaggtccacagctgaagcagtagaggaacagctgttcgaggggctgcctggggaggagcggggctgggtgccctgtgcgcacagcagacacttcatcagccactcaagtaggcagccgagccaggagggccctctgggcacctgggcctctccgtaggaaaaggagcagggacccactatcctttgggtcaacaacggccttaagcaatgggctcgaaaatccctggttagtgaccaccttctgttgctaggcaagatggggacaaagatggggtccagttctccagttgttaaacatctgtctcatcaagaagatgggacagcacatggaaaataaatttctatggttataataactgtcccagattctctgtgcagtaatggcagacccgctttccctctgaaaacaagcaagaattttggataagacaataacaaaattacgttaaaagcatcaaagggctgctaagctagtgggaaacctccaggccaagtttcaggggaaaaccaagaacctagagaggagcgctggggccactgttgcttgtgagcatttgccaacctgacaagttgggcttcgaccttggagggagtaggggggtagacagaggtcaaggtatgaggaggctgataggggattcacccccatatcaagctgggagcctgaaaggcctcacctgggtgaagacagaagcagagataaccctggtccctgccccaaaacaaggaattcattagcattaaaaggagtgggaggaaaaaaggaaaggaaactcacagattcaaccacaaagagccttggatctccggcggacttggacccctcacccatcacacctgggaggcccagggatggtggggcttctgtgcacttggttccaggtggtctgggctgtccatgtgaaagcaaacaccatccttgtgagaaggaacctctgtctttggcctcacggaaaccccacagacacccttccaagggccccaagaagcacacaaagatatccaagtctgaaagggaagaaggcaccatgagtaagaaccagcagacaagctagcagacacccgcacagtctccccatatttttatacaattaccaaacaagacactatggtacatttcaaaccataataggagagatggcccatgttcggtggccaagcatagcacagagctcctcactcctccaggaattccactgaagggtggcaagttctggagttcaagccactggggaggcaacaggagtgcaagtggccacggttcaggcgctgatgggcagaggtggggagggggcgctcccaaggagtccactgggagatgcaggcagggggcttcccaggcagcctcaccagcttcccttcacactgatcccctgtaaacgtgtgtccggcctcgacgtaggaggaacagggagaaactgattttctattcataaaatgtgcgcctctctgcgcctgcgctggcgctgtgcgcctttgcgagggcggagctgcgttctcctcaacacagacccggattgcatcgtgagggcgagctgagttctcctctgcacagacttcagagatacagcgaaggcggagcagtgttctcctcagcacagacccgggcggacgggtgggccgggggcaccgcaagggcggagctgcgttctgctcagcacagacccgggggacacagcgaaggcagagcagcgttctcctcagcacagaccttgggagcactgcatcgctttgggcagaataggtgaatgaatgaatgaatgaatgagtgtaatcacatgccctccctttccctgtttatcaagcctggcatcactttagaatctcttgttagaatttatgacacctaggctttacctcagaacctgagagtggcactcaggtataagcacgtgtttccaagctccccaggtattccatagcacagccaagtttgagacagtggggtctaagaaccatgtagaactaatgagaatcctgaagtgtctgtgataaaggtaataagctttttgtaagattacagaggacatagattaagttggaaagcctgagtgttgagattcctaggctcaggaattttaatttaaccaaagttaaatgtcttaacttgcaaagacatgaatctgtagattccagattaatggcaggtgtgaattgtacaatagaaactgatctagcctacatgtcttcttggactggcagactatgttaatctttttattttatgacaagttcaacattattcccttttgtactgaattttagattactgattttgggcactccaagattttgggagagacctctctcatgagaactttatgtggaacccccacctgcttggctcctgaagttcttgtttctgttgggactgctgggtataaccgtgctgtggactgctggagtttaggagttattctttttatctggtaagaaatattttcattgcttcacagactggtaggaggtgattagatgaagtcacaaatgtgtcttgctctgttgtccaggctggcatgcagtggcttgatcttggctaactgtagcctctgccttctgggtcaagtgatcctcccatctcagcctcctgagtagctgggactacatgcgcacaccaccatgcccagctaatttttctattttttgtagtgatggggttttgccatgttgctcacgctggtcttgaactcctgggctcaagtgatcctcctgcctcggcctcccaaagtgctgggattacaagcatgagccattgtgcccagcctagctcactttttgaccattgatttaaagaaaaatctgacttttcattatgctgaaaaagaaatctttatatctgaatgccactgagaatgccacttgatttcttttcctttctctctctaccaatattaagccttagtgggtatccacctttctctgagcacaggactcaagtgtcactgaaggaccagatcaccagtggaaaacacaacttcattcctaaagtctgggcagaagtctcagagaaaggtatgaatatgaaagggttaagaatttgtggtatgctaaaatgtgtgtgtcctgtggtgggagtttctttccaaattccatggtgttttctcctgtcaattctgttcttattttctatcgttagtttcacaccatttgagaggcactggaaattattaagagcatgcactcaggtcctgggtctgctactacttagctgtgtggccttaggcaagttatttaacctccgtctccaatttctttctgtgtaaagggaccctcaataatccctaccttaaaaggttttttgagggttaggtataatgtaaacaagtgccttgtacctattttactgagcaaaataaatgcatttgtaactttttagttacaaggtttcctttgagtaagcaagcgtgtaaaaactatatgtctttagttaccttgtattttataatttgtcctggcaactttagttccctgaagagaaaatagaaaattaaatgtcaaataacataacataggtaattgtgttaaatgtcagaatatttcaggaataataatgttgtgatatacaggccagcatgcatttgttgcttgctggagtagtcaagttttatttctgacaagtctgcagttccagggagcctctccctggctgagtaactgtcacccatccatctgtagatgtcagggagagtttgctgtgcatcccaattatcttagaattgggtagaagtttagctttaattagtttgaccttgagtctagcaacaagagagggaacaggcagcgaagaggtcgtgactgatgtcccagcaacaggagacagggagtgtcattatcattcctggtcttctcacagtactctgaatacagagagtgaggaagattagggggccctgtctgctgactccctgacgatctcagaccctctctgctctttctggatggtggcctgttaattctggcatactgttactgataatatatttatccttttcactgtgatttgcccaattgttgcttcagctctggaccttgtcaagaagttgttggtagtggatccaaaggcatgttttacaacagaagaagccttaagacactgtggcttcaggtgggtgtgggacagtgcctgctagcataaaatacatgggaagccctgctgcctgagagacatgagacagaggacagaaacatgtttactttgttgaatgtgtttaattgttttagatgtatggggggtatcttggacaggttacaacctgttttttttttttttttttttgagacaggttatcattctgtcaccctggctggagtgcagtggcacaatctcagctcactgcaacctctgcaccctgggttcaagtgattctcctgcctcagcctcccaagtagctgggattaaaggtgcatgctaccacgcccagctactttttgtattttttgtagagatggggtttcgctgtgttggccaggctacaacctttttgatattactcatggctgttggatgtacaagctcactttatgtcctgttctggttccacttggctgccccgagtctccagtttggcctgtgttcttttgagggcttgttctggctctactcccagccatgtccactgctcttcataggtggggtgcattctagccatcttcaaccttaaatcagggaagtgggggagggggaggagggcagcctccctggggagaatccagctatttctcaagcccaagtgactcggtataaagggtcccactgcttgttcattcaggtgagtaaatgtgtccttagtgaaggctgtcacctgcacctttcatctgtgttactgctgtactcctgctaggggttggggctgccattattaaatgctgacctcatttggaactgccaagagttggaagtacgttgtggctttgctgggttaatctttagttttggaattagctacggcattgggcaggtttttctgatagatgtctggtcttctgtaacgagcagttccattcagtacagccatgcccctttctattaattttcttttggtctgtgtattagtctgttctcacactgctataaagaactgcccaagacttggtaatttataaagaaaagaggtttacttgactcacagctccacatggctggggaggcctcaggaaacttacaatcatggtggaaggggtagaaggcatgtcttaatggcagcaggtgagagagcttgtgaaggaagtgaagggcaaagagcctcttatgaaactgtcagatctcatgagaactcactatcatgagaatagcctgggggaaactgcccccatgagccaatcacctctcaacaggtccccttctcaacacctggagattacaatttgagatgagatttgggtagggacacaaagccaaactgtatcaatccgttttctgtggagatgggggacagaactggtagcttgagctagaggctgttacttgagctaaatgctgtttctctggggattactggtccaggaactccttgggcaatccagcctcagccccgtacttctggaactctgggaagactgtccccattctctgttctaatcctctacacctaacagttttgctcaggccagctcaggttgagaacaacaaaaacttaaaaaaaaagacagatatatatatatatatatgtgttttggatgttgccctggaaactatagtctccccagaagaaatctgtcagatgatttagcatttaatagaccacagagatttgaaacagcgggaccctggaggaaaggggtttggaaacaaagggtgcctttgcatgtggggattttaattttgatgagaaagagaaacatgtcttttggctcttttcatgtgtcctaatagggaaactcttgggtctaaatgtagaggtacaggagctgtgttcatctctagcaaaaaaatagagctggcctgttgagcctgggaacagggtttgcatctgcctgaaatttatgagcaagcgtagcctatttttcttgtacttctttgtctcaaagaaaacttattaacaaccaaggagaaggtgaagttcaactccgttgcaggatctccctggaatactcttttagccaccttttgtttttgcagtaaaaggaggaatgagcattgaatgaagacaaggatgaagactgaccatctaaaacatctgttagtgatagtttgggttttattttggggaaattcagtgcttttgcaaaaaccaaatggttttgtgggtctggcgctggactgagtgttgggaatgtggattctggtctctgttttgtcattaacagagtggccagttttgggatcatcccttacatctactctctgcttcatatttactgcctgaaatagaggatttcttctgtttgctttcaagggatattataatttaatttttattttatttattgttggagacaaggtcttcttctgttccctaaactggagtgcactggtgcaattatagctcactgcagcctcgacctcctggccttaagggatcctcccgcctcagcctcataaagtgcttggataataggcatgagccactgttcctagctaatttaatattttggaataattgtagacatcatgaagaaaatcaatgtttatttatttatttccttttttgagatggagtctcgcttttgtctaccaggctggagtgcaatggtgtgatctcagctcactgcgacctccatctctgggttcaagtgattctcctgcatcagcctcccaagtagctgggactacaggtgcctgccaccatgcccagctcatttttgtatttttagtagagatggggtttcaccatgttggtcagactagtctcgaactcctgacctcaggtgatccacccaccttggcctcccacagtgctgggattccaggcatgagccactgtgcctgacctgatgacttggtttaaatataggcctgattaggcttgtgaccactctgtttggcttcactgaagggctgccaagagatggacttttgagagtgacactgcaagataattgagatcctaagtaaagccgtgagagggtggggagaggaatccagatgagcttgctgctgtcaaatggcaatggggagctacactgagaaactcaaaacatggtgaactcaagtgttctgccctgccttggcctcccaaagtgctgggattacaggtgtgagccactgtgcctggtccttctttctttctctttcttcctccttccttccccctcccctctcctccattcctttttcctcccctctttcatcccccctccctttttccttccttgcttctttccttccttccttcctcagggtcttgctgtctcacataggctggagtgcagtggcatgatcactgcaccatgactttcaggctcaagtgatcctcctgccccagcctcccaagtagctgagactacaggtgcatgccaccatgtctggctaatttaatttttttttttttttttggagacagagtcgtactcttttgcccaggctggagtgcagtggtgtgatcctgtcttactgcaacctccgcctctcgagttcaagtgattctcctgcctcagcctcctgagtagctgggattacaggcatgcactaccacgcctggctaattttgtatttttagtagagatggggtttaaccatgttagccaggctgatcttaaacttccgacctcaggtgattcacccaccttggcctcccaaagtgctgggattacaggcgtgagcctccatgcctggcctaatttttaaatttttttgtagtgacaaagtcccagtatgtggcccaggctggtctcaaattcctggcctcaagcaattatcccaccttggcctcccaaagtgctgggattataggcatgagccaccatgcccaacctagtgttgtaaaatttccatatccatcaagttgccaaatggtggaggactttgctgtatcctctccctttccccactgtggtatgcttggctcagtgggaggaggggctggagttgggtgggaaagtacatgaggcactggaatcagataactctgggtctgtattccgcacatgccacctgtgagtggctgagctgggcttctggccagcactcaaaggccacattactagatatagatgttcctttcaccttgctgaagatggggagagctgcaccggaccacctctcagggtttcctaatgcaaatccttgaaccctgcagaagtgagcatccagagaggtgggagctacccgtatacacactgtctgtgccctgctcatctcccgttcctgcagcatgaaacacctgtaatgctttgttctgtttattgtctccctttctcattagacctgaactctgggatactgtgggcttaagtacttctgaaaatttctatggcatctgctgggtgaattttcctagggtgctgggctggttgttaagacagcctgggtgactggcctcattcatggcaggggcagcaggtggagagcggtcctggaaggatttgaggagctgcacggagtgagacccagcccctggcccctgattgtcacctttctcaggatctgggatgctaattcagaaactcttgactgctggaggctgtgattgacccactgagagcttttaggcatgtggatgtgactcagccaggatcgatggagcattgactgctgattggactcctgtgggaaggtagaggggggcaacacataatgccttcactgtgggagcttcatcaaggggatgattcttggacggacatcttttcctccctctttccacagaggcatgctagccctgtcattctaggagtttattatccttcagacacagctacttatgtttttaattccctcacaggatgaagacatgaagagaaagtttcaagatcttctgtgtgaggaaaatgaatccacagctctactccaggttctagcccaggtattcgtattcctgatgatcactaaatgtagtctgggcttaaggagatgataagcaaagatgatgaaattcaagattttcctgagtagcaattgcttaacattgtttcagttataatgtagtagaaactctgtttgaacttgattcactccagcacccttagatttaaaaacgcaggatatgtttaatatctaacacataatagacagataagcacagctagggattgtcatccaaaaggtcacctgcaaggcaatttcgaaagactctattaggggctcaaatataaatttgttggaaaaattaaaatttgggtcagtagttgattccttgattacaagtttattctttaaagttctttgtgagtataagttaattccagtcctactttgttgttgttgttgttgttgaatggtagctgtcctttttcccactgtttcctccccgctgccccgatttttattttcttgagacagagtcttagtctgtcactcgggccagagtgcagtggtgcaatctcagctcactgcaacctctgcctcctgggttcaagcagttctcctgcctcagtctcccgagtgtctgggactacaggtgtccaccactgcgcccagctaatttttgtatttttaggtgagatggggttttgccatgttggtcaggcttgtctcgaacttttgacctgaagcgacctgcccacctcggcttcccaaagtgctgggattacaggcgtgagtcaccgcacccagccttcctcccaattttatatatgggaaaacaactaaggcacaaaggttgtcttcccgcaaaagaccaagacttggggcttcaactgagaggtattatagtccttttaaacttgatatttagaagaggacgatcaagaggaagttggttatgctacttgctttcagtatacatcgttcagaggtcagaagccatagggagagaaatatctattagataagcatgtctgagttgcgggctgtggtgaggactcagttgtcaatgatgacgaccagtaatttttggtactagaatttcacatcaaatgcccccactttactggaagtatattgaggaactttgataatcttaaagaagccagtgattttcttttgaacatttctccattttcctttattttcagccttctactagtcgaaagtggcctcatgaaggggaagccgagggtgccgagaccacaaagcgcccggctgtgtgtgctgctgtgttgtgaactccatggtttgaacatgaaagaaatgtaccttctttcactctgtcatctttcttttctttgagtctgttttttatagtgtgtattttaattatggaaataattgctttttcacagtcactgatgtacaattaaaaacctgatggaacctgggctttgtgcttctgcttgataatcggttctttagttgaatggctttgttatttatttatttgagacggagtctcactctgttgcccaccctgaagtgtagtggtgcaagcttggctcactgcaacctctgcttcccaggttcaagcgattctcgtgcctcagcctcccgagtagctgggattacaggtatgcaccaccatgcccagctaatttttatatttttttgtagagacagggttttgccatgttggccagcctggtcttgaacttctgatctcaggtgatccacctgcctcggtctctcaaagtgctgggattacacacgtgagccactgcgcctagcctgaatggcttttttatatttaaagttgttgtgtgcctttcatctggagctacaccttggctatcactaggcaggtttcccaggatgtcaccctggtctcagcctgtgagagctgaatacaaattctaagggccccttggaaagttccgggaaaaggagcatagcaaggttgggggtggagtttgtagagactggctggctggctgctgacatcttcatgagaacagcaggtaccttggtgcataataacaggccaggttatattctcatccttgccctcataaagatacaggtctacagtctctgaaacctttgggctagataagttgtgaaatttaattacccaattttaggaaggtggtaaggcatatctactatgtgtatgtgtagcacctcagcggagtcctacacatgtggagtcctaccccagtggagaccaaacatgttaatatttccacagcaaatattcacagcaagagggatagagaaagattataggtagttgcatattgattcatatcagtcttttcttccaaatgagctacaatgactcgtttttgagagctgtttgggttttggaagtggagataaggcatggttctgtcttgttgacccaataatgaccagggaagccctgtgcaaagacttacccttggctgctcttgtcctcacagtgattttatgagtgaggtcctctagccactgtcatgtcacaggtgaggaaaccaaagttagaggacgaaggtaacttttctgatgtcacacagctggtaaatggcagagctgggacccaacccaggtctttttgactctaatgttccttattgtccactgaatctgcttttataactttgcttggttgatgctaggacactttgtagctcgctggccatgccatgaattgagtgccgtggttcaatggccactggcgattcagtcagggcagaatcaagggcacacagccatttccttaggaaatggggatgtggttggaaatttctattaaagggtatataagcattctgagacttggctggcctggtgtagggggtttgttgggaatttagttggtttgcatgtttaaaggaataaggctgagattgccctagatgggttttagctcatttgaatatttaatgtggaggctgtggtttcctgggacatttttcccgctgtggagagttagccaccttttctctgtttcttttttctttttttttaatcgagatgaagtcgtatgcttgttgcccaggctggagtgcaatggtgcgatctcggctcactgcaacctccgcctcctgggttcaagcgattctcctgcctcagtctcctgagtagctgggactacaggtgcacaccaccatgcctggctaacttttgtatttttattagagatgagggtttcaccacgttggccaggatggtctcgaactcctgacctcaaatgatctgcctgcctcggcctcccaaagtgctgggattacaggtgtgagacaccacgaccggcaaaattttttaagatacatttcagtaagctaaggttaatttattgaagaaaagctttaaaaatttttggtgtagcctaagcatatggtgtttataaagtctacagtagtgtacagtaaggtcctatgccttcacactcactgactcaccacagcatcttccagtcctgcaagctcctttcatggtaagtgccctatacaggagtaccattttaaaatctcttatactctattcttactgtaccttctctatgttcaggtacacaagtacttacattgtgttacaactgcttatagtatattcagtaaagtatcaggctgtacaggtgtgtagcctaggagcaataggctacaccatacagcctaggtgtgtagtagactgtacaaggctatacaaggtttgtgtaaatgcactttgctgtttgcacaatgatgcaatcacctaaggaggcatttctcagaaccatcccgtgattaagagaggcatgatcgtacagtcatcatctccctgaaagctcagtcagccctgtgcagtgctactgccacactccccttttgcacatgtagaaatcaaggatctttggctcctctgagtgacttgttccaggtttctcagttttcaagagatggaggtgggactcgaattgagatttccctttcttgagaacctgtggtccttaaccattaaaaccacttaagaggtcttctctctcgatcactacctactaagtgctaggcgcggtgctgaggcgttctcttgattattatattgagtctttagatttaggagaaacaggccgagcgcgctgactcacgcctgtaatctcagcactttgggaggccgaggcaggaggatcatgaggtcaggagatggagaccatcctggctaacactgtgaaaccccatctctactaaaaatacaaaaattagcaggcgtggtggtgggcgcctgtagtctcagctgctcgggagactgaggcaggagaatggcgtgaacccgggaggcggagcttgcagtgagccgagatcacgccacagcactccagcctgggtgacagagcgagactgtctcaaaaaaaaaaaaaaaagatttaggagaaacaagtcccgaagccctgaccctaacacgcaagggttagtggagatgtgggacttgaactcagcttctccgttgagtctggctgtcaccgggacgcaggcacgtgcttgcacacctccacggtggcgatcccacccccttagtagcgtccttagctcggcacttcttgcggggaagttcttcttggcccagaccctcgtcctaggccccgcgccatgggggaagtgaaaggggcagtgtggggaaatggccgagaggtcgggtcaggggtggtctgcagagaggcaggcggcggtgctgagtcgggaaccgcgcgctcacccgcccagtcggacggttccggcgcgggtgggtgagacactgggaacagcggccagctgcagagggcccgaggccgggcgcgcgggagcggggcgcgtcgaacgcgcgcgtgcgcggttcgtgtgtgggcctgcgggggcgtgcgcggttggggggcagtgagggtcgccgcggcggcgcgcagcacggcgggaacatggcgcgcggaaccggcgcacgcgcctagctggtgggaccgttagctcgaggcggacgcggcccggaccccgtggatatggagcagtggccgccgccggcgcccgagccggcccaagggccgacccccgcaaggagctgaaggcggcgggagaccgagtcggcgccggtgagtgcgtgagggactcgggccgggagactttctttgtcaaactccggcggtgggagccgggccgggcctcagcgactgaggagcgcctgcgaggcggagggtgtctcgcagtccgggttcgatcccagccgcgagccgtcaggcgacaggacatggtcggccgcctgcctgcctcagtttccgcgagagtgtgtgtgggtgtgtgtgggtgtgtatgggtgttggcctgcacacaccgggggtggggggttcggtatacagtcggcgcctaatgcgcgcggtgcctcccccctccccccagtccccgtggggcggaagctggggactggagtccaccagagcagtaggcggcacccgcggggagacaggtgtcggcgcagcccgggaggatcaggtgctacctctcccgggtggggtttgtgaggagtgagctcttcgtccccagtggcgagcaagtctgtcggtggctcatcacagagcactgttttggaaagcgttccacccacctcagcttcgtgctgtgtttgggccactagtcagggggaaggatgctgagcgacatggactttagaggtggggctcccgctggacgggatggctctgggctctcgagcttacccccacccttgtctcctaaacccgttagagtgtaggaatcattgggagcacctgataaaaatgccacggattgtggctcaccaaagcagggaagccgatttggaacttaaacaagctcccaagttgtgatcagtcgagcttggcaagcactgttttagagagtaggcttcctgcaagcaggagctgtttttgtgtatacctcaccatggcatcttggtacctggcatggtgcctggcacacggtagatgatcagaaaatatctgtagaaagtctaaattattagggagagtgcaacataggagttcttgagacattttcaggagcttcttgagattaatatctgtcagatttgttttacagtatatgatttttctcagctcccaacttttgtgattgtttttaatgccatgttttcagtatgttctaggcaaaagcagggtatatgttgcttagtatacactatccactaggccgggtgcggtggctcactcctgtaatctcagcactttgggaggcagattgcttgagcccagaggcttgaggctgtagtgagccaaggagttagagacaggtgtgggaaacatagcgagactcgtctccgcaaaaattagctgggtgtggtagcgtgcacttgcagtcccagctaccctggaggctgaggtgggaggatcgcttgagctcaggaagtacaagttgcagtgagccaaggttgtgccactgcattccagtctggataatacagcgaaacccagtctcttaaataagtaaataaatacataaatgattatgtatactccagctaggttaaaattaattctaaatcaaaattctaaattaaaatatgcatatttctttctcttcatcatttgagaacactaggcttttaggatttcattccgttggggcaggtaaatatctacatttttgacaaagcaaatatgaattactgttaattcaagaaaggtgggaatttgcttaaacctgagtatttgtagtctgtgatttttttaaattttaaatgtaaattttctttttttttttctttttttttgagatggagtctcactctgtcgtccaggctggagtgcagtagcacaatctcaggtcactacaacctccacctcccgaattcaagcgattcccctgcctcagcctctggtgtagctggcattacaagtgtgtgccaccatgcccagcgaatttatgtatttttagtagagaggaggtttcactatgttgcccaggctggtcccaaactccttgacctcaagtgatctgcccaccttggcctcccaaagtgctgggattacaggcatgagccatggcacctggccttatttttatttttttgagacagaatctcaggctgccacccaggttggagtgctgtggcatgatctccactcactgcaccctccacctcccagattccagtgattctaatgcctcagcttcctgagtagctggggttactagacccggctaatttttgttgtatttttttagtagggactgggtttccctatgttggccaggctgctctggaactcctggcctctagtgatccacctgcctcgtcctcccaaagtgctggaattacaggcatgagctactgctcccagccaatctttgtgacattttgaaattgaggtttatattttgttcagagtcaaagctaaaatagaattgtttgaaaattaatatttcaggaactgttttttaattaagttgaattttattttattagtttcatttcagtagggttttaacttaaaaaatatataaatatatgtgtgtgtgtgtgtgtataaatatatatatatatatatatatatatatttttttttttttttttttttcccctgacacggagtcttgctctgtcacccaggctggagtgcaatggcatgatcttggcctcactgcagcctccaccctcccagctcaagcaattcttctgccttagcctcccgagtagctgggactacaggtgcctgccaccacacccagctaatttttatatttttagtagagatggggtttcaccatgttgtccaggctggttttgaactcctgatctcaaatgatctgccctccttggcctcccaaagtgctgggattacaggcgtgaaccactgtgcctggcctaaaaaatatttttaaagacaggatctagctgtgttgcctcagctggtcttgaactcccagtcttggcctcaagtgatccttctgcctcagccttctgagtagctggaagcacagctgtgagccaccacacctggcttttttttatttctaataaaaaattaatagagtgtcttgtttcactggacaaaatacgcatatataggaaggaaagacttttggacttgagattgcgctgaagaagaaaaatggaaaaattaggcattttagtctctcagtatgttatttttgtagcttatacagatatgtctttttaaagtgtctttaaaaagctttattgagataaagataaatgagataaattcacctaccatgaaatcaaccccttgagtgcagaattttgtggtttataatatattcacagaatcgcacaaacaagacaggtatctagatactttcagaccattttcatcagtccacaagaaatcccatacccattagcagtcatccttattcccttttcccctagtccctggcaataactagcctactttctgtctctgagtttagctcttctggaggtttcacagaatgaaatcttactacatatggtcttttgtgattgacttatttcacttggcacagtgttttcaaggtttatccatgctgtagcgtatatcagcacttcattcttttttaatgctgagtaatcttttgaatggatataccatattttattagttcctctgttgataggcacttgagttttttttccaatttttggctattatgaacaatgctgctatgaacatttgtgtacaaattttagtgtggatgtatattttcatttcccttgggtatatccctaaggaatagactatctgggtcatatgataattgtttaagactacaggcacgtgccaccacacctggcaaatgtttaaaaattttttgtagataaagggtctcgctgtgttgcccaggctgatcttgaactcctggcctcaagagatcctctcacctcagcctcccagaaagtgttgggattacagatgtgagtcactgcacctataaaagaggctcatacctctttttacatattttttttgagacagggtttcactctgttgcccaggctggagtgcagtggtgggatcacagctcactgcagcctggacctccctccatatgattctagctgtgggtgtctttcctgtagtttttattatgttgtggtatgtttcttctgtacccgtttctttgaggattaatagcatgaaggatgttgaatttcaccaaatgctttttcagtttcagttgacatgatcatactgtttttgtcatttatttgattgatatgatgtatcacattgtatgttgagtgacccttgcatcccagggatacatcgcacttgatcatgatgaattatctttttaatgtattactgaatttgattcactggtattttgttgaggatttttgcatcaatatttgaaatactggcctgtagtttccttctttgatgcctttgtctgattttggtagcacagtaataatggtctcatagaataagtttggaagtattccctcctgtttttcaaaatagtttgagtaggattcgtactaggtctttaaattgtttgttgtgaagccatcagcagtgaagacatcagttcctgggcttttctttactgggagactttttctgatggcttcaatctcatttcttgttaccaatctgttttggtcttggatgttttcattattcaacctaagtaggtgtatacaacctaagtaggtgtattcctagatgtatgcatctaggaatttgccaatttctactaggctttccaatttattggcatataatagccagttatgatcctttgaatttctgaagtattagttgtaatgtctccttttttttaatctgttgattttatttatttgaatcttttctcttttttcttagttagcctggttaaaagtttgtcaattttgtttagctttccagaaaaccaacttttcatttaatcatatgtgttttttatttcaattttatttctgctatgatcttatttattttcttattttcggtttagtttgtttttactttaatagttctttaagatgtattgtttatttaaagtttttcttttgtttggatggtaggcacttatagctgtaaatctctgcctttgtactgctttctgcataacaagttttggtatactgtgttttcattaccctttgtttcatgaaatttttgaatttctgtcttagtatcttcattgacccactagtcatttattcaggagggtagtgtttaacttccatgtgattgtattgtttccaaaattactcttcttattgatacctagttttattcctttgtagtcaaagaagatggccacggagacagcagcgtggtcagagtggtaggagccggccatcagcgagagctgctccatgcctggctgctgggtgctacagcctgtggcccactggcttgcctcactgtggttggtggtggcggtgacagagactgcagcacgaccaaagtggtaggacaggggctatccagggctgcacctttcgcagtgtggggtgggttgggggcgctatccagggtgtcattgcctgcattaggggtactggttggtagcactgtacagggcttcactgcacatggcagggagggtgggttatgggtgctttctgggactgcaatgcccatggagaaggacaggttagggcactatcaggtatacgctactggtggcattgggggatggaggtggggggagctattgagggcaggactagccgtggagaggggtgagttcagtgctatcaggggctgcactgctggcggcggtcagcagagttggcatccaaggaaggagtggttctcctctccctgactccacactccagagagcgacccactcttggtcatactggggtgcggcaggcgcacagcgtttgcgtgggaatcctgagcgtggcagagcccccacacccaccgtggttcctgggcctgtgcactctgggtctgtgcctcagaggctgccaggcacccctggggacaccacgggggacagggccctgtgtgtggaggcgtccggaacaggaattggcacctgggtgcggagggctgtctgggtctgaatttttctgcttctcctactccctgaggagtgcagccctggtgggcccaatggttcctgtggagtggggagctgggtgctgtggtgtctccagcacccaccccagaccccagttcctggccagcttgggccaaagggagaggctggactttggagggtgggtgtgagtgcctttgctgaaactggcccctgccacccagtggctggcatgacaaggtgaggctctaacccttccacccctcacatcttcctctaggcttttctggctttgcccgcccagctgctccatgccaggaggaggaggagacacctagagcctgcgacaccacggctcgcctcgctgcgggagggtggcatcaacggagactgcagtgcaccagagtggtaggagagcggccgcactaggagggcaggtggctgcagccagggttgggggtcaggcttacagcaatggacgggctgcagcagtggccaggtggtaggagccttgtagggagggctggcgcattggcaatggctttgccctgcccatgccgtggatctgaccctgtactgccctgccttgccctgtacctgccctactgttacctggactgtctcggccctgtcctactctggtcccatcctgaccctgtcttggccctgtgctaccctgtccttgccctggtcttgccctggcactggccctgccctgaacctgccctggcctgaccttggctctggccctggctctggccctgccccttgtcctgaccctggtgctgtcatggcactggccctgccaatggtcatggtcctgctcctgttctggccctgacctggccttggacatgtcctggccctgctttggcccatccctgccctggccccaccataggcctgcctgttctaccctctcctggcactgaccttgccctgtcatggcctagtggtgccattgccctgccttaccctgtgctggttgtgccttggccctgcttggtgctggccgctccctggacctgccctgaccctgccttggcttttgccctgccctcactatggcctggccctgaccctagccctggtcctgccatatccctggccctgcccttatccaggccctggccctgctgctggcctggaacctggtcctgtcaaggacctgccctgactctgccatggccctggccctgctctgccttgttcctggccctgacccagacccagaccctttcctggctctgcactggcctttccgtggtcctgagctggcagtggtctgcccctggtcttgccatcaccctgccctgctgtgctctggatgtgtcatcaccctgacctggccctactctgcctttgaccctgccctggccttaccttggccctcaccctagtcttcactaggccctgctctggagctggccctagcacagacctggccctgactctggccctggtctttgtcctgccatagccctggccctgaagtgaacttcgaggtgtcctggccccggcgtaacatagctctgcattggcatgtccctgccctgccgctaccattgccttgccctgctctgccctgtcccagtactgacctggccatgctatttccctgccctaccctgccttggctgtgccctggctcggttctggccctggccccggccctgccctggacatgctctgacactgcctcagcctcggcactagcctggctcttctttggcatcagctctgctctctgtgtggaccggctcttgtcctgtcctgcactggccataccatgccctgccctgccctgcccgactcagccctggctcagccctggcccagccttggccttggcattgcccctggtcctgccatatttcttgccctgtccctaccctggccttggccctgacccttaccttgccctggctctgcccttgccctaacgcagcccctggccctgtcatggccctgccctggacctgtcctggccctggcccttccctgcttgagaccttgccctggttctcccctggccctgaccctgaaatgcctggccctaccctggccttgcactgctctggcccttgccctgactctggtcctgtcactggcctagccccagccctgttgctggtcttaccatggcccagaccctgccttggcccttccctgacactgtcctggaccctggctgtgccaagatcctgcactgaccgtgtccttgttttgctcctgccccgaacctggtcctgcccaggccatggccatggccctggccctgccctggctgttccctggccctgccctgccttggccctatgctttcctggccctgtcttgcctgtcctggccctgccttggccctagcctggctttgaccctgccctggccctaccttggccttcaccctagccttacctggccactctgttggacctggccatagcacagacctggttgtggccctggccctgccatggccctgtcccagaccctagccctgccaggtacctgtcctggcccagctctgggcctggctttgtccctggttcttagatgaacctggccctgcacctgcccttgcccttgccctggcactggccttggacatgtccgtggtcctaaccctggccctgccctggagctgccactgtcttggccctgccctggctctggccctgccctggccctggccctgccccggccccagccatagacctgccctggttggtcatgccctaccttaaccctgtgctaccctgggcctgctccaccctgccctggccctgccctccctttggccctgccatgaccctgccttggccctcacactggccctagcacagacctggtcctatctgtggccttagcctggcattgacccttgctcctgaccctggccctgccatggcccttgccctgccaatgaccctgacagccctggccctggccctgtcttggccctggccctgaactggccctgccctgaccctggccctgaagtggatttgcaggtgtcttgtccatgatttaacctggtcttatcatggccctgtccctcccctggctctgtcctggtcttgtgctgaccctgacccagaccttggccctgccccagccttgtccttgacctggccatggccctgcctctgccctggaccgaggctggcactggcatggaccctggccctggccgttcactacttaaggccataccctggcccagccctggtcctgaccctgtcctggccctaatttggcctggctctaccctggcatgctattctggccctggccctgacccggtccctgtccctgtcctggccccagccccgttgctggtcctgccatggcccttgttctgacattgccctttcctggttctggccctggccctgtcccagccctgctctggccctggtctgaaccctggccctgcaatagacctgccttggtcctgcccagaccctggctcgggccctacctctgccctggccatacccttgccctggcctggacctcggtcctggtccttgtcctgccccagccatggtcctggccctgccctgcctgtgccctgttctatcctgggctggccctgccatggcctggtcttgccattgccctgccttagcctgccctgcttgtgccctagatctgccccggcctttgccccgtcttggttctagccttgacgcagccctggaccttccctgaccttgccttagccctggcactaccctggccttggcttggcatttgccctactctatggcctggctctcgtcctgcccttatgcaggcctgaccctgcctgtgccttggctttggcctggaccttggccatacagtgaccctgccatgaccctttcctggccctggcctggaacctggccctgccaaggactcgccctggctctgtcatggccctggcccttttctggatttggatgtgtcctgtcccttatttccccggcgcttccctggctctgccataccccttctctggggtagggccagggtcaggaccagggtagggccatggtaaggcctgaagatgggaagggccaaggcagcggcatgaccagggaagggtcagggccaggaatgtggtaggactaggggcagagctggtactagggctgagccggggcagagcaggagagattacgttaggctgttatgtaaaatttttattttagatttttaagataactacagtagtagtaataatgtctatactatgttgtttgtaatagtaataatatttgcagtaaataatcactaaattttaactaatactatctttgcttccagtagtattctatgagtataattttatcaatatgtaaatatgtgaggcattgattctcacaataattctacatgctaggtacttaaagcatccccattttccaaatgtaggaaacaggcataaagaagttaaatacttggccagattactcctgtaatcccagcactttgggaggccaaggcaggcagatggcttgagctcaggagtttggaaccagcctgggcaacattgtgaaaccccatctctactaaaaatgcacaaaaagagctgatttaagtttcttgtaggattctggttataaaacactgctcaaacacacagggcatggatagggcagggccagggacaaggtcaggccaggaaggggccagggccaaggcagggccagagctggacttggaggtgtcctggtctgatttgccctgccccaacgttggcccagccctgctctggcacttctgtcatgccctgtccctggcctgagcattggccctgtccctgtcctgcttctggccctgccccggagttgaccaggcactaccatggtccagtcctgcgttgccctgccctcctctgccctggcgctgccatggccctgcttgggccctagctctgcctcgactctggacctgccctgactctgctcagccctggatctaccctgactctgccttggtgttgccctcccatctctatggcctggctctggccgtgccttgcacaggccatgctctgccctgcatgtcccagcctgggcccagcccttgtcctaccatattcctgaccccagccgtacccttgttctggccttgaccctgccgtggccctctcctggcccttccttggtcctgccctccccttccatgccctggccttgccctcaccctgcattggccctgcactggtcctgccctgccctggcactgccttggctacggccctgccttctccctggccttgctcttgccctgacctggcctgaccccaggcctaccgagtccatgaaatggccctggacttgccttgccatcgtctgtcctggacctgtattgtccccaccatgctctggtccagcacttaccctggccctgttgctagtcctgccactgctatggccctgccctgtttttggccatgccctgtgctaccttagccctgccctgccttggccctaccgtggccttctcctaccctggcctggccctacactagccttttctaccctggccttgcccttccctggtcttgccctgccctggccttgccctgccctggccttggctttgccttatcctggtcctggttctgccctggccctgctcttgctctggatcctctctggttttgccttctccctggccctgcccctggcccagtcttgaccctggccctggccctgacaatccccaggccccacactggccatgcttggccctggcccctcctttggccctgcactggccctgtgctatcttagtcctaccctggccctgaactcgccctggccctaccctcaccctacactggccctgccctaccctgaccttgccctggcctggccctgcctttggcctgccctggctctggttctgccctggcgttgcccttgccctggaccctccctggccatgttttttccatggtccttctctggccttgcccttgccctgtcccctttctggtcctgccatgtttctggccctgccctgtccatgtcctggacctgactctggccctggacctccctgtccctgccctgccatactctggcccattcttgctctacactgaccctgccctgccttggccctgtgctaccctagccctgccctggccttctgctgaccctgatcctgccatggccctggccctgccatgtccctgccctggccctggttctgccctacttctggccctggccttggtcctctcatgtccctggctatgaccctgcccctggtttttctctgtccatgaccctgccccggttctgtcctatccctggccctgtctcagttctgtcctagccctggcctttcacagtactttatgcttagtaagggctccatggtgtctgtgagttgaatgttgtgttcatagtatctgccaaaacagaaagaaaaaaaaatctgatgatgagaagttaaagctttgtatataatatgccttgaattgtaagtgcttgttattagttgtattacatataggtcatggttttgtacacataactccaaaccattgatactgttaaaagagtatatgaatatatgaaagaatgtataaacgtaagaatgtatgagtatctaatgaactttccaaattaatttttatttttagctctattagatttttctcagtgtaacaaatgtttattcctatgtaattaagggcgtatttcctgtacagagtattcatattacctaattgaaaattatataatacaaaaatataatattatttttaggccaggcatggtggctcatacctgtaatcccaacattttgagaggccaagttgggagaatcatttgagtccaggagttgaccagcctgggccacatattgagaccttttctttattaaataaataaataaataaataggttgggcactgtggctcatatctgtaatcccagcattttgggttgcagaggcaggaggattgcttgagcccaggagtttgagaccagcctgggcagaatagcaagactccatctctacaaataataaaatattaaccaggtgtggtggtgcgcacctggggtcccggctacccgggaggctaaggtgggaggtttgctcaaggctgcagtgaactgtgaatgcaccactgcattgcagcctaggccacagaacaggaccttgtctataaataaagaaataagtaaaaacataaataaaaataagtaaaaagaaatataagtaaatataaatataaatacatgtaaatatacaaatgaatacatgaaaacaatttttaaatttaacatcactgagggcatcctatccatttcatttcatgattccattacgtcatttcacttagatgaaatgataatatgacttgagatgagatgaaatgactaaatgatgagatgagatgaaatgatgagatgaaattttgagatgaaatggtgagtagaaatgatgagattaaatgatgagacaaaatgacaaaattgaaaagaaattgaaaggagatgagatgagatgaaatgagatgaaatgatgagatgatggatgaaatgatgagatgaaatgagatgaaatgatgagaagaaatgatgagatgaaatgaaatgaaaaaatgaaatgatatgaaataatgaaattgaaatgagatgagatgatataatgagataaaatgatgagatgaaatgagatgaatgatgagatgaaatgatgagatgataaaatgaaatgatgagatgaaatgagatgaaaaatgatgagatgaaaaatgagatgaaatgagatgaaataatgaaatgagatgcaatgaaataatgaaattatgaaatgtaatgatgaaattgaaatgagatgagatgaaatgatgaagtgagatgagatgaaatgagatgaaatgatgagatgaaatgagatgatgagatgagatgagatgaaatgatgagatgaaatgagatgaaatgagatgtaatgaaatgagatgaaatgaaatgacataatgaaatgcaataatgaaatgagatgaaatgcaataatgaaatgatgaaataaaatgatgaaataaatggaaatgaaatggaaatgatgagatgagcagaaatgatgagatgaaatgatgaaatgatgagatgagatgaaatgatgagatgaaatgagattaaatgatgagattaaatgatgagatgagatgtgatgaagtgagatgaaatgatgacaagatatgataacatgaaatcagatgaaataatgagatgaaatgatgagatgaaatgatgagatgagatgaaatgtgacgagatgaaatgacaatgaaatgaaataaatgatgaaatggaataatgaaatggaaatgatgagatgagatgcaatgagttgaaatgatgagatgaaatgatgaaatgatgagatgaaaagatgagatgagatgagatgtgatgaaatgatgacacgaaatgatgacataaaatgagatgagacgaaatgatgagatgagatgaaatggtgagataaaatgatatgaaatgagatgaaatgatgagatgagatgagatgatgagatgaactgatgaaatgaaataatgagatgaaatgaaataatgaaatgaaattgaaataaatttgagatgagatgagatgatgagatgaactgatgaaatgaaataatgagatgaaatgaaataatgaaatgaaattgaaataaaattgagatgagatgaaatgagatgaaatgataagatgaaattatgaaataaaatgatgaaatgatgagatgtgatgagatgaaatgatgagatgagatgacatgaaataatgaaatgaaattgaaatgagaagatatgagatgagatgaaatgatgagatgaaatgatgaaatgatgagataagatgaaatgagttgatgagatgatgagatgaaatgatgaaatgatgagatgaaatgagttgatgaaatgatgagataagatgaaatgagttgatgagatgatgagatgaaatgagatgaaaagatgagatgaaatgatatgaaatgaaattagatgaaatgtaatgagatgaaatgaaatgacataatgaaatgaaaaaatgaaatgaaataatgaaatgaggtgaaattaaatgagatgatgaaattaaatgatgaaatgaaataatgaaatggaaatgaaatggaaatgatgagatgagatgaaatgatgagatgaataatgtgatgaaatgagatgaaatgatgagatgaaatgaaataattaaaggaaattgaattgagatgagatgagatgaaatgatgagataaaatgagatgaaataaatgatgagatgaaatgacgaaatgctgaggtgagatgagatgaaatgagatgaaatgatgagctgaaaggatgaggtgaaatgatgagatgaaatgatgagatgaggtgagatgagatgaaatgagatgaaatgatgaaatgatgagatgagatgagaagaaatgagatgaaatgagataagatgagatgaaatgatgagatgagatgagatgaagtgaaatgaaatgaaataatgaaattgaaatgagatgaaatgagataaaatgatgaaatgaaatgatgaaatgagatgaaatgatgagatgagatgatgagattaaatgatgagatgaaaaatgatgagataaaatgatgagatgaattgaaatgagatgaaatgaaataatgaaatgagatgaaatgaaatgatgaaatgatggtattgaaatgaaattgaaagatgagatgagatgaaatatgaaatgttgaaatgaaatgatgaaatgaagagatgtggtgagatgaaatgatgagctgaaatgatgagatgaaatgaaatgagattaaatgagatgaaaaatgatgagatgaaaaatgatgaggtagggaggagccaagatggccaaataggaacagctccggtctacaactcccagcgtgagcgacgcagaagacgggtgatttctgcatttccatctgaggtaccaggttcatctcactagggagtgccagacagtgggtgcaggtcagtgggtgcgcgcaccgtgcacgtgccaaagcagggcgaggcattgcctcacttgggaagcgcaaggggtcagggagttccctttctgagtcaaagaaaggggtgatggatggcacctggaaaattgggtcactcccacccgaatactgcacttttccaacgggcttaaaaaacggcgcaccacgagattatatcccgcacctggctcggagggtcctacgcccacggagtctcgctgattgctagcacagcagtctgagatcaaactgcaaggcggcagtgaggctggggtaggggtgcctgccgttgcccaggcttgcttaggtaaagcagctggaaagcctgaactgggtggagcccaccacagctcaaggaggcatgcctgcctctgtaggatccacctcttggggcagggcacagacaaacaaaaagacagcagtaacctttgcagacttaaatgtccctgtctgacagctttgaagagagcagtggttctcccagtacacagctggaggtctgagaacgggcagactgcctcctcaagtgggtccctgacccctgacccccaagcagcctaactgggaggcaccccccagcaggggcacactgacacctcacacagcagggtactccaacagacctgtagctgagggtcctctctgttagaaggaaaacaaacagaaaggacatccacaccaaaaacccatctgtacatcaccatcatcaaagaccaaaagtagataaaaccacaaagatggggaaaaaacagaacagaaaaactggaaactctaaaaagcagagcacatctcctcctccaaagggacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggaactgatggagctgcaaaccaaggctcgagaactacgagaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaggaaatatgggactatgtgaaaagaccaaatctacgtctgattggtgtacctgaaagtgatggggagaatggaaccaagttggaaaacactccgcaggatattatccaggagaacttccccaatctagcaaggcaggccaacattcagattcaggaaatacagagaacgccacaaagatactccttgagaagagcaacttccagacacataattgtcagattcaccaaagttgaaatgaagaaaaaaatgttaagggcagccagagagaaaggtcgggttaccctcaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaccagtcactgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaacaagccaatggaaaagaaaaaaaaaggcaggggttgcaatcctagtctctgataaaacagactttaaaccaacaaagatcaaaagagacaaagaaggccattacatagtggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaatattagagagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtacaatcaaactagaactcaggattaagaatctcactcaaaaccgctcaactacatggaaactgaacaacttgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcagaaaagatccaaaattgacaccctaacatcacaattaaaagaactagaaaagcaagagcaaccacattcaaaagctagcacaaggcaagaaataactaaaatcagagcagaactgaaggaaatagagacacaaaaaacccttcaaaaaattaatgaatccaggaggtggttttttgaaaggatcaacaaaattgatagaccgctagcaagactaataaagaaaaaaagaagaatcaaatagacgcaataaaaaatgataaaggggatgtcaccaccgatcccacagaaatacaaactaccatcagagaataccacaaacacctctacgcaaataaactagaaaatctagaagaaatggataaattcctcaacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctaaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatcttaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccttctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaagcccattgtctcagcccaaaatctccttaagctgataagcaacttcagcaaagtctcaggatacaaaatcaatgtacaaaaatcacaagcattcttatacaccagtaacagacaaacagagagccaaatcatgagtgaactcccattcacaattgcttcaaagagaataaaatacctaggaatccaacttacaagggatgtgaaggacctcttcaaggagaactacaatccactgctcaaggaaataaaagaggatacaaacaaagggaagaacattccatgctcatgggtaggaagaatcaatatcgtgaaaatggccatactgcccaaggtaatttacagattcaatgccatccccatcaagctaccaatgactttcttcacagaattggaaaaaacgactttaaagttcatatggaaccaaaaaagagcccgcatcaccaagtcaatcctaagccaaaagaacaaagctggaggcatcacactacctgacttcaaactatagtacaaggctacagtaaccaaaacagcatggtactggtaccaaaacagagatacagatcaatggaacagaacagagccctcagaaataacgccgcatatctacaactatgtgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatgacaacaaaagccaaaattgacaaatgggatctaattaaactaaagagcttctgcacagcaaaagagattaccatcagagtgaacaggcaacctacaaaatgggagaaaatttttgcaacctactcatctgacaaagggcttgatatccagaatctacaatgaagtcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatgaaaaccacaatgcgataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcaaggatctagaactggaaataccaattgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatctcctttgtagggacatggatgaaattggaaatcatcattctcagtaaactatcgcaagaactaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggcgcagcgcaccagcatggcacatgtatacatatgtaactaacctgcacaatgtgcacatgtaccctaaaatttaagtataataaaaaaaaagaaaaaagaaaaatgttgagattaaatgcgatgagacgaattgagatgatatgaaataatgaaactaggtgaaataatgaaatgagatgaaacgaaataatgaaatgaaattgaaatgagatgagaagaaatgagatgaaatgttgaaatgaaaggaagaaatgatgagatgagatgaaatgatgagatgaaatgagatgaaaaattatgagatgaaaatatgagatgaaatgagatgatatgaaatgacataatgagataaatgagattagatgaaatgaaatagtgaaatgaaatgatgaaatgatgaaaatgaaatggagatgagatttgatgaaatgatgagatgatatgatgagatgggatgggatgagataaaatgatgagatgaaatgatgagatgatgagatgaaatgatgaggtgaagtgatgcactgtcacgtgtgtgtctattctttttcccaaccaacaaaaattataattcattaattttaattttatttaacaatactcttaagagttgaaggaaaaatattatctacattatgggttacaatctaagtataaataatacataaatatattaaaacttataaagaatatgttttggaatcgaatataccatgcttctgtgatgacagttatttcatgctggttgtcacaattttacgtgaaaaactaatgaaaaaatgtttttaactgtttctaaaaataagtttccaaaacagttttacattcgaaatatgaaaaagatgtctttgtgttccttaatctgatgagattttcacactctgcacatgataattgttagatttttattgtgttgataaattgtatatcaaataaaaaatgttattacctcttaaattaggatttttaggtgatataggcagaaaggaaggcaagtttttataactttgtctaaatgaactttctaaatgcctgagtatgaaaagatagcatgtctataaatcacaatgtatatattactgtatgacctaggaccaatcaaaactgttatctctgataacattatattgtgcccaatataaaatagatataataatacctcaaacttcaatctaggcattgtcattgaatatcttaagaatatgcagcaaaggtgcttttaaaaatacaagctagtgattgtactaaatttgtaaatcacataggatagtgggtcattttaagaatattagttatttcaatctataaacttggatgtctttccttttttgtgttttctttaatttctttcattaatatttgtcatttttgttgtcaaaatcttttacttccttggttaaatttataagtacatttttatagctattgtaaaaggatttgctttcttaatttcttgtttcagctagtttactatcaatatatagaaatgctactgatttaaacagggacaatttgactgtctcctttccaattcagatgtcctttatttctttctctcacctaattgtcctggctaagactttcactatgtgaaatatgattggtgagaataggcatccttttcttgttctagtaaaatctttttcttgttcacagtaaaatctttcaccttttccacactcagtatgatcttagttgtagatttgtcctttatgtccttctgtgttaaggcatatattttctatactaaattgttgagaggttttttgtcattcaagaatatttaattttgccaaatgcttttattgtgtttattaattaaatcatatggttttcagtatatatccaaagaaaagaaaatcagtatatcaaagagttagctgcacccccatgtttattacagcactattcacaatagccaagatatggaatcgacaaaagtgtccatcaacagatgaatggataaagaaatgtgacatacatatataatggaatattatttagtcataataaagaacaaaatcctgttatttgtggcaacaagaatgcaagtggagggcattatgttaggtgaaataagcctggcatagaaacataaacaccacataactacgtgtactcacttatgtatggaagctaaaatttttaatctcatagaagtagatagtagagttttggttaccatatcctggaaagagtaggagaaagaagagtataagaaaaatgtggttaatacatacaaaattacagctggagagaaggaagaagttctaattctctacagcactgttgggtgactgtagttaatgggaatttattgtgtgttttcaaataactaaaataaaagattttgaatattctcactgcaaagaaataatacatgatttaggtaatggatatgataatgactctgacttgatctttacgcattgcataaatatatcaaaatatcactctgtaccccataacatgtacatttattatatgtcaattaaaataaatttaaaagacaaaaaatgaggtaaaggtaaatgtacagaatttaattactttttcttctataaaacccgagtcagtaccaagaagagtcaatttattagttttctaaaataaaaaaaaatcaaaatgaccaaaaaagagcaatatccaagaaaacattgaaaatgaaacacaacatttagtaagaatggaaaacttgggcactgtatcaccctgttcctagataccgatttactgatggccatttaaatagaattttattctatctaattcatttatactcccagagttcgaaattacattttacctacaataaatgagataacacctgtaaattatatggtactctgcctaacacacgttaataactcaatacatgttagcaataaacttttagtatagcagtcaaagtattaatttctcacattgcaatttccttcaaagacatgaatacaacctttctaatgactccttgtttatcaagatacctcttcaaattattctatttatttcattcagtatattatctgtgtataccgatatgatattacacttttttttttgagatggaatctcattctgttactgatgctggagtgaggaggcatgatctcggttcactgcaacctccacctcccaggttcaagcgattctcctgtctcagccccacgggtagctaggactacaggtgcacaccaccatgcctggctaatttttgtatttttagtacagtcagagtttcaccctgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttacctctttgtgcttcagaaattattttccttcaagtgttctaagagtctaatgaagaatgaagtcatgttttatcacttttgtccttaaagatttcagacatgctgaaactgattgaagtataatttgctaccagatagattaattatctctagttgtaggagtggatacatctttaatggtatatcttgggttattgtcttatttttgatgcagtattctataaataatttattaaacctggcatccttgggtgagcatagatttttcaactttggtgttatattgtgtttgcttttaaaaactgcttttgaggccaggtatggtggctcttgcccatacctagcactttgggaggccaaggtgggcggattacctcaggtcaggagttcaagaccagcctggtcaacatggcaaaaccatgtctctactaaaaacacaaaattagccaggcatggtggtgcatgcttgtagtcctaacctctcgagaggctgaggcaagagaatcacctgaacctgggaggcaaaagttgctaggttgctgtgagccaagttcgcaccattgcactccagcctgggtgaaaagagcaaaactctttctcaaaaaaaaaaaaaaaaaaacccaccaaaaactgcttttgaatggagttgtacatacaattttgatgaaaaaaattatcaagtgcataagtgcataatagaaaaaccaataatactccaagcacaagttagtactaaaaaaaatatgttgagtattctctactacaacttgctttttcccttcatgaacaatttgtgttttactgagaagactcattgtttatggtagacattagactacagatgaatatgtactttaaacactcttagttgctttcttaattttatatctgctgctttatgcttctgtttattttcattctttccaatgtctaccttctagtaaatttgaatattttaatccgagtttatatactatttaatattgcttgtatagtttagtatttttaagactcaaaaagttttacagaaagaagaaaaagatcaacatgttattaatcatttaaagatcattttaaaatctttgacctttctattttaatgaataaaatgttagtagttattagtataaaataatttatgtcttttggacttagcatccagtatttcttttttaataaagaaaataatattctcttgcaatatactatgtttatctgggttttgaaaaatgatgtttcctaatatgagaaagccatttacatttttaaatctacaaaggcaaatggaatggtactaaattatttacataataatgtttagatggtggcccttattaacattctttctatacttcctacagagttggggatatgcaatcctagaatatttctgggagctaatcctttatcttgatgaatgaaacaagacttttaaataaaattaaactttcaaattttccaggtaatgggcctgtcttttaattcaatggatatggagcataatgaattatcccctgttcattgggtaataagttctcattcttataatactcaaaatgtcctttaatttttaatttttgatagtcatatcattatccctaggtattttagcttctatcttaaattctaaaatgattttgaaacaggagaaagtattctttattactatatgtattaaacatcatggttttcaaatttaactgcaaatgtatcttttcattgcttcttgatgacgcccttcaccctatccatattatcactaccaagtggtgattacttttcaggttcacatacttattctttagaaaaatcttgtctgtgccttataaagaatatgattgttggcattcaaaagccagtgaagtatacattattagcctgttgcctaactcatttctttaagaaactacactaattacccacatacttatgtttttatttcctcattatttctggaggaaacaaatactgctaacatgatatttgtaagacagaaaaaagtcttttcttgaaaagtgctgtcattgtagtactaacttatagtatcaacttctttatcaactccttatgcgctttttattctgagagaaataaaaaagctaaaagtgaaatgactttttttactgtccatattataagcacccatcttggtaatttagggtctttatagttagggtaagttgtgtcataccgaggttacaaaatgaaaagtatttcgtctctttgggcctttctttattcagtaatactgtcagtttggctttttttgtaggtcaacttattgaactcagtattctgaaataatatgtttactatcttttgataagcatttaaaatattagatttattgttattcttctgactttattgggctggaagaataattgtttcactccataaaagccaagttgcggagaaaaacacatagacattcaactgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaaatatataaataggggacctaatgttaatttttattgtctgagaccatgtctgttatttcactctttaaattcagttagtaatgcagaacctagcacttagtagatactcaaaaattatttgctgaataaaaaaaggttaaacgtaatatatacaaaatgtactggaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatatagtcaaatatccccttggaaaaaaattaagtggcctctaaagtgaggtattaatatatgtaattttacaatccactagtgatagaagtaattaaatatgccaccaaattgattaactcctacagtgttaaaagagaagcactaacaatgccagtgaacatgtaacatggatttaagctacaagtcatagaaatgtgatgagaagcctcagcgctgtaaaacagagggtggaggaaagattttcctctctcaaatgagctttgtgaggtatactttttgaaggataggaagttgaagtgttcaggacttttatgactattctactttggcttagtttacatgattcttagtttattagcctagaaatggccaagaaaacttaaggttcaataattagttataaatatgaaatagccccaattttaagataaaaacaacttataaatgtatttgtctgtaaaaattgtgtatatttttacagaacatctatttctttctttttttattttcttgtatttttttattatactttaaattctagggtacacatgcacaatgtgcaggtttgttacatatgtatatatgtgccatgttggtgtgctgcacccattaactcatttatattaggcatatctcctaatgctatccctcccccctcccccctccccccaccccacaacaggccctggtgtgtgatgttccccttcctgtgtccaagtgttctcattgttcaattcccacctatgagtgagaacatgcggtgtttggttttttgtccttgcgatagtttgctgagaatgatgatttacagcttcatccatgtccctacaaaggacatgaactcatcattttttatggatgcatagtattccatggtgtatatgtgccacattttcttcatccagtctatcattgttggacatttgggttggttccaagtctttgctattgtgaatagtgccacaatacgtgtgcatgtgtctttatagcagcacgatttataatcctttgggtatatacccagtagtgggatggctgggtcaaatggtatttctagttctagatccctgaggaatggccacactgtcttccacagtggttgaactagtttacagtcccaccaacagtgtgaaagtgttcctatttctccacatcctctccagcacctgttgtttcctgaccttttaatgatcaccattctaactggtgtgagatggtatctcattgtggttttgatttacatttctctgatgggtctatttctttaaaacaaaaggaggggagtctctcatttacattagtttttttcatagccttttgaactttgcaatttctatgtttcagaacctatttcttacagtttttctatgctaaactctgtcctagtcagttctagagtgtatgaagaaccaaatgatgtaattgtatgcgacctggctgtagtggaacaaatttgactctaaagtatgcaggctctaattttcctgtctggttttggtaagtattccttacataggttttttctttgaaaatctgggattgagaggttgatgaatgaaaattaatcctttcactttgttgtatgtaggtttgcaataattagctcagagtggagttttaaggtcatggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacctattagtggaatgtgttttaaaggatcatatcagatgaatgaaaggtatttgatccttcgtttccttaataataaaatgatggtttggaaaaataggctgcagtctaaccacagtgctattattaggctttcttgttaaacataggtctaagcctaagtatgtcaatagaacaaatacttactgtttcatttctagtaatgaaaaaaaaaaaaaaaacaagtcttctggcataaggatgattttcatctggtcattttgaaacatttttgtaaaataaatttacatctataaagaacatttttatttgtaaggaggggtatgtctctgtgcactggaagagagggaggactaaatcactgggaagtcttatgataaagaagccattggcttaaatcagcaaagcaagccatcccttggtttaaggtgtttttcctggccatcctgtcttgactagaactttacctacaccttcctttttggtttaggcaaattatagtatctaaaactgaagtctcagctctgtgtctttgagatataaatgttctaccatgtcttctctggaacctgataactatctatctctttaaaatgcaagtctagggagatgactcatcagaaaaagaagaaaaaagaggtatttggaaattgtgcaaattaaagcagcccctgatgccaaagtctacacattcctgagtgagtcagttctggccagttctagctgggtcaagagacctctgccgtgcaggcctgaagagcacctggatggcagacacctgaggagccaggtgcctgaaacttcctccacctgcttgaggtgcgccaaagcccaggtgctggctggacaaccccttctggctgcctaagcagatggcagaagaaggaaacaaggtcagaggcagagtgttgaaccctgcctcccaggtgggtggaagatgcctgtcaccaaactagggcccagcttgctgggtgagatgggtgaactggtgatcccccgagagagtggacgtcagaactacgtgttcctggacttcacctcagccagcgaaggaaagagagggttaatgttaactgcacgaggcccactctagccttaaattctgtaattcaaacctttcccttggagacaaaacaaacatgaaaaggaattctgaggtcaggggacaagaatcacaagttccctagtgggagactgaggaggcagtgtccttcctgctcttggtctactggctaagaaccttcctcagcctgacctttgcacattgcactttcagctctgtttgcaattttcctcctttagtgctgagggaatcccagtgttcgatcctgaaatctatcggttcctaatgggtggttaaaaaaaacctcagcgagagaagcagaaaatgtttcctcttcctgaaaaactgtagaaaggcaggcaccattctgggtgaggacatggtccttgcaaatgtctttgtgtttttttttttttttttttttttgagatgaagttttgctcttgttgcccagactggagtgcagtggtgtgatctctgctcattgcaacctccgcctcttgggttcaagcagttctcctacctcagcctcccaagtagctggaattacaggcacctgccaccacacctggctaattttttgtatttttagtagagatggggttttaccatgttggccatgttggtctcgaactcctgacctcaagtgagccacccgcttctgcctcccaaagtgctgggattacaggagtgagccaccgcatccagcctgcaaacgtctttaaagacagcatgtttcagaggctgtgacagtgccctgtgaacatgccaattctcgcagtcccggcagctctgaggagcaggcccggctccttgccaggctgatggtactgaaactctgctctccaagacataacctgatggccgtgcaagatttcttaatcgactgtggaccgtgagagtctgcatctcattttaattaagatgggaaaagaaagaacaaaagagcaactccaagattatagagaaactggattttagtataatattcaagtgtagcattgctaataataacaaacctttcccctcccaaacggtaagcacttgcactgcctattatacaaaaattcaaccaccctctctgttcccccgatatctcctccccagtgacccccctctcatgcggcctcatgagcctggccagtgatgaatggcactttcatcggcatgagactccacgtgagtgggactcagctgggacccctctccacgtgggagctggagaagccaccctagtagcagcttaaagtgtccgtgatgtccctgctgctgagctaggggccgcctctgagctggtctcggggtgtgagctgctgctggtagtgggctctgccctgagggcctggtggctggtcagaacggcaggcacacatgggtgactccccaggaactcaggccacctccccaccacagccctgcaccatgtgctccaggcatgtgctgagtgcctggtcaatcaccagtgccctattgatcccagtctccagagagatcatttagtgtcactccacagagggggaaactgaggcccagagaagtaaggtgactctccccagtcacagggctggtcagcagtaggatgggaggctggtcccttgctgtctgactccctgagcccacccatatcccaaggcagccaacctctgctcgccctggttcaggccccgactggcccctgtggtgggtgatgtctatcttcctggcctttgtgctcccagccaactgggatggagcctccagctagcatgacaggttgtagctatggacagaagagtggctgtgaggctgccaggaatctcaccagggccccctcccagggcctgtccagagtgaggtctgggtaccccaggcattgccagaccacaggatctgatgttgacctgttgaccaagaggccatggccacaggctttctgaggctggcccccagggagagttcaatcccactatcccaattcctgtcctggccttacctctcagtctcaccaagctgcttcatggtcccaaaccatgacccaaagtgctgcttgggctcaaggttgtaattatttgcagccaactggagcagcagacctccttgcttactttgaattcctgggtccagaggggaaaactgggtggtgacagggactggacagggatgccacaggggccctgtgggggtgttagatcgggtggtggccagtctttgctcataggggacccccttctcctctccagtcctgtccccacctgttctcagagctggctcaaacagcagctcctccaggaaggtgtccttggtttcaacctggtactcccacctgcaggtcttcctggagtgtctcctctttctctctgtctccccataaatctaagacgagggggatggatttgcccaccgctactcaccgtatgactcttgtgaggttgatcagtctcccctggaaggccaacagctgaagtccatcagaaagggtcctctggcccagagccagcccctgcccacccctgtcatgctgcacccagggtgcaagccccagatcaggtctgggtgacaggaggggtatagaggggctgaggctcaggggccttctagcctaacttgtctggagacagttggggaaactgagaccccaagtagggaggtatggctccgagagattattctcattaacctggaacatttttgcaagctgttaggtataggaagtctgtcacaggtaagagaaatgctttttgagagcatgagagacagcagggttgtgacaatattgaaacactgccgtgcagattcaccaattgccaccaccgggagccccctgagagtcattgcagatgcacagccctcccctgcaacccctggacctccccatggtctggcatctaaagggttatgcctcatggcaggaatcagggccctcaggatgccctgcccactccaaggtctgcctctgctctgattggtcactgacattcagattgtcacccaaatataaggatgttagcagaaagactcattcaatacaagtggactcagacatagataggaattgagttgcaaaaagccccttttgtttcttttattttggaaaaaacttttattgtgaaattcacatatatatatatatggaaaaaactgaatcaatgcaaaaggatagacaatgaacaaatgaattccccttccactccagatccccaactcagatccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccatctcatcaccagtgatttcttgggctctgcattagttttctattgctgctgcaacaaacagctacagactcagtggcttccatttctgtcttatagttctggttgccaaaagtcctaagaggatctcactgggctaaagtcaaggtgctggtggggctatgtcccttctggaggctcaagggatgaatcaggtccctgcgttttctagcttctaggggctccagcttctgggtttgtggcctccttcctccatcctcaaagcctgcaacagcaggtgaagtcctcgcccatcgtgcatcactctcccttctgcctccttcaacttttttttttatatttagggggaacgagtataggattcttacatagtcaaaaagctccttatagagaagctcagaactttcaatacagctttgccttttttgccatttaaattttccatttaatttaaatgtattctctcatttgaccttcatactctgtggagaaatattcctattttggcttgtattgacaagttgttttcacacagcccccacatcacccaaccaaccagcagagatcctccttcccaagaaacagataaagaaactgaggcccaggaaggctaagagtcctgccaggattattcacctttcaaggtaaggagccagttccagacctgggtttgtgcagctccaagctcccccgtctttctacaatgctagatttagactaaagcaatctagcaagtgtggccacacaatggtcaagttggatttagatgatgttctctataaatccattctcctctcccgtgtaagcaaggcaaagtactccaggccatggggagtccctgaagactcgatgaactgcagtggccacatcaggaggttgcaggttaaccagaactcaccgacacagcaggagagcagcttggaacctgcaacctagccaaaacctagtgccttggattgggggagaaaacatgcagccattcctctctctctgctggctagaggggattctggcttttcctgccagagccacccctttccctcctcctaaagttgatggtggttctttaaggaaagggagaagtgcacggtgtgatagggcaggaagagaagaaaacggaggagaggaggggactttcccataagcaggcagaagaaaaggcagctgtggtgtgtgatggacatggatgcagtggtgtccaatgtggggtcagccctagaggagagacagagagagagacagaaaagtgagagagtcctgacccttattattaacatgggatctgcctgcaaatgctgtttagggtcatcgcctcttcctgtactgctatttttgagagtgatgctcctgagccccacgacccagtcaaatttgatgtccctttgagccagattcagtgctgggagtccagtgtgatctgcctggatcttgctgcattgagaacaggccagatcttgaccccaatacaggggctggatatgaacaggcaacagctgggtttctgagtcagaaagacttggttaattgctaattgcttaggcaagtaatttaatttttgttgcgtcagattcctcagctacaaaatgcacatgacagtacttattcctccaggttgtggggaaaatggagattctaagcacgatgtccatttcacagaaagataccaatttggtggcttatttcctttctaccttcagaagtggctatccctgccacccaaacagacccttgactctcaagtggacggggtcccatttgcacagggggagaccttacagcctacgttgagtctatacttaccacttagtgagcatggtatccactcaggggcctctgtgggcatctgtctcctctgcagcatctttcctccccactgctgggtctgcacatgaccccctccttgggttaggcctctgatcagtgatgaccttggtatggtggtaatggtcagtcttggcatcaaatgagccagtttatatcatcagctattcaataaaatactaatctaggtgtcaccttgaaagtattttgtgacattgttatgtacatattgttacaaatgtgcatgatgcatttactacagcatagaattttgcctgggtgccaccctgaagtctgtccgacagatcatagccatgttagtcccacagtcgtaggggccaattgattaaattattttatctcccttgagaactaaaactaaaatcctaaggcccccacccatcttaacagaccccctgttggccaatggaacctcaaataaaacttaaaattcagttcttggccatgacaggacaggaagtcagacatacctccctgtacctccctccctcttatggtttagacccaacaactgaacagcattaatgttaaaatagagatcatgagactgacagaacagactctttgtggcaataagacctcaaattataaacaggacctagggccatgccaggcgagggttaagtcttgtaccctactcttaaagaattaactagattctaactaccacatgggttttatttttctctagcagccaagcaagcactggctgtgagagatggctgtgagagaagattaaaacaattacaactcacccagttcacagatgctgagtaactgatctcctgccccactaaccttaacgacagctttctctggacaagggactgatttcagtaactttctcctgataagagaccatcctccatggactggttctggccagttttagaggctgtgcctttacgaggctgagtaccttcatgtccctgcttcactttttgatgtgtagggcctaattataatacatttaaatgtcaagtctccaccccagaatgaacatgcatgtttattgaatatgcatgtgttaggacctcttttatgagtattctcataaaatgatatagctcctctgatatcctattgagtatgtatatgtagccaactcatttggctcaaattcctgtcctctccctccctccctggaaatgcctgcctctggccttggctgtaggccacacttcccagcctgtcataatggccaccttgcagactgcaaacctttataagaaataaagctctcttttctaaatttataaaattgtgtgatttttcagttgatgctctctttctacacacacacacacacacacacacgcaatttatacagaaggaaatctggagaatatatgtgggaatggatattgtgtggcaccatggtgaaagtaacataaagttggattaggctaaatttattaatgttggcccactaaacagagattctggactcagagttgtaggtcaaagctttagaaagggctccaagggttggtttgatcggttacttggttggttgcttgcttggttggtggtgcttgcttccttgcttggttgtttggttggtttgttgcttgcttgcttgttggttgattggttggctgtttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactgaagggtctacagaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatgatttgactcacagacacccatggcattgtgtagtccatggtatccacagggagagctaatgggctgtaccaaagtcttagttgttgtttaaaaaatgaataattctaggtcaactgaataaaagattaactcaaattaatgaaacacagatctaaaaccctcaatcaattcccagacttgagccagttcacaggcctacaaccccttaagtgaaggggaggctgggtgatcttggggaagtacgctgctacattgccaaaaatttacattgttaatcttttccccagtcttccccaaagggacctacagccttctgccaggatgactgtgacttaaagaaaagaaaattctcagatatttggggaattactggacactggctctcatttgacactattatcactatgttgcctaggatggattcatgcttctgggttcgagcagtcctcctacctcagcctcccaaagtgctgggattacagacatgagccactgtggccagcagagctttgaaactagaacatggaggtctagtggtaaatatttgacaagtctgggaagagattgggccaaggcaatgttgatgattcctttttttttttttttgcaacagagtctcgctctgttgtctaggctggagtgcaatggtgcaatctcggctcactgcaacctctgcctctggggtgcaagcaattctcctgcctcagcctcctgagtagctgggattacaggtgcccaccgccacaccaggctaattttttatttttttaattttttttgagacagagtctcactctatatcgcccaggctggagtgcagtggcgcaatctgggctcactgcaaaccccacctctcaggttcacaccattctcctgcctcagcctcacgagtagctgggactacaggtgcctgccaccgtgcctggctaattttttgtatttttagtagagacagggtttcaccgtgttagccaggatggtcttgatctcctgacctcatgatccacccgcctcagcctcccacattgctgggattacagggatgagccaccatgcccagccacaccaagctaatttttgtatttttttttagttgagacagggtttcaccatgttggccaggctggtccctgaccttgtgatccgcccgcctcggcttcccaaagtgctgagatgacaggcgtgagccaccgtgcctggccaatgttggtgattctaaacagcagccgctaatgtgaaaaccatccaactggaagacctggcctttcccagaggacacagtctgggtggtgggcagagacttcagctgccttccaaggcaagcagctccttgctgcctgcttgctggggattttacttacagggcagaagctggcaagtgatttgggggcaggaattgcttcctggatggtataggatgaaccacactccccaggaagacactcatcctggtggcctaacagaagtagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttctttttttttgtaatggaatcaacctaggtcctaagcctagcaggttattattattatttttatgattattttttgagatggagtcccactctgtggcccaggctggagggcagtggcacgatctcggctcactgcaatgtctgcctcctgggttcaagagattctcctgcctcaacctacagaagagccgggattacaggcgtgcaccaccatgcccggctaatttttgtacttttagtagagatagggttttgccatgttggccaggctgatctcaaactcctgacctcaggtgatccacccacctcagcctcccaaactgctgagaatacaggtgtgagctgccacacccagccacaggttatttttgctgatcttctccctcctcccaccctctaccctcaaagaaaatgtggtacatctacaccatggaatactacgcaaccctgaaaaggaacaaaatcatttttttgttttttttgtttgtttgtttttgcagcaacatggatgtagctggaggccattatcttttttaattatttttattattttttattttttctattctactttaagttctggggtatatgtgcagaatgtgcaggattgttacatagatatacatgtgccatagcggtttgctgcacccatcaacctgtcatctacattagatatttctcataatgctgtcccttccccagtcccccacccctgcaacaggtcccagtgtgtgatgttcccctctctgggtcgatgtgttctcattgttcacttcccacttatgagtgagaacatgcactgtttggttttctgttcctgtttcactttgctgaacatgagggtttccagcttcatccatgtccctgcaaaggacatgaactcatcctttttcatggctgcatagtattccacagtgtctatgtgctacattttgtttatccagtctatcactgatgagcatttgggttggttccacatctttgctattgtgaacagtgtggaggccattatcttaagtaaattaacagaatgctgcgtgttctcacttataagtgggagctaaatgttgtgtataggtagacacagagaagggaacagatactgggttctagttagggggagagaggaaggtagaaggacaagagttgaaaaaaccaactgtggggtattatgctcactatctgggtgatgggatcactcataccccagacctcagcatcacacatcatccgcatgtaagaaacctgtacatgtacctcctgaatccaaactgctccaccatttgcaccagcaattccaagactgggcatctacccaaaggaaaagaagtcattctaccaaaaagacacatgcatggtaaagttcctttttgtttgtttgtttgttttttgagatggagtctcgctctattgcccatgctggagtgcagtagcaatctcggctcactgcaacctctgcctcctgggttaaagtgattatcctgcctcagcctcctgagcagctgggattacaggcatgcgccaccatgcctggctagtttttgtatttttagtagagatagggtttcaccatgttgaccaggctggtctcgaactcctgacctcaggtgatctgcccaccttggccctccagagtgctgggattatagtgcccggccctgtaaggttcgtcacagcatgacttacaataggaaagtcatggaatcaacccagttgcccatcagtagggtaccggataaagcaaaagtggttcttctacagcatcaaatactacacagccatgaaaaagaataaagtcacatcctttgcagccacatggatgtagctggagggcattatgcttaatgaattaagaacagaaaatcaaataccacatgttcttgactggataaagcaattgtggcccttctacaccatagaatactgcacaaccatgaaaaagaataaaatcatgtctttgcagccacatggatgcagctgaagggaattatgcttagtgaattaacaccaggaaaagaaaatcgaataccacatgttctccactagataaagcaaatgtggtctttctgcatcatggaatactacgcagccatgaaaaagaataatatcatgtcctttgcagccacatggatgcagctgaaggacattatgcttagtgaattaatgccaggaacagaaaatgaaatactacatgtcctcaactggataaagcaaatgtggcccttctacaccacggaatactacacagtgatgaaaaaaataaaatcatgtctttgcagccacatggatgcagccggagggcattatgcttagtgaatcaatacgaggaacagaaaatcaaataccacatgttgtgcactagataaagcaaatgtggtccttccgcatcatggaatactacacagccataaacaagaataaaatcatgccctttgcagcaacatggatgaagctgaagggcattatgcttagtgaattaatgccagacacagaaaatcaaataccacatgttctcaattagataaagcaaatgtggtccttccgcatcatggaatactacacagccatgaacaagaataaaatcatgccctttgtagtcacgtggatgaagttgaagggcactatgcttagtgaattaacgccaggaacagaaaatcaaataccacatgttctcgcttataggcgggagctaaacattgcctgcacctggacacaatgaaggggcaccacagaccctcagtactaatagagcaggaagcaggggcgggggtacaagggttgaaaaactaccctgagattctttgaatttccggcagaaagcagcaactggagagagctttgggtcacggatttttctgttgcattttcttgcttgtttgttttctctctcgctctctttttttttttttttttttttgagatggagtctcgctctgtgacccaggctggagtgcagtggtgcaatctcggctccctgcaacttctgcctcctggattcaagcaattcttctacctcagcctcccaagtagctgggactacaggcacccaccaccacacctggctaatttttgtatttttagcagagacggggtttcaccatgttggccaggctggtctcgaactcctgaccttaggagatccacctgcctcggcctcccaaagtgctgggattacaggcatgagccactgcgcctggcctctcttcttacatatttctagaactcctctagaatttggggtttgtttttcttaattacaaggaatcaagttgaatcattagtgcatatataaatatacattttatttttagtacacattatatacctcaggaatgtacaatgctcagtgcctgggtgacgggatgattcataccccaaacctcagcaacgtacaatatcctcaggtcacaaagctgcccgtggatcccctgaatctataataataataataataataataataataataaaaataaataaaaagtgactttgtcattcgcagggaaatgcgaatgacattcactctgcctctcaggcccttggattcccaaagtttgttttcatcacgcccaggggacactcagaatctcgttttcagaacacgggttgtttttcttagaaacgctttgcaaaacaaaataggaagcaaaatctttctcactccttctgctccataatagactaaataaaatgagggggcaggaatccagagactttgaccgcagttggcagatttattgtggtacagacatgaaggcaagcagtgttctctctgattctacgaaccgtacagcccaggccggctgccttctgctttctggatggtgcaggcgtgagctccaagcccaaatttcaccggagctccaggaatcgagcctggcccaggcactcactgcacgggggccaagcgtgaaaccagtgatcgctccagcaaggtaacaggacagcttggtgatccttcttgccggccacaaaatgttatagccagaattccaccgaatgtggtctttctgtgtatctccccagacagcgaagatggacaaacatgggggtggtgggtggggggtgctgacctcagtggggtgtcctggagacgcaggaaccagggtttacagggtgcagatcctactgaagcaaatggaagtggcatccatgggcagagctggctgtagcatcccccatctgcctgtggtgtcaccaaatgtatccagagaccgcttgtaaacctggagggtgtgctaacgtcagtggggtgtcctggagaggcaggaacctgggtttccaaggtgcagatcctactgaagcaaatggacgtcgcaaccgcgggcagagctggctgtggtgtccccccttctgcctggggtgtcaccagatttcaccgagagaccccttctaaacctggggagtgtgctgacctcagtggggtgtcctggagaggcaggaaccagggtttacaggatgcagatcctactgaagcaaatggacgtggcatccttgggcagagctggctgtggctggccttccggcctagacgtctcccccactgcctggggtgtcaccagatgtacccagagacctctcatctgaaagctcatgcatgggaagcctccaggtctcctcggcaggcagcatcacgtctgattcaactgcgttatcaggtaatgcaggcctgttctgcctgtgtgcgtgagtgcgtgggtgccatgtgggattgtgtgtgttgatgtgggtgtgggtgtgtgcttgcgtggctgtgtgtgcctctttatgtgatgatgactgtgtctgtgagtctgtaagacgtgtgtttccatgtgtgtttctgtgtgagcgtgcattcctgtgttttatggaagtgtgtttttgtgatggtgtttgtgtgtgcccctgcatttattgtatttgtgtgtttgtgaatatgagtgtatgtgtgtgaatctgtatgccaatgtataaattcttttttgtttttttgagacagagtcttgctctgtcacccatactggagtacgaaacatgatgaaaccccatctctactaaaagtacaaaaatcagccgggtgttgtggctcaggcctgtaatcccagctactcgggaggctgaggcaggagaattgcttgaacctgggaggcagaggttgcagtgagccaagatcataccgttgcattgcagcctgggagagccagccagccggccaagccagccagccagccaagccagcgaagccagccaagacggccaagccagccagcaagccaagccacccagccagccagacagccaacccagccaagccatccaagccaggcaaggaagccagcgagccaagccagccaagccagcgaggcagtcaccaagccggccacgccagcctgtcacccaagccggccaagccagccagccatctaagccagacaagccacccagccagccaaccagccaagccagccagccagccaagccacccagccagccaagccagccaagccagccagccagccaagtcagccaggccacccagccagtcaggccggccaagccacccagccagccagaaagccaacccagtcaagccagccaagccagccaatccagccaaggaagccagcgagccaagccagccaagacagctagccagtcacccagccagccaagccagccaagccagccagccagaaaagccaaccaagcaaccccgccagcgaagccagccaagccacccagcaagccaagccagccaagccagccaagccagccagccagccaagccagccaagccagccagccagcaaagccagccaagccagccaggccacccagccagccagccagccaaggcagccaagccagccagctaggccagccagccagccggccaagccagccaagccagccagccagccaagccaggcaagccagccaagccagccagccagccaagccagccggcctaccagccagccaagtggccagagagccaaggcagccaagtcagccagccacccaagctaggcaagacacccagccagccaagccagccaagccacccagccagccaacagccaagccagccagccagccaagccacccaagacagccagccagccaagccagccaagccacccagccgtccaagccagccaagccacccagccagccaacgagctaagccagccagccaagccagccagccagccaagcccgccaagccacccagccagccaagccagccagccagcgaagccagtcaagccagccggcctcccaatccagccaagccagcaagccacccaagccagccaagccagccagccacctaagccagccaagccagccagccagacaagtaagccagacagccatccagccaagcctgtcaagccaggcagccaggcaaggcagccaagccagccagccagccaagccagccaagccacccagccacccaaggcagccaagctgcccaaacagccaagccagcaaagccacccagccaaccaagccagccagccacccagccagccaggccagccagccagccagccagccagccaagccagccaagccagccaggccacccagccagccagacagccaagccagccaagccagccagccagtgaagccagccaagccagccaagccagccagccagccaagacagccaagccagccaagccagccaagccagccagccagccaagccagccaagccagccaagacagccagccagccaagacagccagccagccaagccagccaagccagccaagacagccagccagccaagccagccagccagccaagccagccaagacagccagccagccaagccagccagccggccaagccagccagccagccagccagccaacccagcctgtcaagccagccagccaagccagccaagccagccagacagccaagccagccaagccaggcagccagccacgtgagccagccagccaagccagccagctggccaagacagccaagccactcagccagccaagccagcccagccagcccagccacccagccagccaagccactcagccagccaagccagcccagccacccagccagccaagccacccttccagccaagccagccaagaaagcctgccagccaagccagccaagccagccagcaagccaagccagccaagccagcaagccagccaagccaaccggccagccagccagccaagccagacaagccagccagacagccaagccagccaagccaggcagccagccaagtgagccagccagccaagccagccaagccagccaagccacccagccgggcaagccagccaagccacacagccagccaagccaaccacgccagccagcaagccaagccagccaagccagccagccaaccaagccagccaagcaagccacccagccaagccagccaacccagagagccagccaatccagcctagacagccaagcaagccagccagtcatgccagccaagccagccaagtcagccagccagccaagccagccaagccagccagccagccagccagccaatccagccagccacccaagccagccaagccacccagccagccagccagccaagccagccaagccactcagccaggcaagccagccaagccacccagacagccaagccagccaagccagccaaagaagccagcgagtcaagccagccaagccagccagtcacccaagccagccaagctagccagtcaccaaagccagccaagtcacccagccaggcaagccagccaagccacccagacagccaagccagccaagccagccaaagaagccagcgagtcaagccagccaagtcagccagccacctaagccagccaagccagccagccactcaagccagccaagccagccagccagccaagccagccaagccagccagccactcaagccagccaagccagccagccagacaagccagccaagccagccaaccagccaagccagccaagccagcaagccagccaagccagccaagccagccagacagccaagccaaccaagccagccaggccacccagccagccagccagcgaagccagccaaaccagccagcaagccaagccagccaagtcacccagccagccagacaagccagccaagccacccagccagccagccagccaagccagccaagccacccagccagccaagccagccaagccagccagccactgaagccagccaagccacccagccagccaagccagccaagccagccaaccagccaagcgagccaagccagccaagccagccagccaaccaagccagccaagtcagccaagccagccaagccagctaagccagcccgccaatgaagccagccaagccagccaagccacccggcgagccaagccagccaagccacccggcaagccaagccagcccagccagccaagccagccagccagccaagccagccaaaccagccaaaccagccagccagccaaaggcaaccaagccagccaccaagccaagccagccagccagccagccaaccaagccacccaagccagccagccagccaagccacccaagccagccagccagccagccaagccacccaagccagccagccagccaagccacccaagccagccagccagccaagccacacaagccagccagccagccaagccagccaagccacccagccagccaagccacccagccagccaagccagccaagccacccagccagccaagctagccaagccacgcagccagccaaggcagccagccacccagctagccaagccagccaagccagccagccgaccaagccagccatttggctaaaccacagaagccagccagccagccaagccagccaagccagccaagccacccagggagccaaccagccaagccagccagccagccaagccagccaagccacccagccagccagccagccaagcccaccaagccacccagccagccaagccagccaagccacccagtcagccagccagccaagccagccaagccagccagccagatccagaggcgtccttggcctggggaccgggtggatttgacgcttgcacagggagagattgccccatgcagatgagccatgtagggggctcgggccctagggacccagcctctgggccaggggttggcctgcccaggcctgctggtgtctcagctggtggccgagagccataaggcaggcattgtcctccacaaggtcagctttgccgctaacttcctgttctcgttaataacctgatgcaaggaattctattgcaattgtttatgtgtctctccgagaaggctgtgagcaacacagtatcccgagctcctggtctgatgcctgacacacagtaggtgtttaataaatgattcttcagtgcataagtgaaagaaaacatgggtgaagttagcatggtcaggaccattgcaactgccttctgactggtctccttgcttctccttagtctccaggcagcagttggagtgatacagtaatgggaatcaccacactcttccttctctggccaggtgcagccccagattggtgcttccagggagcccttgatgccttggtgaggggtgtgggcttggaagctgggcacttacagctgtgggttgttgccactgttggagtagcggaggcatcgagccccctcccgattttccagcatgactagtggtgacaatattgggtctcaatgggtctctcctgcctccagtccagtgcccttttttggggaccattattggcttttggggaccctgaaggaggaatggcctgattatgcaatttggctggagtggaacgtccccatgacgacatggcaatgagtcttccccagcaggcagatgccagatgcagtggtgaccacacctgccatctgggaggattccaggtgagtccctggtgtggggactggggtgggctctccatcctcctatccctgggacaagtgtgtgggggacagcaggggccaccaggagccacgctagatgggcccagcctcaccaggtctactctgggaccggctgggccccaggggggctgtgatctttcacggccatgatgttaggagagagacaaggaccaaggatggtgattccttcccaaagggccacagccatccagtaaggccgagcagggaggagctgagaaaggcagcctccctcctttctgcctctctccaccatcagcatcagctctgttgcccaaggtggtcgccctctgcaggggctggggcttgtaaggcaaccccccccacccccacctggcggtgcttgctctccgattcctgggacctgcctgaccttgactgcagcagggttttatgagtggcctcaccactttaccaattgctgttgccttttattacttctcaggggctttatctcagcggccgccttacctcctggctaaatgaggattaattttttaacaggattatgtgctgtgggttagctgtactctctggggacggccaggcgctccgctccctcttagcccctccctctccccaggccccccttgctggtttgctgggagcaggggctacatgtgggggccccaggagctgggggctgcatcattccagactctgggatgggggtggggtggcgagggccagacctggactctgggtggtgatgtccttgggcagggcctgccctgcagggtgaagttcctttagaggtttcagccacttcttgaaggacaccagacttggccactgagcagctgggagtggggagagatggagcaggagcaggagcaggagcaggatcagggggacatggggagagagaggatgggggccaccttgccaagcccacctgccccggtatctcagagcagcacagcctgaacatggccagcatcagactttcttggtccttctggaacacaatttcaattttccaccaaagtttgataaaggtgagcctgttctcacccctcctgtgtctatcgcctggaggacaaaacccaggatcccacctccagctctccatgccaccatctccttcacaaaccagagggaggcctccttctttgcccatcaggaaagcctctgtgtcagtccagggtgggcctccagacaccagtctagggggcttctccctgttgccccaggcagagctgaggcccttgtggcttctcttgtgattcttctgttgggcctcctgtcccctctggagttatgaatttgtgggtgtgcttacctgcctgctgtgggcccctgaaagggacatattgatactgcattcatatctaggcgcgtgggaggtgccaagcctgtttatggaaggagtgatgaatggatggctgaatgaacaaatgaagggatgaatgcatgagggaggaagggaggaggtcattggctccctgaaggggcccagggctgacttgttcacagctccctcttcccttggctgagcccagggcaggctggcagctgtaggcctgggatgttggcccagcagcctcgtgggcagctgggttgatggggtgaggtcctggccagaggggaaactgtcccttttcgggtctggcttctcctccagagttcctgctctgcaggtatgtgcagacctggcttagctgatgtaatgaatgaccacaaactgagtggcttcaagcagcagtcatgcattctggtggcctgggcatccttggcttgtggctgcatccctcctgctcagccaccattctcaagaggccttctctgtgtctgtccctatgactcctataaggacaccagcccttggatgtagggcctgcctgaataacccagaatgacctcatctcctcatccttcacttaattccatctgcaaaggccctccatccaaaaaaggccgtattcacacattctgggaattaggacagggtcatatcttttggggggaccacgcttcaacccataaaatacccatatgcttgacgacccaccttcctcctctctaggagcctctgtgctcacacctagaaattccgggtgtgagtctatgcccctctgtgaccatcctgtgtcctggttgtttgtttttgtttcttgagatggagtctcactcagtcgcccaggctagagtgcagtggcatgatcttggctcactgccagctccacctcccgggttcacaccattctcctgcctcagcctcctgagcagctggcactatagatgcctgccaccacactcggctaattttttgtatttttagtagagatggggcttcaccgtgttagccgatggtcacaatctcctgatctcatgatccacccgcctcggcctcccaaattgctgggattacaggcatgagccaccgtgcccggcctgtcctgtgttttttttacatttattttttgagacaggatctcactctgtcacccaggctggagtacagtggtgagatcgtggctcactgtgtagcctcgacctcctgggctcaagccatcctcccatctcagcctcctgagtagctgagaccacaggtgtgtaccaccacgcccagctaatttttaaaatgtattcgtagagacagggtctccctatgttgctcaggctggtcttgtactcctaggttcaagggatcctcctgcctcagcctctcaaaatgttgggattacaggcatgcctggcgtgtcccttgtttatttgttcatgtataccactcctgggtatacgcccaagagaactggaagcagggtctcaaagagatacttgcacacaggtgttcatagcagcttattcacaaaagcaaaaatgtggcaacaggccaggcgtggtggctcatgcctgtaatcccagcattttgggaggctgaggagggtggatcacctgaggccaggagttcgagaccagcctgaccaatatggtgaaaccctgtctctactaaaaatacaaaaattagctgggcatgatggcaggcgcctgtagtcccagctactcgtgaggctgaggcagaagaatcacttgaacccaggaggcggaggttgcagtgagccgagatggcaccactgcactccagcctgggcaacatagtgagactgtatcacaaaaaaaaaaaaaaaaaaaaaaaggcatttagtatgcctaaccgcctgccagctcagcccagctgacctcagatgtgctcaagacactcccattagcctctaggtaggcaaaatcagctcacacaaagcttttttttttttttttttttttttttcaggcagactctcactctgctgcccaggctagagtgcagtggtgtgattatagctcactgcagcttcaaacccctgggcttaaatgatcctcctacctcagcaacccaagaagctgggacaacaggtatgtgccaccacgcctggctaatttaaaaaaaggtttgttatgttttgtagaaatggggtctcgccatgttgccaaggctggtcttgaactcctgggctcaagccatcctcctgctttggtctcctaaaatgctgggattacaggcgtgaaccactgtccccagctcatgaagctagttttctaatcaggtgttgattttcttgtgcaatttgtcgaatactgtactgaaagtgaacatggttgtgtgggacttaagtgccgttgctactgagttctggccacattcttaccatcgtggagtcggggcccgtcggtggagccatcctaataaggcagggccatctgtgtaggaatctgctgtttgcagagatttttgttggtgatcaccaggcttggactctgagaaccttggaggaacccagtgggtagcacacaatgcggagtgggacgttcactggaccagggaggtcgggccgtggttaggaacctgggggaggaagagctgagggggttggggatctgagcttttctcagtggctcagccacgaccctgggctacccctgccccaggcctccctcctgtgcctgtgagctggggatgatcattagtgtcccctcccccagcatgtagggctgtgccaggcacaaggaggaggcttgcggcattcccactgaggacagactacccgggaaagcactcggacagcctcagggaagatgagggtgggtccaggagatgccaagggcaggcccttgggcaggtttttcaacagtgcctctgccccaccacccctgtgcccttgcctgtcaccacagggtctcggagaggagagccatgtggctcagcatggccaggggcaggctagactgtcctgctgcagaggacccactggggcccagtgggacagccctccccctccccctgggactccatggcctgtgctgtcctcctgcccaagaagcttccctctgaggcatctcgggtccgggtccgtcctgctcacccagggccaggagcccccaggaggcccacggtaagaaggagcgcaagacataaacaatttccccctcctctgccgaaggctctggtgtcagcgtgctttgcctgcagtggcctttccccggggcagcgagggcctgagtgggcgcctcccccaacgcctcctgggtgtcagccccagactgccccacggctccacccctgttcagagccactcagcccctgggaaaggtggctgggtcatgagttggggatatgagggggatcagtgcctgctagttggtgccagaaaaccacctttgctggacttggcattgagggttggcaagggggcctcggagacactctcctccctcctacctgtacccccagggtacccgtggtcactcagttcctgactgcctgctttgggttgggatcccaggacccaccctctcctggcttctgctgagccatgccctccgcggtgggggggtcccctgcctgatgccacggccttgcgagtgtcactcagagcccctgctgcacggagccgtgctgtgggtttcttttcctgtgtggacctgcagagaagctgccttgtcactgtcccctcattgctggggtataaatcctcattgtcactatcttcttggccctctgccaccagctgtggactctggggacactcaggactcaggcctggaattttccccaaggtttttcctaggtgcattggtgtaaacagggtcccctcttgccccagaggctgagctcccatgggcagggggagagtgggagcagttgtctgagggccaggctgcgggaacagggtctggggtttcctgtggaaatgctgaagagtgcccgcccctgccctggctccggccagcatctggtcaccctggcgggcagggagtggcagctgcagaacgcatgaaagtggtgggtggggtgggagtggctggtgctgactttgtccaaaggccagaggtgcggtggggcccctgacaccatgtggctaagggcttctccattcaccaggactgttctcacagagtctttccagagaggctgcaaagggcctcttatctccaaaaacgtctattttataggcacctggatgtctactgtgtcctgatacagaggagaggacatgcaatgggagataacgtggctacctttggccatgtcgggtggataagagatggccaacaggtcactgcagggcctgctcccccttacttaccccatcaggggacaggatctcgtgtgtgtgtgtgtgtgtgtgtgtgtgtgtgtgtgtgtgtgtgtgtgtgtgtgtcaaggaggggtatccctctggtgcagtccttgatggtttcctcaccttgatgttggtcccatggccatcggtgttggcctcaccatcaccactttcagtctctgaacagcaacaggctccactgagcaggtgcccagtgacacctggtgcgttggagggtggggctgagccctggtgagccaggacctgctgaaagatcagggggaagagaatagacccccctccaccagccctggggacccacaaaggaacattcaggccgccccagtttgagccatgagttgtgtccacggcagcctcgcttcctttgctgggccttggcagcgataacgcctgaatctgtgcaggtctcaggtgagccttctccagctcagcctctgtcgcctcacaggacgcctcggttcccgggcattgattcagcacctgctgtgtgaagggaaaccagagaggccagtccttgctcctgaggactcaagggtctggatgtggggggaaacccacaccccacaatgctcccagacgatggacgcagcgcaaggtctaggctcactccaggaatgtggggcacagggcccagagcccatttggatgaggaggcgccgtgccctccgtgggctggagggacagggggcctttggtggccggtgaaagcgttttgccagctgagaatattctttttgctggccgcgtctaatctggtttctggggaagataggaggaggctacatcagcagatgcctgtcaccatggactaagagctggctcagggaatccaattccagctcagaacccggggcccaaggagccgcttgaggctgtggctctgtctctttttggactcgagggactctgaccatggttgtggactctccctagaaaacatgcacacatagcaatttgctgacctgtcctgggagctcaagggaggcccaaggcagtggggctggggggcagggagcagaggggcagggtcggggccaggggaaagagagagcatggggggggcggtcctgtccccttgaggctgccatgcaggggctggctgcattccaaagctggaggaacagctctgccttgcagggaattagcacagtctgcctgtccggctgcttcaccatgggttgcccccgtgccattgaggatggtgatgggggaggaagggtggtgatgagggagggagggtcttgatgtaccacctgcccccagatggccaaggtgaccctccccagcgtccccaagcttcgcaggcatgtaggggagcctcggagggcacatctgtttgctgttcctgctgttacacgtgaccacaaacttagtggtctaaaacaatgcaaatgtatttattttttcctcttttttcccccatgtaggacaggtaatgtgccactgttctaaagaggttgcacgtcccacgcaagagtgtgaaaaccccctcatcacacatatcagccacagaaggatcaaaacaatgccaatttattattttagagttctgggggtcagaagtcccacggggccgcactgggctaaagccacggtgtcagcagggctggctccttctggaggctgggggcagatgcatctcctggcctttcccggcttctgaaggccaccacgttctgggcctcagtcccaggctggggcatcaccacacccactgcttttgcaccaggtctgctctcacccccgcctctcgctcacaggggcccttgtcatgccactgggttcacctgcatgatgccggggagcctcccatcgcaggaccctcggtcacactggcaatgtcccttttgccatgaaaagtagcccattcacagtcccgggattaggatgtgggccttttggggggcaccattctgcccactgtggagggtgtgcaggagtgaccagacctcagggaggctctcaaattgacctcatccccagcacaaagtccaggagggatggcatgaggtgtccaggatgctggagcttggtgggggctggacagggactctgctcaggcacccagccccagtgtgaggggcccatggctgcgggcgcaggagccacaagggagaaatgatggccccatagactttccttccccaaactcggatcccctgaaacagagaggtgaggcttaggggtgaagggcgagcaacttctgcaataagatttccatgatgcctgaccatgtctgtaagagaaaggctatgtctttctttatttttgtttatttattttttgagacagagtcttgctctgtcacccgggctggagtgcagtgggttgatcatagcccactgcagcctcaacgttccagcctcaagcaatcctctctcctaggcctcccaagtagctgggactacaggcatgtgtcttgggaggcaattttttttttttttttaagagacgagggtctcaccatgttgcccaggctggtctcgaactcctggcctcaggcaatcctcctgccttgatatcccaaagttctgggattacaggcatgagccagcatgcctagtctcttttcaaaaaaaaaatttttttttttgagtcacagtttcactctttttgcccaggctggagtacaatggtgccgtcttgactcactgaaacctccgccttccaggttcaagcaattctcctgcttcagcctcctgagtagctgggattatggcgcctgccaccacatccggcttattttgcacttatttttatttttagtagagatgtggttttacgacgttggccaggcagatcttgaactcctgacctcaggtgatctgctcgcctcggcctcccaaagtgctgggattacaggcgtgagtcaccgtgcctagcctcaaaattttttaatgtaacttttcaaataaactcacacatgtgatcagtgatcaccacacatgctttatcgataattgccacacttgtttcatgcattgctgttgtctttctctttccttttcccctttggctgaagcatcttccatcctgtagcaaatgttctgaaattttgttcctatgaacttcaggttgcaaggcgccaagtatgggaaactctggaacacacttgcggctcccttagggcaatgttcaaattaacagtcattccttggcacctgctcaggccccatccggaatcacattcccctgattgtttgcttacatccatcagatggaacacataggttcctaacaaggcccacagtttcagttttgtggtggcgcctcttgaacctctcttactctagatcaggcgccgcccctgacccccactgctcctcccaccacttgtgatttgttgcagaaaccagatcagctgtcctgcaaatgtgtcgcctatcacgcagctgtttgcctctctgtggtgtcgcctcgccccatgtctcctgcaaatggaagctgtgctgcagaaatgcccttagattcaggctcatctttctttgccagaagccttcgtgggcagagctgtgagagccacatggaagcacctgtgatgctaagtgtgccccgtgggtccaggtggccagagcccgaacccaccctgtgatgcaaagtgtgcccagtgggtccaggtggccatagccctgacctaccctgtaatgctaagtgtgccccgtgggtccaagtggccacagcccgaacccaccctgtgatgctaagtgtggccagtaggtccaggtggtcatagcctgaacccaccctgtgatgcccttgttttgtcattactgatctcatccatgacccttgcgagaaataattatgtcatgagaggtggcaaaattgtggtttctctcatgatctcatctcttcacaatgagtagctgaaattcttctatcaaaaacaacaacaacaaaaatggctgggcacagtggctcacacttgtaatcccagagcttttgtgggccaaggtgagagaggccaggagcttgaatccagcctgggcaacaagaccccatctctacaaaaacataaaacattagccaggtatggtggtgcgtgcctgtagtcttagctactcaggggctaaggcagaaggatcctttgagcccaagaagttaaggctgcagcgggctgtgattacaccactgcacttcagcctgggtgatgcagcgagaccctgtctcttaaataaaacaaacaggctgggtgtggtggcttacacctgtaatcccaccactttgagaggccgaggtgggtggatcacctgaggtcaggagtttgagaccagcctggccaacatggtgaaaccccatctctactaaaaatacaaaaaattagcagggcctggttgtgggcgcctgtaatctcagctactcaggagtctgaggcaggagaatcacttgaacccacgaggcagaggctgcagtgagccgaggttgtgccattgcactccagcctgggcaacagagcaagactccgtctcaaaaaaaaagaaaccaaccaaacaaaacccaaaaaaacttgctgttgtccactagagttattgagttaccctgaaatatagtttaaaagggaaattcttaattcttttcttttaattgacaatgttccgaatagagagttggagccttgtttttccagtggactaccgatgggttttggtttggtttctctctttaaatctatttatagcttttgtgtattcattgtgtattcagcaattacacacaatgaatacacaaaaaattacacaaccaatacacaaaaggtataggcagatttaaaaagcaagataccaaggcttgattttaggctcgatttgtcccctctttagccagggatttctaatttttttcacctcaaaagtggtaggccagggtgctgtcccatcagtggtgggaggaaaggttggttgccccggacagtgggtgaatgccggggtgccagtgtcagggaggggaggggctggtgggtgaatgccagaatgccagtgtcagggatggaggggctggtgggtgaatgccagggtgccagtgtcagggacagaggggctgctgggtgaatgccttggtgccagtgtcagggacggaggggcttgttgaagagaaactctttcttcagggccattgatttccctgccttgtttgaagtgcctggattgggctctctgaaaaccaacaccatcttattagaagacaagggcttcttctcttttctttctttctttcttttttttttgagacagagtttcactcttgttgcccaggctggagtgcaatggcgtgatctcggctcactgcaacttctgcctccccggttcaagcggttctcctgcctcagcctcctaagtacctgggattacaggcgcccgccaccacacctggctaacttttgtattttttagtagagacggggtttctccatgttggtcaggctggtctggaactcccgacctcaggtaatccgcctgcctcagcctcccaaagtgtcaggattacaggcgtgagctactgtgcccggccttttcttctctttctttagagacagggtctctctctgtcaccctaactggagtgcggtggcatgatcacgactcactgcagcctcgacctcctgggttcaagcgatcctcccatctcagcgtcctgaatatctgggacgaccgcacctcactaatatgtgtgtgtgtgtgtgtgtgtgtgtgtgtgtgtgtgtgtgtgtgtgtgtgtgttttgcagagatgaggtctccccatgttgcacaggcctggcaggtgtttctgatagtcacaaagcccctgctactggggaaagggaaaggaagccccagctaagacccaattaagaaaatcccagaaccaagaacgaatcgactgttcggctttggtaatctccaatgtgtccaccaggtggtgctgtccagccacaaatctcccaggtttgatctcgggcttctgccgagggcacctccagggctggggtctcatcgtgttgtccccactttattccaacgtccaccccaggcctgggggagcccagggaggaccgagtttcctgggccccgcagggtgcacagaggtgagtttggtagtgcggtcccgacctcgacaagcatcccagcgaagcaggctgagcgcccggctggctccctcaggacccctcctccgggccttcgccctgttgatttgggtgttttaatgcaagaaagtaggacactggttgtcacctgcctgctcctacaaggaaaatgcatgtttgtgtggttatccgtggccacccccaccagggcctgcggggggtccagtgcagtggaggtggggaggcgactcatgggctccaggatccgtggagagtgagtgtcagcgggagggtgtcccctgacctcggtcaatggaagctgctcttcctgggggtcccacgggaggcccgtgatgggggtgggggaggaggggtaaacgccaggccctgattggccgcctgtccttgggtcttggctggtcctaagagggaacggggagcacagctggggtcacagcctcagccgggactcctgccctccagcccctcagcatcctccctgcgtgtgctctcctgggggctgctcagggcaggtggcgagtaggggagctgtgggaccagagagagggggtggacgtgcccagggcctgccctcttggcctgccgtggagacccacccaggcatacctgggggctgaccctcccctgcagagagcagggtgaaccccagccctgccctcgcctaagagccaggttcgaggggagtgtaatttataatgaaccccactcctccccccaacacccaccacagggaggagccagcctctctcctggcaccaaagtcacgctcctgaccctgcaggccacaggatgaggaggacccagagaggcagcggggttggggcatttcataagccggcgagagctgcccgtgtgcatcctcaggcctcacagtggagtgaggggcgggggccgcctgcgtcctccacaggagctcctgtcattccacctctgggggtgcacttgccgacttgccccagacctggactcaggctgcgctgctgtctgcccagggcctggcgattgctgcgcccatggtgggtcccacaggcaggccctgccctcccatcgctggcttctgagcaggggctttggggctgctggaccttggaggcagatcgggggcttctggtgtccctatgtcttgggggcctggtgtcctgagggccagcgccccccggcctgcactgggaccctccatggaagcaactcctctttcatctcaggcactgggtgtcccagggccagggaaggggctgcgcagcacctcaggagcccagaagagctgccagccaaggaggaggagctggggggagcagaggcctggaccagctgggatgttcccatccgcgtgtccctcccgcccaggccacatgggcaggggaggaagaggggaggaggaggggaggggcccttgtcctcccagagcctctcccttcctctcccttcctctcctccctctccctctgctcatctcatcatgagacagctggcgaggcccttcggctgccctggagtgcccctgccctggccaagctcttgctgcccccttctcctggaggtgccagatggggcgggcccaaagcagcagaggtctgggccctggctccagctctgtcccctcccgagggccctggaggagctaggaggagggcctagcagggccgggcagatcgtgggccgggagaaggggttgcctggggagacggaccgactagcaggacagatggtgggccaggcaggggtccggagcccgccccatctgctccagtccctggtgggacttttcttgtccacctcgggctgaactgggatgggctgcgtgggtggctgtggcccaggccggattctgtcacactgggtcctctgtccctggggcacggccagccgggtgctcatctggggtcttgaagccccctcctggcagctggcacgtggctggaggtcatcatgtttcgggggctcctgagggtctgcgggccatgcctgagcagagcctggggcgcgtcccgggaacgaagccgccgctgcagatgaggggctttgtaggtgggtgggcgactgaagccccctggaggggcttcctggggtccaacgccgagagggtccgggacaagaagatgctcagtcacgtgtttgtgctgcaggtgcacccccagcccaggcgacatcaacggccagccccatacgcgtgaggattgcggcaccaggggcgctcaggattgggccgggctgcttctcagaagaggggacattgagcccaagcaggctgcactcctgcttggacggaaggtgcatgggtggggagggtaatcacaccaatagagacatggatggacttgtgcagaacataaatactctctttgcttatgtctatgttactcaaaggaaccatggaaataacaaattcccaattacaatgcagtaaactttaagaggagcagagtgagcttcgctcttttatggttggtgtatttccaaaaaacactttcttcttctttcccaattctttttctagtttctcctaaattggtgtttctttagatggaagccgtgtctcagaccataaaacactaaacctatttgaagcacttacgttaattattctattcataaaatctaggttgatccatctcatagcaaaatccgttagtataattttaccttcttctttttaaaaagccaacaaactataagtggtgcttctatgtagaaatatataagtagaactgagtttttacttatagaacttatatcaaatgatgataagcaaagtatttttattctataacctggatttaaaaatatataatctctgcaatatatattaaagaaactataattaattttaagaagtcaaatggggaaaaaaacaaaacaaaatgttccatccttagacagatgacctataatttattttatttgattcaagctatatctttaaatagtagtatcaggatcacaagtcattttgaaatgtcataaaaatgttccaagtttgtgttttaaaggaccttagagggactatttgtggttttgtactttctttgttcagtgatccacttgcaggttattctgaacctccttgggaaaagatgaaagtaggatggcattttggaaatgattcttcattctgaaacctccttgagtgatagactagatgaagtatagttatatatttggcagtagaaagcaatctctcctgtcaaatttcccattcatttttatttctggatttattctttctacttttgctcaaataccaacacataaagagtgtccacagatataggctctaataatgcactgtgggaatttaacacattttaaaagactgaaggatagtaagaagagagtttttaacagattccttatggagggaaaagaatattgctagatgaaacaaaaatggaaaaaaatcttttattgatagatatagcttatattttcttcctttactcctaattgaattgtgaatgttttattatcaaaattcacaaaattttgatagaatgtgccaaatatttcctgagttacaatttctcatttagaaacatttgctttaaattctcatacatatccaaaactgttctgttcattttcctgttgactactttttctaccttgacttgagatactccagaagagatatccttgttgttaacaagaaaataagctaatataaaagggataaattaaagttagattataggccatatactaagaactaaaaaattgagtttggtggaaacataaagattatgtagttaaatgctcacaattttcccttatatcactaaataaacaaaataaaaatattacaaagggttaaaaaaacagaaaagatgcctgcaacatttttagtcagatacatattcgcatagatatttccatatattcatagaaatatttagcaccatttctttgaaaataagaaagtataaaggaagaaattgattttgacattatcctagagagtttaaatggatcctaaccaaatacagacacaagtcaaacaacactgaccatccaagcattttacactgatcaagataatgcaaaaaggttgaacttatgacaaatacagaaataagaaatttgtgttattttttaaagaaataaactgtctgtgattaacctttttcccatttatgaaacttaaatgacatatcatttgtttgtaaactgcaggcagggtgtttaattatataaaaatgaaacacattctgtctttatggagtttatggaaaaaaggtaatacagattaatttagggtaaagttttaaaaattaatcattaatattggagaaacaaggatcaaaaacatctaagtaagctgtagctcaaataagaaggcatagacccatttcttcctgctccctctcactaggcacaaccttaagcactgcaaatggtacaaaaagcaaataaaggagaactctgcaggtggtaaaaatagaagagctggtgtggggacccaggatttgagcaacaacacaacatcaagatgccttgtgtcctcccacctgagaggaaggccatccatatccagtacttctttcccccatgacatagtagcagaaggcagcccagataggcccattgtttctccagatcaaacagtagcccccagcatagcaccagctgaacttaagacatgagagtgcatctcctcacccacctgtcctgagacttcttttttctaccaagagatacttaggctacaagacaaagagcctgcaggagagactgaacaataccaggcaacttagtaggtcatggaagcctctttgtcctcataggactgagattctccattcttgatcagatgtattagaccatttcatgctgctataatagaataccactgactgtaatgtataatgaacagaaatttatttgcagcaggagccaatccttctcatcaaatttcacattcatttttatttctagatttattctttcaacttttgcttaaatgtccacatttaaagagtgtccacagatacaatataggctctagtgatgcattgtggaaatttaatacgtagtgaaacactcaaggatagtacaaagaaagctctcttatttttactaccttcagggttctcctctatatttgtcttttcactacttctaatgcttaaggttgtgtctcgtgagagacagcaagaagaaatgggtctatgccttcttgtccgaaccacgtttcatttagatgtttttgatccttgtgtcttttatactaatgatgataaaagaatcaatcaactagacataaaaattctaaatatgtaccgaccacgagagcgtattcgcaaaataacatgaaacaaaaactgataaagagttgaaagcagagattcactactgtaattgcagactccaacactgataataatgatagaattattagaaaatcagcaatgacctgcaatatctagaatatatgcacattcagctaagaagatctaactgccacataaaaacactccgctcaattacagcagaacacacaatttttttcagaccttcatggaatactcatcaagatagatcatagacataagtagacattaatcaagcctcaacaaacttaaaaaaatagtttaaattgtgttatgtattttttgtgataccaaactagaaataaataacaaaacaagaggaatctgagaacatgtgggaaataacgtatttttaaatgatccatgggtcaaaaaggaagtctcaaataatttaaaaacaaatacatagatgtgaatgatttaaaagatacaaaatattatgtcagatagaactaaagaagcgattagagaaaaactgatagcagtgcaggcttacattaaaaatgagaggtctcaagttgataatctacatttctattaacaaaagtagaaacagaagagcaaaataagctcaaaacaaaaagaaaaaataataaaaaatcaaagcagaaatcaataaaattgagaacagaaaagcaataaagaaaattaatataaccaaatatctttcaaatatgtttatcaataaaattaataaaactccaaaaatactaaacaaaagtaacaaaaagacagctattgctcatgtcaaaattaaagtaagaaataacgctcttgattctgtagcttttaaaaagataaagagaataatacgaacaacttcatgcttatagtttcatcaacttaaacggactaattttttgaaaacacaaactatcaaaaattaccaagataaaattaacaatctaaaatagctctatttcaatcaaatcaattattaattaaaaggtcctgaaaaataaaattcctggctgaaatagtttcaccggagaatagtaataaacatttaagaagtaattattactaaatttatacaagctttaccagaaaatagaaatgaattgaaaatttcctaactattcttatgaagtattacaccaatacccaagccagtgtacaaaaaagaaaataattgattagtattcctcgcaaatatagatataaaaatcattaacaaaatattatgaaataaaactcaataatatataaaaataactacacacatgaccaagtgtgtttattccagcaatacaaggatggttcaacattacaaaatcagtcattgcaatgaacaatatcaacaggctaaagaagaaaaatcagatgatcatatcaattgatgcataaaattaattcagcaaaaaataaatatatataataaaaaactcttagaaaattaggaatagaggaagaccttctccaaattttaaagaacaggtaaaaaccctacagctaagattatacttgatgatgaaaaacatcctaaaatccttcctaaaatcaggaataaggtgctatagtttggatatatgtccctgccaaatctcatgttgaaatgtaatccccagtgttggaggtggggcctggtgagaggtatcggggtcatgggagcagatccctgatgtcttggtgctgtcctcaggttagtaggtgagttctcatgagatctggttgttttaaagtttgtggcacctccttccactctctctttggccacatgaccatggccatgtgattctgctttggccatgtgacatacctcctcccgcttctcagggagtaaaatctccctgagagacccccaaagctgagcagttgccagtgccgtgtttcctgtacagcctgaagaaccgtgagccaattaaacctcttttctttataaattactcattctcgagtatttctttgtagcaacataagaacagcttagcacacaaggtaaagatgactactcttacttctcttctcaacatagttctggaagtcctcaactagcacaataatgaaaagaaaggaaacaaaaggtatacagacaagaaaggaaaaagtaaaatttttttctatttgctgataacatgattgtctgtgttgaaaatcctaaaggatctatcaaaaaacagagctaatataaatgatgccaacaaggtcacaagatacaagataagcataacacaatcaatttttcattctagataccagaatgtgcccatgaacactgaaattaaaaacacaatgccattcacaacactcaaaaatgaattatttaactataaatctaacaaaactgtgcaagacttttatgctgaaaaatatacaacaatgatgaaataaattaaaaatcctaaataagtggaaagacattgtgttcatggattggaagaaacagtatagtaatgatgctaattttttctaaatcaatgcacaggttcaatgtaattcttatccaaaatagcccacttttgtataaatatagaattatcactgtaaaatttacatgcaatgcccagggaactaaactagctaaaacaatttcaaaaaggaaaaataaaaaggaatgaattattgtatctgatttcaagacttattatctacatacattaattaatattatgtggtactgacacataagccaatggaacaaggtagagggcctggaaacagacccataaaatatacctaacacacttttgagcaagatgcaagaactaaactgaaaaatgttcttttcaggaaatggtcctgcggcaattgtatatgcatagaccaaaaggaaaaaaaaaacaaaagaaaaataatctcagcctacatttcatataacatacaaaaattaagtcaaaataaattatatccttaaatgtaaatatatagctaaaaaacatgtttaaactaaaagaaaacaaatcttcaggatctacaggaaagctacaatttctcagacttgacatcaaaagcacaatacataaaataaaaaaattataaactataaactttctcttagtgaaaaccggtgtgcaaaggataaacagaccaaggtacgtatttggagaaaacatttaaaattatatatctgaggaaggactagtatttagaacataaaaaagacctctctaacctcaacaaaacaaaactatacagattgcaaaaggtcttgtaaaaatgaactcgaaaaaccaattagaatatgggcaaaagacataaagagacatttcagtgaataggatatgcagatggaaaacaagcatcatatcaacatcattcatcaccagaaaattgcaaattaaaaccacagtgatatattattacctaatactacaaatctattacaatggcaaaaattaacaaaaaagtgacagcagcaaatattgccatttctgtagaaaaactaaatcactcatatatttcctgtgaaaatgtaaaatgatacagccgctatagaaaacagcttggagcttggtaataaaaaaggtatacaactattattcaacctagcaaattgtactcttgtgaatttctccaagagtggggagaaagctctgttcacaaaagcctattcaacaaatatttatagcagatgtattcataatagccaaaacctttgctcaatcaagatgtacttcagtaggtgaatggtcaaacaaatggcagtacatatgcaccatggaatactacttaacaattaaaaggaatagatcatttatgtacatatcaacttaggcaagtctccagagaatcacacaaagtaaaaaaatactaaccccaaagtttatattctgtattgttctattcatgatgaaattttagaaatagaggataagtttagtggcaacatttaaaatgagtgggagaaatggtgggaggtgtgtatggttatcaaagaatagaaaggatcctgacgttgttagtgtttagcatttttactcctatttgtggataaacacacctactcatcttaaaattgtatcagatttaatacacacatatatgtgtgtaagtaaaactgggtaagtctgaattagatcaatggattttattgatattaatatcctggttatgctattatgctatggttacgcaaaatgtcaccattaggggaaactggatgaagtatacaagggatctctctgtatcgttccttctatcacgtgtgaatctacaataatctcaattaacaaatatgctgctcataagtgagagaggttcatatgccaaatatttccagaaaaaaaagtactaaattcatgatactataaggtttaaacaacgaaataatttataattacataggaaagaggattttttaaatttaaaactcatcaggatctggcattttcacaaggaaaaaggagtaaaattagctgtactaagtatgaagtcagatgtgaactatgattatgacacaaacatcatgttttattttcaaggtcaatcctgggtgagtatttgtctgtggcctagtatcagagacccacgcatcaggtacaggtagatggattaagtagaggattgaacagaataaactaaaataaaaagatatgaaataaatacatgcctcaggcagtgagaaatctcaaatattctggagtaacacaatgtttcttatggtgatgatataaaaatatatcactaagattataatatactgagacgctgcatcaccattatcccagagctacagtatgagtggctgatgaagagtaatgaaattttaattagcattttggtagcagaagatcagttcaatagtcattttcatttaattgatagccttttggaagctgggatgcttgtttcatgcatggaccgtcgcttaccacctgcagggtttatttgtatggctagctattaaatctcacctaaaaccatcatgaagctaaatgcatatcacttctgttttaaagtgcatttcaaggaaaaaattcaaacatttaaagggtcatgctctgtaatggaaaagaagaaaacaatagctttttctattcaatatgaaccttcatggagaaaatttagaaactattctaattttatgctggtttaatgtttaaataagcacataagtacatttcttagagtccaatactagtacttgaggtagaaatgatatttttaaaaaaatattctacggatatgctttcaggcatacagtggatattgttaactgccaatccagtatcattcttgtttttctccttccaaacagaatccctttctcttttcaaacagaaaggtctttgaatattcaccattttcacaagtctgtgcatcttattcagcagctactgagtctaatctcggctccagagaatagttggagaaaattagaatgattatatcttccctttctgtatttgaatcaagaatggcatgtcatctaacccagaacaataaaacaatataaatagttgattacagcttctgtggaaatcctctctggtattttcaagggggagggtctcagtttctacacagaatctgcaaaagggccatcctaccttctaaatctcttcagcagtttcttaatctagtgaagacatttcatgtaggtacatgtactcagtcctgtaaaatgccatttatatatcaaacaatacttggattgataatcaaccattcaatttaaatatatgaagatcactgaggaccttgataacattaatttccttgaggtattggaaacaaaagctttatgtaaagcattcaaaaagattcagagtgttggtggcagggagtgggggtagagagatcattagaaaaaataggtaatgcatgctgggcttaatacataggccatgggttgataggtccagcaaaccactatggcacatgtttacctatgtaacaaatctgcacatcctgcacacgtaccccagaacttaaaataaaaataaaacagaaataattggagacaaccaatatccatcaacagatgaatggatacactaaatgtgttaaatagacataaagtaatatgattcaatcccaaaaaagttctgatatatgctacaatatggctcaaccttggataaattatactaactaaaagaaatgagacacataagaataaatgatgtaacattccatttacttgaaatatttacaataagaaaattcagagagaagttcccaggggctgggggagagggaaacagaagttattacttaatgggtgcagagtttctgttggaagtgataaaaaagttttagaatagatagtgatgatggttgcacagcaatatgaatataaaatgccactgagctgaatattttaaaatgattaaaatgacaaattttatgttttatatatatatatttcaccatgataaaaccatttagactattaatgtagataattctctgaaataattttctttaaaatgaataaaaatatttagtgctagttgaataagttcaacaaaagacttgaaactataaaagtaaaaagatatttaattcctataaagacacttaaagacagcgataaatcatgaataatggcattttgaaaatgtgacagaagagaaaattcaaagaaaaactgaaagaaaagtggaaaaaaaagtcccaagaataggttttcccttgaaaaaaaatatcagaaagagctattattttttagaccggacaaagttggctctttggaagtaatgaagaggtgggtctgactgtattacatacatatcaatgtgaagaacaagaggtgtgtgtggcatgttaaatcatcctgtggactctattgataagtgtttttatgtggagtgaatatattatgaggcttgaagttactagactaaaaatgctatgaaaggttattctaattaaaacccttctagaagtgtgaaagaagtcactggtgaagcacttgctcaaatgatcaatttaattcagattaatgaaatctacaaagccacaaataaaacagaagatataaaatattagaagataccacacttacatgctagataaccaaaaacaaacttcttagacataaaatgccaataaatatattcatttactcttaacaaattaaaacattttttaaaaatatttttaaaaattaatcaattttaatttattttatttttaataagagaaacatttatgcttttttgggtagaatcaacaattgtttaacagattctttttttcctgccatctcatgttgctctgactcaaattagggctgaagatatttgaatatttgattgcaccacaatataaaaagggctaatatagatataaacccagaagagaaaaacaaatcagaaaatgaggctctctggggtgggttatatttgtttcacgtctcaaagtatgaatacacaacaacttaaatttagcaaacattaaagaagaatctatgtagttagtcttaatccctaggagtaacaaaaattacaaatacatcatttatgagtggtaagtgccatttgatacttgtggaataattaacattacagtacaaaaaacagatcaaatctacataatattattcctcacaccttctccttttaaattataaaatcacacttgcttatgtgacaagattttgagagacttaaatgagataatgtatgtaagtgaaactgttattcactcttaatggccgcactggatcttgcattggttattcattaaagaaccactcagtaagcacctacgtacaaggccctgttttaagaactgatgacacagtgcataaaagcactttatgcataaaagtacttctctgcatagtacctttttatgcccaaaagcacttctctgcatagtttatatctttccttctgtcttcgtttagtcccaatgtttcatcatgagattgcaataaaaattctcaatttccccctttattatttgtgaaaattatggacatatttgtagccatgatcacctatcacttttctactaacaacagagctagactatgaaatggcttcaactgtatatgtattagcaattatatgtaactataaattacatataaaataattgtatatgtacattttatgctatgcattaatcactttttcctttctcaaaaattttatacatagcttatgactgtaatttataataaaatatatacacagtaccctaaactcacattatctttgcagcaggggaaatcaaagagaacaaaatcaagattcttctctttcccagaattttatatatatatacacacatatatattcctgtataaaacaaacaatatctgataaaccatgatagataaaatcccaggttattttttgattgactctttctaaatgttgaattgagttctcataagaaggcattaatataaatttttattattactacaacttatacattaccactacaacattgaacaaatattactagcatcaatatcacttaatatttttaatgtttatttgaccagttaactttgtttacatgaattgaagtactcatcattcaacatttagcagattttttaatgaaaaataaagacaataaataacatattcaatacaactttcatttatcaccattatcgaagacctactgtggacttcacactgggtttaacatattttatttattccttgataaattaattacattttagctaatattgttaatgaaaatgttgaacagtttcgcagtgctttaaaataatctacgtagcatattacatttacaatgacatgaaaacttctagaaacttttaaccaatagttctatttgtcatctcaactttttgagtaggacagtaaaattcaaagggatacaatgatttgcgtaattccacacagctagtgtatggtgatgaagatttgaatctagctgctctcaattgtaacactgctctcctctcattataccttactgacatttactaagagcactgaatctttctgtacaaagccttccactattcttatgcctcccctatttacctaattaatgtttataaaatatagacagttttaagtgtatttttagttatttttatttttttaagtataagaaactagccaagttaaaaaaaaagcattacgattgaagtgtttacaacctttggtaatctgaatattttccacatccattccaaagattatgtaggtgaaaggtattttaatgttaattttcaactggtaatatggggtagtcatgtagctatcatcactgaaagaggcatatttttttttaaatagagactttctaaaagaattctattttcatcaatataaattgaagtgattgccattttcaactataaatcatttacactgtgttttaggaagcagtacttgttcctgtcatgattccagtccttgacattgccgctgatcattaaaccctgtatctccttgtattcatataattcagacagctaccttggcaatgcaggatgtcacattttcacagtattcatgaacatggaatgggagcctccaatttctgtaatcaagatatttgagagttgatgtgcccaaggtcctctctttaatcagctgtggtacttcccgccctgaactcaaattatccctgcaacaggagtaatcaaggcagaataaaatccaggttattctctttggcccagtttatctctctacagccacggggaaggctgatgcatcaatcaagtctccaaataaaaaggtaattatttcttgatttctctggagcagatgcaatgagagcaaggttgcttctactgggagtccctactgtgttgccaaacagcagcagttatcttagaagacagaagcaattacttgcaagatgttcttgtctttttaggtaaggctgagtgctagtcattaaaattcatctggcatttgagtaaccactacaggccaggcataatgctagatatttttatatatatgtacatattttatatacatatataagttaaatttcttttaaatttcagacatttatgaatgcactcacatatgcacaaaaatattaacactgtaaggtttgaatcatcttcaagtaagagtgaggaaaagctcagtgagtgagtgaaatgaccaaggtcactgagctagtcagcagctcagtagtacttcaaacttgtgtttctatcatctttccactacgtttttattatgagcatgtggtagtttgcaaagcctttttctaatgcataacacacgcactgatatatacactacaacagcttgccgttgtcatcttaaacgcttaggacagcagttctaatcttctctttgtcctaaagggtccttggtgacagggggatcaccctggatgttagcctaaattattctttcaaactttatttaactcccaatctcccatgtccaaatggtataaaatatgtgaaatttaccaattagctaaatttagcattccatttcttcttgatatcacttgagggaaaatatacattatatacttagtctaatcattgaattaatataattggattactgactacccagatggaaagaaggatgccatcactgctgatgtatagtacaggcagcccctgacacaagtaacagtgtaattcttgaactaggggagggtgctactgacatctagtgagtagaggccagggatgcttgtaaacatctgcaatgcattagacagcacaacagagaactgtgctgcacaattttgccctgagagggcaaagtgatgttggatgaggtaattgtcttcatctcatgaattcctaagagacagcatgtacatgaataactgattcatgcaggtttatgaagactcaggtcctttctgtggccccttatagatctgaggggccctccagatacagacaccatcagctgagaaaagaattcattaagaatgaaaactgctcccttggcccaatcttgttttcttttcttccctttccttgtcttttacaggaaggacaggaagcaagattgggcagaggaagcagttttcatttattaggggattattctcaaaaatagtctcccaataaatcttttgcatgctaattcccatatcaggcccttcttcttctggaacctgaccaaaaagggctggtatctgaactggtctcagaaagcagatgctaaaatgagattttgcagttggattatccactgccctgttgaaaatgaggacactggctgggcgcagtggctcacgcctgtaatcccaggactttgggaggccgagcagggcggatcacaaggtcaggagatcaagaccatcctggctaacacggtgaaaccccgtctctactaaatacaaatacaaatactaaatacaaaaaatcagcctggcgtggtggtgggcgcctgtagtcccagctaatcgggaggctgaggcaggagaatggcgtgaacccaggaggtggagcttgcagtgagccgacatcacaccactgcactccagcctggatgacagagcgaaaaaaaaaaaaaaaaaggaaacaaggacaccatcaatggtgataaataagtaaaggcagcccctggcacaagggaacagtgccatttttaaaatcttcattggcggagggatggtatgcactcagtagaagagaatggtatgcactcagtagaagagaatggtatacactcagtagaagagaatgcactagatgatgtggtgtgatgtgttaaatatttgagaaatattggagacgtagtagttataaggagagtggaattgagtagctttgctaaacttgaagtatgccttgaagaaaaagataaaaatatgattcattaatctgaaattaaaagctaagcgtgaatgccagtgcatgaaagcaagtagcatgtaaagaggatctcatttactgcagctagaggcaaagaatgttgaggaccaaaccaaagtctcaatcataagagtagaagagagctgtaaaaaaacttaaactctcaaactaagcaggtctgctataaccacattaaaaactcaggccaggaaagaatgaaactctcatggagtaagagcatctggattattacatctaaaaatattgtaaactcatatcccttatatttcaacatcgtccgcagatatgaccaacacattcctgttaaggggtgcctcctttgcatcaagatgacttagagacctccccttcatactacaaagtattccaccctcacaatgtgtttccacattcctaggtattccattctcttggaagcaattgtgaatgggaggttcactcatgatttggctctctgtttgtctgttattggtgtataggaatgcttgtgatttttgcacattgattttgtatcctgagagtttgctaaagttgcttatcagcttaaggagattttgggctgggaccatggggttttctaaatatacaatcacgtcgtctgcaaacagggacaatttgacttcctcttttcctaattgaataccctttatttctttctcctgcctaattgccctggccataaattccaacactatgttgcataggagtggtgacagagggcatccctgtcttgtgccagttttcaaagggaatgcttccagttttgcccattcagtatgatactggctgtgggtttgtcataaatagctcttatgattttgagatatgtcccatcaatacctagtttattgagagtttttagcatgaagggctgttgaattttgtcaaaggccttttctgcatctattgagataatcaggtggtttttgtctttggttctatttatatgatggattatgattactgatttgcgtatgctgaaccagccttgcatcccagggatgaagcccacttgatcgtggtggataaggttttggacgttctgctggattcggtttaccagtattttatcgagaatttttgcatcaatgttcatcagggatattggcctgaaattgtctttttttttgttgtgtctctgccaggctttggtatcaggttgaatggccatactgcccaaggtgatttacagattcaatgtcatccccatcaaactaccaatgactttcttcacagatttggaaaaaactactttaaagttcatatggaaccaaaaaagagcccgcattgccaagacaatctgaaggcaaaagaacaaagctggaggcatcacactacctgacttcaaactgtactacaaggctacagtaaccaaaacagcgtggtactagtaccaaaacagagatatagaccaatggaacaaaaccgagccttcagaaataataccacatatctacaaccatctgatctttgacaaacctgacaaaaacaagaaatgggaaaaggattccctatttaataaatggtgctgggaaaactggctagccatatgtagaaagctgaaactggatcccttcctttcaccttatacaaacattaattcaagatggactaaagacttaaatgttagacctaaaaccataaaaaccctagaagaaaacttaggtgataccattcaggacagaggcatgggcagggacttcatgtctaaaacaccaaaagcaatggcaacaaaaggcaaacttgacaaatgggatctcattaaactaaagagcttctgcacagcaaaagaaactaccatcagagtgaacaggcaacctacaaaatgggagacaatttttacaatctacccatctgacaaagggctaatatacagaacctacaaagaacttaaagaaatttacaaaaaaataatcaaacaacccccatcaaccagtaggcgaaggacatgaatagacacttctcaaaagaagacatttatgcagccaacagacacatgaaaaaatgctcaccatcactggccatcagataaatgcaaatgaaaaccacaatgagataccatctcacaccagttagaatggcgatcattaaaaagtcaggaaacaacaggtgctggagaggatgtggagaaataggaatgtttttacactgttggtgggagtgtaaattagttcaaccattgtggaagacagtgtggcgattcctcagggatctagaactagaaatgccatttgacccagccatcccattactgggtatataccccaaggattacaaattattctactataaagacacatccacatgtatatttattgcagcactatttacaatagcaaagacttggaatcaatccaaatgcccatcaatgatagactggataaagaaaaggtggcacatacacaccatgaaatactatgcagccataaaaaggatgagttcatgtcctttgcagggacgtggatgaagctggaaactatcattctcagcaaactaacacaggaacagaaaaacaagcactgcatgttctcactcataagtgggagttgaataatgcgaacacatggacacagggaagggaacatcacacaccatggcctgttgggggttgaggggtaaggagagggagagcattaggacaaatacctaatgcatgtggggcttaaaacctagaagacagattgataggtgcagcaaaccaccatggcacatgtatacctatgtaacaaacctgcacgttcctcatatatatccaagaacttaaagtaaaatttaaaaaaagaaaaaagttactcatttgcagactactgcaggaaacaatgatgaaagtagcttctgctaccaggaagattatagactctctctcttatcatctcctcccttttctagagcctaccatggcacataataaaatatgttataaggttttggtggacaatataaatttacaatattttgcatttttattcataagtttacagagtataatatggctttaatatgtaaaaaaaatttactgtaaataaaaaataataaaatgcttaggaatgacattaactgtgaagtgtttggatagaatattttaatactccaggtcatcaataaataatgcttattctttctttttgtagctgttattcgtgtccctgaactgtggtctcaaccacaaccttgttctccatcaattctatccctgggcagagctctgttgatgactgcagtgccgtggccttgtgtgtgtgtctagccatcactctggctccccgactccctgccagcaagttggccccactgagcagcccagcatggtgcatttggtggctctgagaaatctgatctcatgaaaaaaaaaatcacaggcctctgagttttctaattttgcctctgtcatttactccgagtcatcattaagcaaatcttgttacttatttgagccatattgaacccgtgagtttggaaaacaggcattaaagtcttactcacaggcataaattaaacggcatttcataggaaataaacattttgtaagccacgatttgctcaattgtgagacgtttttgtttgtttgtttgtaactattgtttcaactgcaaagtcaccaaaaacactgagtcattgaaaacagagcaatggtccttaggaaaaatacagggttaggttcctgtgaatctctgatcacaacatttttatcatctgatcaatacataactttcttttatgttatttctgtttagaaatacctgattataatatatttttgatttaacattgaactgacagccaacaacattatctgcctgaacgaagctcatctagcacacacagtgtctgttctctgtaaggcacgctacagctttcttgtgtacagggacactagacaacattccagcactctgctttgaggccatgttgaacaatgaaatcaccaatacaaagcagaaaacgtggtactaaatagaccacaaacagacatgtgtttatagtacgagagctgaaaaaataaggaagattatcaccttttttacttcagctgtgcatgccggcgactcaaatttttcactgctgtgaacgtttttacaaactatgaaggtgccatgagtatgggggttataaagaaaatgtattattagacaaacttgcaagtatgaaatccacaaataatcaggattgactttaattatatgtgaagggcacgtgaatctccctcacaggtaccaagcacaggacaccttattcttgtcttgatttcagatccctgtttggaaccccagtatgcagtctttgtccttccttctatcgatgtattggtcaaggtttccagagaaacagaacaaacattaccctacaggattggctcatccagttatggaggctgagaagtcctaagatctgtaagctggagacccaggaaaaaaaatgtgtaagttcctgtccaagagagcaagcttgaaacccaaaaagagcctatgtttcagttcaagtctgaaggcaataaaacaccaatgtcccagctcatacagtcaggtaggagttccctccaactcatgggagggtgtgtttttttattctagtcagacctttaactgattggataatccccacatacttcagagatgacaatctgcttctcttctgattctaatgataacctcatcccaaaacagcctcacaggcacatccagaataatgtttgagcaggtatctgcacatcctcctgtggcccagtcaagttaacacgtaaaattaatcatcataattagcattacatattttattatctaatttttacataaattttgaacaatatatatcacatatatgcacattataaaacttaaaccacttcatgaaaatcccatcaaagccagaactccattttggtaatgcttctctgccgtggctctttccctttctgacacacaagatacaaatgggtggtattcattcatgatttcataattctaacataattctaagaggccttgacatctccatcatatggcctaagggtcaaaaagccttcaaacagctaaccttatatggaatgctcactataggtcaggagattttaaaaattattttgtggtataagttcaccaattttttagccaggctttgagctagccacaattagtagcactatatgaaagatgaggaggcttgaaatgtagagaaatttgtaaggaacacatagttcctattatggaaagttcttcttcctgatggaaagacaggaatctgacttcaaagcccgtgttcctatctgctatgccttactgcctctaacttctaactggccagtgctacttcctactgttttttttcccattaggagatacattaaataaattggaaatatttggaatatagcaaacaattagctcatgtatttatggaacctgcagaggtctttagttttctagggcacagcacaaatggctttctcttatccagcttgtttggaaaattccaagtctagctgtggaaatgaaaaacagttctcagtccaccaaaatgattttgttcccaatctgatgtagcctgttgtgatttatgcctttgaaaaggttgaccaacatggtacataactgccatgccaatttcagctaaattacctctgccctttttcagtttccctgtgaaactctaatttggcttgtgaaatcaagttgttttaacagtaatgctttttctctttttagaaggtttttatacaatggtaaaaatacgtttatttttagttttaaatataggttatggagtgagatatcattctttttaaaatcagaaatgactaaaatctgaatcttgaaataacagggggaaatatatcaccccagcaaagcactatgcagaaaataatgcaccaaaagatttaaaatgtaagctatctatttaacctatctgccattcaaaggaaggggtggcaagatggtggaaagaggtcaagtgagcagaaaatgaagaaccaatcacaatattggaggatcagaagaattggaaggggagtgacatgattttaagtgggttccaattgcctttgtgtgaatattaagaatgcccttataatgattgtaaagatgcttaatgatgtggtctcctacttagatctctagcttcacccctggttagactcctacacaaaccttatgccagtcatactgaatattgtctgaatccttaaaaattaccttatgctttgcacctctggaaatcctcatgttctgtttcctctttctgtgaagatctggacaaactgactcacaaccttatttatttttatgacatattttagcctttggtccagattgctggtctgtaaggacctcactgattggaccagattctaaagagttacttatttcattttctgaaagttcatagaatcatatgctttcttctttttattttagagtctctctctttctctctctctccatatatatatatatatacacacacacacatagtcttccaaaactcctcggaagaaagggaagcattctgtaagactttgggcagattttttttttttttttttggacagagtctcactttgttgcccaggctggagggcggtggcaggatgtcggctcactgcaacctccacctctcaggttcaagcaattctccaggatcagcctcccgagtagctaggattacaggcctgtgccaccacactcagctaatttttgtatttttagtagagatgaggtttcgccatgttggccaggctggtctcagactactcttgacctcaactgatccacctgtcttggccccccaaagtgctggaattacaggtgtgagccactgtgccctgtgattttgggtacatttttgttgttattttgtcttaccccatttctctgtacaaaatgtgaaacacatgagtcctcttaactggtgcatgtgtgtggaggggagcattttgttgtttagtgccaaaatgagatagatagaagtttaaagaatgtgacatttgtaaaatgttctctgtaaaaaaagagcaggtacttaccagccccggaatagaggaagacatcgtgcactgctggctgctgtgggggagacaaaactagcagggcactgagcagagagcctcaaaaacaaaaatgtgcattatcttgtgtgtgtgtgtgtgtgtgtgtgtgtgtgtgtgtgtgtgtggtatgatttttatatatgagatgtgtgcttggggcggtgtggtttgtctggtatgtgtgcatatgtgtgtagtgtaatgtgtggtaggtgatgtgtggtgtgggtgtgatgagtgtgagtggtgtgactgtggtgaattatctgtggtgtatgtgtatatatgcataggtggagtatgttatatggtgtgtgtgtgtgtgtgtgtgtgagagagagagagagagagagagagtacatgagagagagaaaggaagaaacctctcaactatgttgtaagcatttagtaaaattacacatataacaatattcttggggcagttgtctcctatgaaggtcagtgaaggagatgagttttgcataacgaagatgtataagccagaccatgtgcagcagagagaaagccagcatgtgaaatactattttaccttcatgactactacaggctctgaaacatattggtgcttagagacattcttaaaaacattaatgaatgatgaaaacatttaaaattgtgtcacaaacaagaagtcttttattaaatacttgttcattatatttatagaaaggagagataaagaaaatagtttcaagattatacgtttgacaaatgcttatctgaaaattactaaagtcatttttgctcatataaaattagtcctttcagtaaatcaaactatttaatttacggatgttctctaggtgttactgtatagtaatgatattctgcaggcaattatgtagtaaaagattccaagcatgtttgtgatatgtttaattcctgacccttggctttatttagttaatattcttttgttctttcattcatttaatttaattcattcattcatgcaaaagctacttattgagagatttctacatgctaagcattattttaggtgttaagggacatgatagtgaacaaaaccagcaaaactctctgcccttatggatttcacattcatgtggctgcaaatgcaagagatcaatacaggcaagtgttaacacaaattggaaaaatcaaaaaagaagagggtggtgactaaaggaaccaaaagattgaagtacaacttggtctgagaaaatttctggaacgaactaagagaaaattaatcaatattctctctctgttttttttctccttctatcctctaagagttttatctattttttctatactttctttctgaaggctggactttgtgccctgtagataaccactaacatgatccagtcacatccaaaaacattttaatctaatttttgcttcaaactccaagaataagttttctgattatactaggttggtcaacttttgtctcaactgtgacagattgggggcataattaaatggactaaatggttgccaccaatataatgttatgaatgagtgaaaatctaaaaacagtaataaaactgtagagaactctgagatctctttttgacactcagggtgtccttatggctttatgtctattctggttccctctatgtctggtaaaaagtatttccctttgggattctaactcctgtatgtctatgtgtggatacttacatatttttacaatttaaagcaatatagttggttctttagttttggttggtaaacgggtttgtaagatttaaagcaataaagaagataacagagaaaaagatgagctggtttaattactcatatataaactatttcaaatatctttacatattcaatataatatcaagaaaaaaggtaagagatctatgttcatatgaattgaggaatatcacctagccattttgagctttcatttttaatacctataaaactttcattatgaatacatatttatgtgacacattctatctgatgttgtccaggtcctgagggggaaacatattttcttgctttcttggcagggtttttgcaaggatcagaaaaaaagaagcaatataaaatgacaaaagtaatgcataaagggcctaaaaatggaagtgatcactattaaagaaggtcatgctgttaagagagcgttgcaaatgtggtgtagccactctacatatggctaagtttgcaacatatttgtcaggctttctgggagtttactcagaggtgtctgggtcattaccagctagccatctggtggaacctaaaggaatcagaagatgaaatccatttttcctgctgcatttatttgagcaaggtgattttatcatgcatatcctgtaccatgctttgtatttacaaggcttgctggccatgactgcagtgcagtgtccccaggacaccatcaacacttccctagggaaaacctgagcaacagctcaagctttgagagtttgctcacccgtggaaagcggttgcagaagcccagtaggcatccactgctaatttgaggctgttgcatttgtattctccttctcacacactgagttcattcttcttataaataagagtatttgctctaactttgtagttcttcttctccaaaaacaacatctggacattctttcctgaaaaatacacagcatacctctcctgagaatatttttcatctaaaaatgtaatgttttaaatcaggtaaaattaaagagtaggattgaatattaattcaagatggattaaagacttaaacgttagacataaaaccacaaaaaccatagaagaaaacctaggcattaccagtcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaatggctaatatccagaatctacaatgaactcaaacaaatttacaagaaaaaaacaaacaatcccatcaaaaagtgggcaaaggatatgaacagacacttctcaaaagaagacatttatgcagccaacagacatgaaaaaatgctcatcatcactggccatcagataaatgcaaatgaaaaccacaatgagataccatctcacaccagttagaatggcgatcattaaaaagtcaggtaacaacaggtactggagaggatgtggagaaataggaatgcttttacactgttggtgggagtgtaaattagttcaaccattgtggaagacagtgtggcaattcctcaaggatctagaactagaaataccatttgacccagccatcccattactgggtatatatccaaaggactataaatcatgctgctataaagacacatgcacacgtatgtttattgcggcactattcacaatagcaaagacttggaaccaacccaaatgtccaacaatgatagactggattaagaaaatgtggtacatatacaccatggaatactatgcagccataagaaaggatgagttcatgtcctttgtagggacatggatgaaatcggaaatcaccattctcagtaaactatcgcaaggacaaaaaaccaaacaccgcatgttctcactcatagatgggaattgaacaatgagaacacatggacacaggaaggggaacatcacactctgggtactgttgtggggtgcggggagggaggagggatagcactaggagatacacctaatgctaaatgacgagttaatgggtgcagcacaccagcatggcacatgtatacatatgtaactaacctgcacattgcgcacatgtaacctaaaagttaaagtgtaataaaaaaaaagagtaggattgaatatcatagtttgatctcccagactgggaagcacatggtgttgctttaaactcggacgccagagctgaatttttccaacaaataacaaatagcaactagaatgtaagcaaatgaagcatacaaattaaatggaaatgctcttctttttagtcaactctgtctctgttttgccttagaacccaactgccatatatcatactgactgatcactgcttatttctttaaactgaagccaaaggtcacatcttataggaatctttccatgattccctccctttatatttccgttcttcatctgatgatttttcatacctagcatagttcttggcatatggtaggcaattttgatatgttaaatgaatgaattgggcttacaacactgtggtagacagaataatgcctcctcagtatgtctatatcctaatctccagaatctgtaaacatgctagtttgcatggcaagggggaaataataatgcaggtggaattaaggtttctcttcagatgaccctgaaatggcgatattgcctctgattatgtatgaacccaatgtaatctcaagggttttataagtaaaagaaagacataagagagtgtgatgatgcagcatgcaaaaggccctactggctgttactggcttagaaaatggaagaggggcaggagccaaggaatgagggcaccttctaggagctgcaaaagacaaggaaacattttgtttgttttgcaaaagcaatgctgcccttctaacatcttgattttagcccagtgagatctgtttcaggcttctgctctctagaattgttgagataattaattatttttttgagacagtctcactgtgtcaccaggctggagtacagtggcccgtgatctcatctcactgcaacctctacctcccaggttcaactgattctcctgcctcagtctcccaaatagctgggcctacaggctaatttttgtatttttactagagacagggtttcaccatgttggccaggatggtcttgatctcctgacctcataatccgcccgcctcagtctcccaaagtgctggaattacaggcgtgagccaccgctcctggcccactttgtgttgttatacccaaatttgtggtaatttgctacagcagcaatagaaaaccagtatagataccgtaatataggcttttttgtttgtttcctccttttctgctggtgccaatggtgaagtcatgggcaggatctctcaatgtcagaagaagtataaccataatatttcctgattgaatgtacttcttggaagtttagtaatgaaaattcattgagtttagagattgcatggctctgattcctagcccaacacatttgtgaccttgggcaaatcacaaaactgtactgaatgtttttatctgtttaatggagaccataacatacactttgcaggggcaccatgaacactaaatgatctgctaaaggccatcgtacacagtcaaagtgaaataaatgcactatggcagagataatcattttgcatgctgatgaagaatgtaataaggcataagcaccaaatgtgtgttgagaactgtgatggtatttcttgggggtgttagagctgacattggccttgtatgaagggaaaggttcacacatgtggacacagcacagaaagggcactccaggctgttcaagttgtgttcaggataagacattaggagcagcccagagcagctgctggtgacaccacttagtggccacaagggtgatgctggagccagaaggctttggattgcctggttccacaacttccagaggttggcagtttagggtcattattcaaaccctttgtgcctctgattactgaaatgtaaaaaaaacaggaagctctggcaatttaatgtgtcagtacatctaaagcacaagaacagagcacttacacaagtccagtaaaaattagctaatgttggtgttatttactgcacgtggagaagtgagtatggggaagatgttctggaatattttcagcctggatcgcttgagcagcagcctcttcaaacccacggaaaatgtcttgtatggagcaatttcatgcactcttacaggagtgggcaagagagttcaactagagttgaagttcaatgaggatagaaattagattttgctgttgtaattcacctatttatcctcagcactcaatgtcttgccaatagaggtactctaaatatttcctgattgaatgtacttgtctaaagtttagactatagcctaaagtagcttatcagtcctattttttgcataaactagggtgtaatctgtatgaatgaaacacttgaagcccattacatcaagccagctagaccataatttaaatcattcagggataggagtctatatttctcctctgcttgcttgtatgacatcgggtaagtcattcaaactcacttggtctcaggttctacctttatgaaatgataaatctgtgggttttgttctattctagtctgttactttacatggtttttgtaaaataacaataataccataattatgtaaatcccagtccagattctatctttctattttacaatctatataacttacataccatattttctaggagtgtaactaaatgttactgaaacatcaagagttcagtctaggtcctgttgcttgcttcacagaaagccagtcactgaaacaatgagtattgccagggaaaggggctttatttggatgctgcagccaaggagaatgggacatcactcaaaaatccatcttctcaatggactaaaattagaggtagaaaaataagggaagaaatgtaactaagtatggaaaaataggaattaggagaggattaagaagagaaggtggtcaacaggcagcagcaggttacttaggcaaccataattggcaaggggtctgggtctggcatctcattgtccaggtgcagttatctggtgagttgcagttccttgaaactatcttggagggctgatagttggtttcctgagaaaggaactcagataagaaaagtgtaagtttcttcagttttaatactgggagggtcaactttttatttttattttttcaaaagaaaccataaacatcagttctataggacaattgggccagtttcataaacattataacatataagcaaagtgtatgagataggtactggtccatgatcaatgttcaatgagccccttccttatttctcagccttagtaatatttaagtgcttttcttccataagttaccaggcataaggtgttatctacagtcctcgcagaagagtaagatgtctcgtcgaatctatcccctggtttatgtctcccacactattcttatttaaatggaattatcctgtttatcacataggcattttacagatagactctgtaatattagtgccatgcagagcattatagccatgctaaaatatcatttttcctgggaaataatatcagtatcaaggtgtatggcaagaaaatataaatctttcaacgggctaagaattaaaaaaagagtaatgattctgtacaattatagtataagaaaaatgagggtggatatttaggtagtgttgattagaaagtagaaaacaatcatttgctgccgtgactgatttatggtttcctctcagtgcacatgttgaggttatttcctccagaaggaagctgtagacaaattcataatttataatatttagaaatacacttgtgataatgtggctagtgttaacaggagaacaggagaacagctattccaaggcttacgctactgtttttaggatgttgatggtactatttctatgaccattaataattttaatgcttgtcaataaatcttcttttcatactaatagctgcatgaagcaccataggcatagtaaaaagaattagggaagctggatttgagacaagcttctttacgctctggcaatggaattctttcccctaattccacgaacttcacttaccatatcgataaaatgtgtaaaacatagtgcgatatgttaaagcactgtaaaaatgataaagtaacatagcataaccattgatttgtgaatgttagttgaggaatactacagtatagtccttgtcaaatctatgaaaattatatgtgtatgtgttatgatatccaaagggtaagatctttttaaatattaaccacagatatgaatttcagtggttggttggctattttttttaatgtaattttcccagttacttcacccaacattctctgctctctagtataatgactcccagatattcatttgggcccaacacaaaattagcttttttgtatttcctgtgcaaaattttctaaaccgtgttatttttaaaagattaaaaataagtctattaagaaaattgaagttatcaaattagattaataaacagatataaacttgaaacatcctctaccacataatctgcacatggctgtagaaagcataatttttgtggagcctcacaacattgcaagtaagtaattttttcatcccaattggttatttagatttgttttcctatctagaaagtctgggttctaggcctttgtcctaaaaactttacacaactttaaaactgaatatctttagtcttaatgaaacctgaatgactgtgtaaatgaattcctatgtatttctacaatttcattaagagtatgatatatgaaagtatcactgaagcatgaatttcctgatcatgacaattactgccacaatcttatattcacacactctgtggtgacccatttctgggttggaaatccaaaacagagtatgaatcatataaatacacatgatttcaagattaaggaggttttatcccgacttccttggggtgggaagcatcaaggaggagttaatcttactgtgcatcagcctctaaccatattcatgaaagtgaaaatttgattgtcctaattacaaatgaggttgtcatggttgttatttttctgatttattgcctgtcaatgacagacaccaacaatagatcttgaattcttgaaatataacacagataccccctcttaccttttaaatggaaaatactttatttttcttccctagaaaagggtatgctgtttaggattgtgcctgtgtgcatgtgtgagtgtgcatatccaaacatgcttgttcacatgttgattgtgggaagtggttgacatgtatcaactaatttaaaattcacaacaatgggaaggattgtatttcctatcagttcattgtaaattacagctaataaatgagataaattgaatcaatacacatagctatctgattcaaactactgcatgtatgtctctgtgtgcttgtgcatgagggatacatgtatttgcatgtatacttacaaaaattgttgcagcatattgctaatccggatcttgtcaggagtccagctacagtactatgcataattttcctctgtcagtttgtatcactggccaaaatctaacagatgtttctaagagtaaaggcactgggaattaacactgttgtcattgatgaagtacaagtgctcacacagccatctttatttcatgcctgtgaggttgattagccacatttctagtttgggagtcaggtatgcctattcttataccttttagattaataaaacaccattttgaagttttgggttgacaataaaaaatgtacctcaacttaaaactgatatccaatgtccttgcacaattttttgcaaacattatcctttccacagcaaatatcttaactttgttttgaaaattaatttatcataaatggaaaagtttatttctggattgatattcaattttttctattgatccagatacttatagttataccaataccataccctactgattactgtaactttatagtgagttttaaaatcaagtaatgtaagtcctctagcattactttttttcccgagtttttctggctacttaaaggcctttacatcttcaggtaaattttaggtgagtttatgaaatttaacaacaaaaaaattctgcttggattttgacattgaattgaatctatagatcaattttggggtgaattgccgtctttataatattgagtcttccaatcaatgaaaatggaatggccttcatttatttggaacaattatctcaccaatactttgtagttttagttgaatatgtcttgaagttattttattaaatgtattcctaagtattctatattatgttattataaaataaattattttcataatttcatatttaattatttgttgttagtacataaaaatacaatttattgatcttacatcttacaaccttgctaaacttctttattagttctagtagtttttaatgcagatttgttaggatattctacaaaatgatgtcctcagggaataaaaacagttttacatcttcctttcttggtagaatgacattaatgtttgctctgatggatgtattgattgtttcattaatagatttgccttacaataatggcaagaacacctgtacaatactgagtatctttctatgtatttgtgttttattgtggatttattagattatttagaaatgtgctatttaatacctaagaatttggatatttcccgtctctcttgatttctcgtttaattacactatgtacataaataatatattacattaatttgaatcactcaaatttgttaaagtttcctttacaatatgtctgttttggtgaatgttccccatatacttgaaaaaaatatgccattcatgtgtttgagtagaatgttctataaacatccattagatccagttgcttgataatgttgttctaaattcttgcggttttctatccatttatcatttacagataaatgttgaagttctctattgtgaatctgtatgtttcttctttctcttctgtcagatttttccatttataaaacacttcgttagacatatccccatttgagattgttgtgtcttttaggtgaattgatcattttatctttatatactatctctttttgttttgttagttttctttgttctaacctctgttttgtctccagcttactactgatttgtttttgcatggtataacttttttccatgtttctaactgtagcctatctatatcattgttcttaaagtgggtttactttagatggcgttggtttattaccttttaatacattatccaaatctagtctctttcattagtgttttaagaccacttacatttaatgtaatgaatgatatatttggatttcagtctattttttcttatttaccttctgttagttccctctgctttttatctctcttttttcccttcctttttctgccttctgtttgggttatttaaacatgtgtacaaagcatttcactataatttatctagtttcaagattatttattcatttatttacactagtcttttcacactaatttgttgtcctggggattaaaatttacaaactaaacttttatagtcttcttagaattaacacactccaatttcaattgaatatagaaagcacttatttgtacttccaaatgtattctgtaatcaatttgtctatacattgttttactttttttccataaaaatgcatggtattttaattgaaattctaacaattttaaattaatttaggaaaaattacatttaacatgttgagtttttcttgatatgtgttgacatttgttcaagaccacctttttttcaggaatatttttaagatttttggttgttaaagctgtttcttgttaaatttatatgtggttcttttatttatctctattctatcttaagtgggtcattttctttccttatgtatttattttttgaatgtgcataaaaagatactgatcttttgaatattatttacatctctagtgaatttactagattcccttattttttcccataaatctgccaattttgttgagttttattggcacatttatgtgcatgtttataccatttacatcaaaggtgacattacttcttcctttccaatttttatactccatttctggtgcctaatcacattggctaacttctctacaatggcgttgaattgtcatagagatggtggccttccttgtctagttccagacaaaggaaaataacagaaaaagtaataaagaagctgctggtgtgttacaattaaatcagaactcttgtttgctggagggttacatctctatctaatctacatctacgtctacatctactgtgtcaaggaagtatttaagtgctttttacaggaattgtctgtttaaggctttttcagattttcttaagatggttatatgatttatttcattttttagaattttatatttaattgacaataagtaaaaatgattgtgtacatcacatacactgtgatgtctatatacacgtgtacattgtggaatgatcaaatcaagctaattaacgtctatcacctcacatactcatttgtggtgagaaaacttaaaatctattcccttcacattttcaaatatacattattattaactacagtcaccatgctgtgcaatcgatcagcagtacttattcctccagtctaactaaaactttgcacccatttaccaatgtctcccctttgcttttcaccccactccccccacccctggtaaccatcattctactctcaacttctatgagttcaacttttttatattccagatacaagtgagaccatgtggtatttgtctttctgtgcctgtcttattttacttagtgtaatgtcctctagattcatttatgttgatgcaaatgacagaatttcctgtcctttttgggctgaataatgttccattgtgtgtgtgtgtgtgtgtgtgtgtatttaccccttcatccatattgaacacttaggttgtttctgtatcttggctattgtgaataatgctgcaatggacatgggagtgcacataactcttcagcatactgatttcattttgttgggatatatacccagaagtgggattgctggattatatggtaattcatttctatttgtttgagaaatcttcataatgttttccaaaatggctgtaatgacttatattctcatcaacagagtgcaagggttccctttgcttcacatccttgccaacacttgccatctttcatctttttggtaataggcattctaacaggtgtcattattgtttttataaattgcatttccctgataatttttgtacttaagcattttttatatatctatttgccatttgtatgtcttttcttgagaactgtctattcatgtactttgtttatttttaaatagggttatttgctttcttgttattgagtaatttgagtctcttatatattttagatattaactcctcatgagatgggttatatgtaatttttttttcccaatctatgggttgtctcttcattctactgatttttttcctttgctgtgctgatgctgtttagtttgatgtaatcccatttgtctatttttgtttttgttgcctgtgcctttgtggtcatatcgaataaatcactgcctaaaccaatgccatgggtatttgggctcttttttggttccatataaattttaaaatattttttctagttctgtgaagaatatcattggcggtttgataggaatagcattgaaactgtaaatcactttgggcagtatagccattttaatgacattgatttttcctattaatgagcatgggatgtttttccatttgtttgtgtcttctctgatttctttgagcagtgttttgtaattctcattgtagagatctttcaccttcctggttagctgtattcctgggtagtgtgtgtgtgtgtgtgtgtgtgtgtgtgtgtgtgtggcaattgtgaatgggatttcctttttgatttagctctcagtttagttgttgttggtgtatacaaatgctagtgctttttgtacattgattttatagcctgcaacattgctgaagttgtttatcagctgaagttgatactgattttaatgataaaaaattcctccaatatatgataaatctagacaataggttttattgtattttttgagattgtatatgtttcttttatatttcctgtttgatcacagtatttaaaatattttaatactattaaatgtaaagtattttttaaattttgtcattaatttctacttatatgtgatttctgattaatacatttgtattattcattttcttgtaatgtgtcaagtttttccttgtagtcaactacaacaaattttatgaatattctatttttatttgaaaagactgtgtgtgtgtttattaccttcttaatcatgctcttttcattttctatatctttactaatttttgttgattttatttgtcctggattgagaatctgtgttttagattcttcattttagtgtatttttctctaaagcattttttagttttattttctcttacaaacttatttttattttttcttgaagctctgtattttcttcctcatgaagatttttgctgcattattgaggctatagacattaatatctggtgttttctttgagtattaaaacttttaatattataaagtgaactagaatctattatgattttattctgaaagtaatcatgctagacactaatattttattcttcactctcttcctacttctccatagttcatcattgtcacgtttttatgtttaggctttctggatttcattgttttaggtttgtctcgagtgttctggatagggtgagtaagcctctctaactttttaaatattatcaatacgtttggcttcagttctcttgtggtcgtttcatttctattttatttttttctatcactttttattatttaagttttatactttcgttcaaatgctcaaatttttatacttacttttgtatgtaatgttctcatctctgtcccccaaatttggatacggtgtatcggttccctactattagctataatgaactttaccagtcaactcttcttcctccttttctccttttcctccaagatttaatgtgaagtaaaaatcttttatacccatagttttgtagttcaactctatcttctttatgagacatatacaatacctttttcattatgatgttcattttatttcagtttaccagaaaaaaacaatattaatttactactcatggctaaatttttatgttggtgtcctccttttttttaaattatatgaagcttgctttctaatagatatttctctttttaagttatctctttagtatttgcttggctaaatgtcatcttactgaaaaccaaaaactaaattcaaattttcacaaaaatagctaaccccagtaatgatttctgtatctgatgttatatagatttttattgaggggaatttcactagaatggaaagttttttctctacaccccagagtgtgatatcattactcatttgtatccactcttaattttctttctaagttggagcttgtcttttacttgtgaacacttttatcacttccacttgccctcactcactcttttctccctttgcctctttttagcacttctcttcagggtttagctaagtgccacatgtgtttgcaaaaatctaaatcttgggaacacctggatatttctgcctatgcaggtgattgccttttttgttgattgcttctggtgtgcttttttggttctcactctccatcaaagattagtttttcaagttatgagttcttggaggaagatgctacgtgaaacataactttaccatctttagctgcaatcttaattccacttgatcacacaaatcttgctttcctatttgtattgactatatctcctctatggtttaacttatgcatgtaaggaatagcagttctgccattgcctgtacagagatgaaagtgttcttgatctaaatgagtgttttcaagtcagatgactttttatatttattttctaaagaaataatacaatatttatcatttaatagtttaaaagtatattaatatatccctaccattacttgagaaaatgacatatggagataattgtatcccaatatgaaaataaagaggtatggatattttttagacataaaatatgggtaggacataagtggccacaaatactaaagtgtttctttttctacttacattacagtgtgaaaaagttagtctagcactagatgagtaagagtcaaataagacaatgattaggaagacagtgtctgggaagccaacattcaaagagctactaaactataaattaagtcaaatttcccaatgctttaatagtaaattgatactctatcaaataatcatatcttattaataaagcagcatcattacaactgaaaaaattatgcaagagtaaaatgaatcatttgtgactttctgagaaaaatatattttggttatctttagaagaaaacaattgatctgcagtcgaattaccttagcaaaataaatttaaaattagatttggagtcagctaacaattgcgatttgcatttcaaaataatttgttaggaattcaaagtatattatttcatataagttgaaatacaaattgagacatctgccaaattttacctcaaagatggagtaattcattgaatcatttatgatttgaaatactgttttttaccttttctcaggttaacaaaaatcatgagaactgctttattgaacaccaatttttgccaggctaagcattacatatgcatatacacaaatacacacacatactgtgtatattacatgtatgtactctctacttcacaaaaaatacttgcaagaaaatatttataaacccattttacatgtgaaaaaataggctcaaaaaggttggttacatttccctcagttaaagagctcatatactgcagaggtgataaccaaacctgttccatctattctacatctttctgatgctgctctacgttttcaaacttcaatataaaaaatggttagcaattatatttatatagatatttgcagtgtgtgaaggagatgagaaaacatttaaattaacttagagtgatctcactgacttttactttcaagcacctaggatgttctcatgcaaatagctcttgtcaatacatttttttcatatagcactgaagataatgatggatcattttcaattaaaaatctaatgtctcagacagacggaatcatgaatctacattcttttaagttacaagaaataatataatgagatatgcatacaacactaccagtaataagcctgagatatggtaaatttagtgcaataagttgttcataaatgtgtctctatggaataataaaaggtacagagagagacaatagtaggtgtacaaaagatgctcttaacagtcttgtttcaaagtccagacccttttgagtagtaaataactataaatgacctcctatttgaaaataacaattagttagctgagtcttattatttacaattgtttagactattccatcaatttatccttttacagtgctttccaatgtgtctgctagaatatttagtgttttccttacttcctttattgtctctcaatataaataccccttaatatgctaaataccttctcttctattttcatcagaagctgattctcgaaggaatgatacatacattatcgtcatcttattcaattcccattcacttttcaacagactaaaataagaaatccatattcactactattttcagggattgatatcgctctactttccctgacaattgtttccacaaccctggaatttccttcctcctttttatatttccacaaattctttcaccactcagctagaacactcactttcgtagaccaagaaacttagttcagccatcaacttgtcattttttttatgtgtcttctagggtaaacaaattttgttaagtattaaggaattacttgctcaagggacatttattctctattgtccaaaaactctgagtcctaatttgtttgctcttctagtcacctctaatgacagccctgttgatatttagcttagagggtactttcttaattgagctgaaatatattagagagaaaaacacacaaatcaagggcaagtcagaatgtaaagttgttcctaaaatggcaggacaattatagtaaaataggccaggtgcaatggctcacgcctgtattctcagcactttgggaggccaaagcgggtggaccacttgaggtctggagtttgagactaacctggccaacatggtgaaaccccatctctatttaaaaaaatacaaaaattagccaggtgttgtggtatgcagctgtaattccagctacttgggaggctgaggcaggaaaatcacttgaacccaggaagcagacgttgcagtgagccgagatctcaccactgcactccagcctgggcagcaaagcgagactccaactcaaaaaatatgtatatatgataaaataagagcaaacatattttatatcacaaggcaagttagttacagtaaattgcaggtgcagatgaagtagttatcaaggagcttaagtactgaatctgaaagaaactccagctttatttacagtgaatactgtaaataagacattttctatattattataacaaatttttgtaagtatatttttcttatttataattcagtatttttgtattaaggtgcattgattaatgataatttactttctatctcaattatgaagatgtataatttctcttttttttctcttttttctttccaatgtttattttaagttcagggatacatgtgcaggatgtgcatgtttattacatagataaacatgtgccatggtggtttgctgcacagatcatcccatcaaccaggtattaagcccagcatgcattagctattcctcctgatgctcctcctcctcccagccccatcctctgacaagccctagtttgtgttttttcttatcatgtgtccatgtgttctcatcattcagctcccacttataagtgagaacacttattttgttttctgttcctgaattagtttgctaaggataatggcctccagctccatccatgtttctgcaaaggacacaatcccattccttttcattgctgcatagtattctgtggtgtatatgtaccatattttctttatccagtctattattgatgggcatttgaataagaatgtaagaataacttatattcttttgggtatatacccagtaatgagactgcttgattgaacggcatttctgcttctaggtctttgaggaatcactatattgtcttccacaatggttgaactaatttacactcccataaacagtgtaaaagcattcctttttcttcagaccacggcagcatatgttgtttcttgacttttcaataatcgccattgtgactggtatgagatggtattttattatggttttgatatgcatttctctaatgattagcaatgttgacctttaaagccagagtggctcctttcctccaaatgaccacaacacctttccagcaagggctcagaactggactgaggctgagatggctgaaatgacagaagcaggcttcagaatgtggataaaaacaaactttgctgagctaaaggtatctgttgtaacccagtgcaaaaaagctaagaatcatgataaaacaatggaggaactgaaagccaaaataggtgcaatacagaggaacatgaccaacctgacagagctgaaagacacactacaagaacttcatagtgcaatcacagtattaatagcagactagaccaagaatattagaggttgaagactctctgtctgaaataagacaggcagacaagaatagagagataagaataaaacggaatgaacaaaacgtttggaaaatatgggattatgtaaagagatggaatctacaactaattgcggtacttgaacgagacagggagaatggaagcgatttggaaaatgtacttcaggataccatcaaggacatcttccccacctagcaagacaagccaacattcaacttcagaaaatgcaacaaaccccagtaagatgctccatgagaagatcatccccaagatacataatcatcagattctccaaggtcgacatgaaagaaaaaatggcagccagagagaaaggccaggtcacctacaaatgaaaacccatcagactacagaggacctctcgggggaaaccctataaactagaagagataggggggccaatattcaacattcttaaagaaagaattttcaacctagaatttcacatatggccaaactaagcttcataagcaaaggagaaataagatccttttcagacaagcaaatgctgaaggaatttattaccaccagacctgccttatcagagctcctgaaggaagcactaaatatggacaggaaaaactgttaccagtcactacaaaaacacactgaagtacacagaccagtgacactatgaagcaactacataaacaaatctgcaaaataaccaactagcatcatgataacaagattttttttttttttcttaagacaggatctcactctgtcacccaggctgagtgcagtggcacaatcacggctcacagcagcctcgacctgtcaggctcaagcgatcctcagcctgccaagtagctggagctacaggcacatgtaatatgcccagcaaatttttgtactttcagtagagatggggtcttgctatgttgtacaggctggtcttgaactcttcaattcaagtgatctgctcacctgggccccacaaagtgctgggattacaggcataagccactgtgctcagaaagatgtacaatttctacttggcattcttactgccctaatattaatgagtttttttattatgggaagaattaaaattttgacattgtgacggggccttcctaaagacccagagcacttctggatattattagatagaaaaatcttttgtaaatgattatacagtgaataggatactacactgtccatgacttggggattaaactccaagagagggttttgtgaaatgtgcattattttgtgctgaggaggtagcagcttcatcatggacctggtgcccatcagtcggttattagccaaagacattcatgcctttcagcctccccataagctcagctatttactagttactccataatcccatttctctcttgtcagcatttaaaaaaaaaaaaactttatactaggtttgcaattagttgactataatattaccaaggaatctgtcagtaatttatatagttgctacttaccaatgtaatcacatttgcctctctagtgtaacatttaaaagaatgagacaaatagttttggtcacttacaatgtacttttagtttttagttctttatctttgtaactttttttattgaagcataaaaagaatttggaaaaattctcaaacaccaggacatagaatcacagtaaatcacaatctgcccgaccccatgatccttttaggcaattaactccgatgacaaccacattcttacctgaaacgatagatagattttgcttgtccttgatattatattactggaattataagatatgcatgttttttgcctctggcttatttcatcaaaatctttgtgaattttatacaaatttatgtgcatagttgtattttgtttgttttcagttccacagaatacaaatataccacaattcataaactcattttattgcatacagagcgtaagtgataattctagaaaatgtcctttgttgaaggtatgtacacatttatgtttggtatgattgcaaatatgagacatatggtataaatatgttcaatagatactatcaaaaagtgttccaatgtggtttttttttaatgaaactctcggcagatttaatttttttaattgtggtaaaatatacttaatataaaatttgttatattcaactatttttatgtgtacaatttattggcatcaattacaacataatgttgtgcaaccattactactatctttttccaaaaatttcctcacctaaacagaaacactgtacccattaagcaatatctttccatttctgcctttcccctggtaatctcttgtacattctttttcaatgaatttgccttgtctggataattcatgtaagtggtatcatgtaatattttcccaggcaacttaaatcacttagcacagtattttcaaggttcattcatgcggtagcatgtatcagaacatcatttctttctcggactgaataatattccattgcattcatataccacattttctttatacattcttctgttgacggacatttgggttatttcaatcttttggctattgtaaataatgctgcaatgaacattggtataaaagtatctgagtccctgggtatatatctgaaagtggaattaccaagttctatggtaattgtgtagaggtatttagctttttgagacaccatcaagctatttttcacagcaactgcactatttacacttccatctgaaatttatgagtgttctaatttcggcacatcctggaaatttgttagtttcttaattaattaaatattttttattataaccatattagtaggcatgaagtaatatctcattgattatgatttccatttcccaaatgattaatgatgttgagcatcttttcatatgcttattgcgcatttataaatattatttgaagaaatgtaaacttaagccaattacaaaaattttattggattgtccctttgttgttgaattgtaattctttatatattctggatattgaatatttatcagatatatgattttcaaatattttctcccatcttgtaggtagtcttttcactttcttgataatgtcctttgttgcacaaaagattctaattttgttaaataatttgttaattcttttgtttcttgtacttttggtgtcatatctaagatttccttgacaaatctaaggttaagaatatttatctgcatgatttcctttaagaattttatgattttgtctcttatatttaagtccttgacccattttgagttcattttttaatacagcttaactttttttttctgcatgtggaaattcagttactgtagcatcatttgttgaagccagcggtaattatgagtgtttcaattattccacattctcataaagatgtagtgttctctgtgcttctatttttctgttatgtaagggttttatactttggttataatttgtatttaaatgtacaattatatttactgtgaaggtcagtaccctttcatatgtttattggacatttggatgtcctattttataaagtgcatgttctagcatttgtctcacttttcaaatgtgaaatgctaatttgtttatatatgttggataagaggcttttgtggcttaatttcttattctcttaatggtgacttttgaaattcttagttgtattataataaaatttttcatctcttttcattgtgattaatccttttcggtgttaaatttttttgctagcccaaattcataaagatatttttctgtactgtcttctagcagtgttaatttgtacatttatatttccactcaatttgtatttattttgtatatagtataatataggaatctattaatagattcttttttgaaaatatcaataaacatataagtggcccagcagcaattattgaaaaggccatttttctcttattgtactttacatttttttgatcagcttgtctatacttttaccaattttacactgtgctaattactagagcgttgcaataaatcttgatataaattggaatgagtcatttagctttctttttcctcttaacattgtttggctatgtaagacccttcatatttctaaactaatattggaaagaatttgccaacctcaacaaaacaacagaaaattgtacctagttttgatcgatatcacattggatctaaatatttagaaagaattgtgatttgtataatgttatgtattttcataaaatcacattgtatacctgtacttgtacaggtttgttgtacatatgtatgtcgtgtatgtatatacacaaaaatatattctgctatttcttacagcacagttttgcagcatttggtgtcaatttaaatataatttattataattattctcagttatttgatattcttaattttattatgaatattttaaacttttattttctaatttttattgcatataagaaaaattaatctatatattgacttttatacaaccaacatgctaaatttatttattgattcctatagtttgccaatggatgcttttggattttctatatatgtaattgtatgatctctgaataatgagagttatttcttcctttgtaatcttgtggtctttatttctttttcttttattactacactaagtagaacttgtaatatcattaatagaatttgtaagatcagggacacatggcatttctgatgccaaaggaaatacattcaacaattcactgtaactataaaatttacagtatgtttttggttaatattcttcgtcatattgtataaatttccatctacttacatattatcatgaaacatattgatggttgcttaattttatcaaatattcttcctaaatatatcaataatatgttttctttttattaatatgtaataaattctattcattgattgaaaaatattaagctgctctcacattcctgtaataaaccttaattggctttgtgatatattatcagttttcataaatatatgaatacagttgaccctttaacaacataggtttgagctgcatgggtccacttatatacagattttctttttgccactgccacacctgagacagcaaaaccaaaccctcctctgccttttcctcctcagcctagtcaatatgaagacaatgaggataaagacctttcaaacgattccacttccacttgattaataataaatatattttatgttccttatttttttaataaaattttcttttctctagcttgatttattgtaagaatacagtatataatacatacaacatacaaaatatgtgttaatcaactgtttatattatcagtaaggcttctagtcaacagtatgctatgagtagttacattttgggggagtcaaaagttacgcacaaattttcaattgcatggataggtcagcatccctaaccttcacattgttcaagggtcagttgtaaaatgatttcatcagtgttggtaatacattattctgtgattttttttctactgatgttcttgccaaagtttactataaagaatatgatagctttaaaacaggacatgtgaagtgttctcatgctttttatgttccctaaaatactttttgtaatatcagtgctatttattttctaaaaattagaaataattcatagggcacatcctgtgtacctcaaattgtgttgagggtattaatgaattcattgttttacatatatataggactatttaggctttctatttcttcttgagtctgtttcaacaagtttttcttttgtgatatatgcatatgtcatataaagtatcaaatatattggcctgaaatatttttaatcttcttctctttaatttgtaagaaagacctatagtaattatccagttttcattagtgatattagaatgtatttctttatttgattttactttttctttttttttttattatactttaagttttagggtacatgtgcacattgtgcaggttacatatgtatacatgtgccatgctggtgccctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgttcttgtgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttcaaacataaaaaaatggtaattttgtatatatccaggaatctactataataattatcaagtcatgatcaatcttgttattttatctatactcccacccattttgaaactgcattgtccatattattttgaattaaatcccatgaatcttatgatttcatttatacatatgtttgtgtgtttttttttttttttttggcagagtctcactcactctgttgcccaagctgtagctagagtacagtggcatgatctcagctcactggaacctctgcctcccaggttcaagcaattctcctgcctcagcctcccaagaagctgggattctgggagtggtggcacatgcctgtaatcccagctactcatgagaatcacttgaatctggaggcagaggttgcagtgagccaagatcgtgccactgcaccccagcctaggtgaaaaagtgagactccatcttgaaaaaataaataaaaataaatacattaaaaagtacgcaaattcaacttccggggtgtttgtccattttcctaactttttaaaaagtaattcttttcttgtgttactttttcctctgtcatcgtggtagttagttaacactagtaggacccatgggttatgcttcagtgtttatgcctttttgtagttatttcctcctgaatccaagcttagcttataactcaaagactttagaatagaatatagcaaaaatattgctgtgcaatcctagcctaggctttaacaaagtataaaacttctacttacgaactcttagaagtcctaaagtttcacatgagaattctagatgaaactgtgtaaagagaaaatatgaagaggtcatgtggagagagaaccttgagaactgaagaatccagacattcctcgaatctagctcttctagccagccctccaccgcccaaatctcccttgctgaggcaccaaaaagctaacgaagctgttgcagcctttccagtgacagcaggcactgaagcgagcgtagataagcccactgcctctgtaaaatcctgaccctcagaatcatgagaaataacaagtgattgctgttttaagccacaatatttgaaaggtagtttgctccatggaagaagattaacaaaagatagaatgacaccagaagaggggtgcttcagcaacaaaatatcaaaatatgcagcactggctttatgatcaggtggaagttatggactaaaaaccttgaggaaactgttagaaagagcaaaaaacaaatggaccttaatgatattggcacaaaaatcagtgaagctgccaccttcttatgtggaagatagcaaatgtggctaataaacttgcaaatctggctaataaaatttccgtgcagagtggtgaatgcaccaagtggttcctttaattgcctacaataaagaatgtgagaagtgagatgagctaaaagaggaattgctggaatttttttttctcgatatgccctcaatccattctagtactgtaaaggcaacattctatgggttgttggtttctctgaaggaaatgaaagtaagcaacaagaaggcatccagggagaaatcattccacagaagtaataggtagcatttcggatgttacgcttttattagcatcatcatatcttaataatgagaggacctctggaggtcttttagctctttggaaacaggtccacgcatatttgaaatattgaaaactgatccagagcagaagaataaatttcccaatatcacacaagctggtgagaagcagagctgaaaataaaatctaattttcctggcatccttcctgctgcacagcattgaagttctcttccttttgcaaagtgagacagggtagtgatagagatatctcaatgcttaactgtcaaactgaacccaggctgcttgatagcgtcacagggagaaataatctaaagggctgaaatgaagacaggaaaatagttctcagcaagtggcatcaacttatttggtatttttttctcagcttattgttacagacatgttagtggcaaatctgagaaggttcttttgtgaatcaggttatggctatgattgttcaaaaagctcattaccaatttatgaaaagcagcaaaactcattttctcttaatgtgaaatcacttcagcctgtcagtagagaaagaattgttgaaaagtgaattgaccacatacggatccattctttcttttaaaaagaaatgaaaaagtcatctaaaagggaaatatctctcaataatgagatatatgtaacactcagccggagttaagccccagttaagatggttttctgaattgggctacttttctcatttgcctactgtgggtaccacacaggtagacttcataaacctgagttatctgtctactaaagagcagcaggggctctttgactcaggatttcattaaaacaacaaaaggattttggggaataactgaattcactctctggaactagagatacatagtttaatacatacatattctttccataaattgaatgacttaagtgatcaaaatgagttctgatcacaattcctggttcctccacattaagaaataaacaatgattgttacccatagtggccgtagagataggtctatgctgagtgacactgtttttctgtgttctgtctatggttcctatgacctctctcatgctctgtcacttgggatagctagctcttattctagagtctttcaaagtcttatttttcacaccagagcatttggccaaggttcagcatttaaccactgtgtctttgtcttttttttcctatagctttatcttccactctccattgaaaatccctggatatctacttaattcattaaagtcaggagaggttgtgggcactgcagctttctgattattttaagattggctatctgcattatctctgccatgatcatcattggtctaatccctcacttatttgtttgtttatttttaaggacttaattactttagagcagttttcggttcatagcaaaactgaaaggatgtaacagggatttcccataagtcctctgccccctcacatgcagagcctttcattatcaatatcccctaccagcatgggacagttgttacaaatgatgaacctacattgacatatcataatcaccaaactccatagtttacattagggtttaccctcactgctgtacattacataagttggaaaaatttataatgatatgtgccaccattaaggtaccatgcagagtattttccctgctctaaaaatagtctctgctctatgtattcaacctcttcacccccaactcctggcaaccactgatctttttactgttttcataattttgccttttccggaatgttgtatcattggaaatttacagatcggcttctgcgactaaggaacatgcacttaagattctgacatgttttttcatagcttgatagctcatttctttttagtgctgaataacattctattgtttggatgtaatgcaggctatttatcctttcaccttctgaaggatggatatcttggttgctttccaagtttgggcaattagcaataaaggtgctttaagcattcacacgcaggcttttgtgtgaacaaatattttccatttctttgggtaaataccaaggaatgtgattactggttagtatggtaagagtatgtttagttttgtaagaaactgccaaactctcttctaaagaagctgtaccattttgcatttccgccagcaacaaatgaaagctccactccagcatttggtcacgacggtattctggattttcctggatgctaacagatgtactgctcctttgttttttgataaatgagtacatgtatcttcagaggagaagtgtgctagttgcttatagcaagagtataaatcaacaacatcttcatgaagcaacagttgtataattttaagacattaagatagatttatagtaaattgatcacgaatattttatagaatataatgaaaaaattgataggttttagatataattacagattccaaaagtattgtttgaaatgagccactaactccattatccactgagggcaattttataaaaaaatatgagaccaataacaataataacaaaaacaaaaacttgatacctataggtgtatttacattttgaaaagctattaaattctatagttttaaatctaaactgcattgctcactgatgtatctatttgtgtgtgatcagcagacaggtttaacacttttcggtttatatttttcttcatatatatgataattcactcagttgagtgtttctaagtgaacatccatcatttgttaatatcttataaggccatgtaatcagacaaggcctaattcttgaatctgaatgcctaagatacgtgttctggtgtgaccacaactacactttctaggtatttattgaaaatgagactaccacatatctgcataagaaccttcaggagcatgccatcaggaaaaaaacaaaaaacaaaaacaaaacaaaacaaaaaaaaaacagtgtgagaacagtgaccagcaaactagactccaggaatcccctgaaacaagttttcatatcagcacttaagtcattctttaaaataatgttataaattgcgcacttgattctctagattctaattattctaattttaagccattaaacgcataggtaaccatgacacttccataatcctttcgttttttttttattgtactttaagttttatggtacatgtgcacaatgtgcaggtttgttacatatgtatccatgtgccatgttggtgtgctgcacccattaactcatcatttagcattaggtgtatctcctaatgctgtccctcccccctccccccaccccacaacagtccccggagtgtgatgttccccttcctgtgtccatgcgttctcattgttcaattcccacctatgagtgagaacatgtggtgtttggttttttgtccttgcgatagtttactgagaatgatgatttccaatttcatccatgtccctacaaaggacatgaactcaccattttttatggctgcatagtattccgtggtgtatatgtgccacattttcttaatccagtctatcgttgttggacatttgggttggttccaagtctttgctattgtgaatagtaccacaataaacatacgtgtgcatgtgtctttatagcagcatgatttatagtcctttgggtatatactcagtaatgggatggctgggtcaaatggtatttctagttctagatccctgaggaattgccacactgacttccacaatggttgaactagtttacagtcccaccagcagtgtaaaagtgttcctatttctccacatcctctccagcacctgttgtttcctgactttttaatgatggccattctaactggtgtgagatggtatcgcattgtggttttcatttgcatttctctgatggccagtgatgacgagcattttttcatgtgttttttggctgcacaaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcattctgatggtagtttcttttgctgtgcagaagctctttagtttaattagatcccgttcgtcaattttggcttttgttgccactgcttttggtgttttagacatgaagtccttgcccatgcctatgtcctgaatggtaatgcctacgttgtcttctagggtttttatggttttaggtctaacgtttaaatctttaatccatcttgaattgatttttgtataaggtgtaaggaagggatccagtttcagctttctacatatggctagccagttttcccagcgccatttattaaatagggaatcgtttccccatttcttgtttttgtcaggtttgtcaaagatcagatagttgtagatatgcggcattatttctgagagctctgttctgttccattgacctatatctctgttttggtaccagtaccatgctgttttggttactgtagcgttgtagtatagtttgaagtcaggtagcgtgatgcctccagatttgttcttttggcttaagattgacttggcgatgcaggctcttttttggttccatatgaactttaaagtcgttttttccaattctgtgaagaaagtcattggtagcttgatggggatggcattgaatctataaattaccttgggcagtatggccattttcatgatattgattcttccaacccaagagcatggaatgttcttccatttgtttgtatcctcttttatttcattgagcagtggtttgtagttctccttgaagaagtccttcatgtcctttgtaagttggattcctaagtattttattctctttgaagcaattgtgaatgggagttcactcctgatttggctctctgttattggtgtataacaatgcttgtgatttttgtacattgattttgtatcctgagactttgctgaagttgcttatcagcttaaggagattttgggctgagacaatggggttttctagatatacaatcatgtcatctgcaaacagggaaaatttgacttcctcttttcctagttgaataccatttatttccttctcctgcctaattgccctggccagaacttccaacactatgttgaataggagtggtgagagagggcatccctgtcttgtgccagttttcacagggaatgcttccagtttttgcccattcagtatgatattggctgtgggtttgtcatagatagctcttactattttgagatacgtcccatcaatacctaatttattgagagtttttaacatgaagggttgttgaattttgtcaaaggccttttctgcatctatttagatgatcatgtggtttttgtctttggttctgtttatatgctggattacatttattgatttgtgtatgttgaaccagccttgcatcccagggatgaagcccacttgatcatggtggataagctttttgatgtgctgctggattcggtttgccagtattttattgaggattgttgcatcgatgttcatcaaggatattggtctaaaattctcttttttggttgtgtctctgcccggctttggtatcaggatgatgctggcctcataaaatgagttagggaggattccctctttttctatagattggaatagtttcagaaggaatagtaccagttcttccttgtacctctggtagaatttggctgtgaatccatctggtcctggactctttttggttggtaagctattgattattgccacaatttcagctcctgttattggtctattcagagattcaacttcttcctggtttagtcttggaagggtgtatgtgtcgaggaatttatccatttcttctagattttctagtttatttgcgtagaggtatttgtagtattctccgatggtagtttgtatttctgtgggatcggtggtgatatcccctttatcattttttattgcatctatttgattcttcttattagtcctgctagcggtctatcaatttggttgatcttttcaaaaaaaaccagctcctggattcattaatttttggaagggttttttgtgtctctatttccttcagttctgctctgattttagttatttcttgccttctgctaggttttaaatgtgtttgctcttgcttttctagttcttttaattgtgctgttagggtgtcaattttggatatttcctgctttctcttgtgagcatttagtgctataaatttccctctacacactgctttgaatgtgtcccagagattctggtatgttgtgtctttgttctcgttggtttcaaagaacatctttatttccaccttcatttcgttatgtacccagtagtcgttcaggagcaggttgttctgtttccatgtagttgagtggttttgagtgagtttcttaatcctgagttctagtttgattgcactgtggtctgagagacagtttgttgtaatttctgttcttttacatttgctgaggagagctttacttccaactatgtggtcaatcttggaataggtgtggtgtggtgctgaaaaaaatgtatattctgttgatttggggtggagagttctgtagatgtctattaggtccacttggtgcagagctgagttcagttcctgggtatccttgttaactttctatctcgttgatctgtctaatgttgacagtggggtgttaaagtctcccattattattgtgtgggagtctaagtctctttgtaggtcactcaggacttgctttatgaatctggatgctcctgtattgggtgcatacatatttaggatacttagctcttctttttgaattgatccctttaccattatgtaatggccttctttgtctcttttgatctttgttggtttaaagtctgttttatcagagactaggattgcaactcctgcctttttttgttttctatttgcttggtagatcttcccgcatccctttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcatgtcattatgatgttagctggttattttgctcgttagttgatgcagtttcttcctagcctcgatggtctttacaatttggcatgattttacagtggctggtaccagtttttcctttccacgtttagtgcttccttcaagagctcttttagggcaggcctggtagtgacaaaatctctcagcatttgcttgtctgtaaaggattttatttctccttcacttatgaagcttagtttggctggatatgaaattctgggttgaaaattcttgtctttaagaatgttgaatattggcccccactctcttctggcttgtagagtttctgcctagagatccgctgttagtctgatgggcttcactttgtgggtaacccaacctttctctctggctgcccttaacatttttttcttcatttcaactttggtgaatctgataattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccaatcagacgtagatttggtcttttcacgtagtcccatatttcttggaggctttgctcatttctttttattcttttttctctaaacttcccttctcgcttcatttcattcatttcatcttccattgctgataccctttcttccagttgattgcgtcggctcctgaggcttctgcattcttcacgaagttctcgagccttggctttcagctccatcagctcctttaagcacttctccgtattggttattttagttatacattcatctaattctttttcaaagtttttaacttctttgcctttggcttgaatttcctcctgtagctcggagtagtttgatcatctgaagccttcttctctcaactcatcaaagtcattctccatccagctttgttccactgctggtgaggaactgcgttcctttggaggaggagaggcgctctgttttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagacactgtttgcctgggtatcagcagtggtggctgcagaacagcggttttacttgaaccgcgaatgctgctgcctgatcgttcctctagaagttttgtctcagaggagtacctggccgtgtgaggtgtcagtctgcccctactggggggtgcctcccagttaggctgctcgggggtcagggacccacttgaggaggcagtctgcctgttctcagatctccagctgcgtgctgggagaaccactactctcacacttccataatcttttcaaaaattactgaaggtgaaagttaaatctgccattttgtctactttttatataataactattccagaatatgactgaagaaataaactttgtatcaaaagatctaaattcagatagtagcgtcccaatctatgaatgggaggatacttagaagttatctaaactctctatcagttttcttatccataaaataagaataatgtggtttaataaaccttttgcaaaaattaacatacatgttgatatataaaaagacttttttttttttttttgagacaaggtcttgctttgtctcctaggctggagtgcagtggtgtaatctggctcactgcagcctcaaacttctggacccaacaatcctgccacctcagcctagttgtcttcttcagtagcagagaaagtttagtgggcattgcctcttcactcatctctgactaaaatggaaacaaccaattaagaataaagtaatccttttatggaacattttcattttactatgcaaacatctgaatttgaacacatgaaaatcagtgatagccaaaacagctataaaggatgaaatttaatggggggaagaagcaacatggtccttttatttgcagctcattaaactcactggttgtgtagtagaattccacgtctattattaggttagtttggattgtgtgttgggcacacaatgaagcagtcagatgtatagactagggcaataaacacaggcgaaagttgagaatatgacttatttttctctgggatttcaaaatctaattgagcagaaagacatgaaaaaggcagctgatgtatattttcatataagaagtagtcaacttaaacacagggtgtaatgagagaaggcactatctaacacaaactgggagtgaggggggcagttgactgagtaagtggggagcattcagcagaaagtggctgcttgcatagtatgaggagactttataccaaaacaaagatgaaggtcatctaaagaaaagaatacagtggtagaagtggaaaagcttattgatacatacaatcctagataagagtccaatatggcccaagaggaggtaaaataattagtctcctctactcagctctgcagtgctgtagactcttccaacttcaggtttattactgtcgaaaagagaagcagaggctacctaagtgggccagaacacctaccacataatgagttaggctgtaaaaatggtattatcactaaaaatttgacatctacgaagtttttatgtgttctctattcataacatttttagggcataaggatagacaaatgtctttctagagattacctgggataaacactagtgtggcaggattagcaaatgctcatattccagggcatcatgcttccaccccatttaaataatctgattgtttcattactcttgaatcagctagctcttgcaattgctaagactgattgtaaaggagttcaatcaacatgtctttttcaaaaataaaagtaaaaatttcatgtttggcctggcatggtggttcatgcctgtaatcccggcactttgggaggctgaggtgggaggatcacctgaggtcaggagttcgtgaccagcctggccaacatggagaaaccccatctccactaaaaatacaaaaattagctgggcatggtggcacgtgcctgtaatcccaggctgaggcaggaaaatcgcttgaacctgggaggcgcagggtgcagtgagccaagatagcaccatcgcactccagcctgggggacaagagcaagacttgcctcaaaaaacaaaacaaaaaaaaaacccgtcacgtgttgttgttacaacattagggcaagctttctatagaagagtaataaaaggccactaaacaattaccaaaatcctgctactcagaaatgaaaccaaaatacacacattgttattatttagtgaacagcattcttcatatttctctgtggagacagacatatgaatagacatgtaaataaacagagtaatagatcaattcatacaatcccacaaatgagattctgtaccacactacgttatttttacttttataatatttaatttaatgaatataataaagcagaagtaaaattatagcaaaaattattctggcacaaaaaaatttaattctaaaatgtagttctaaattaaaaacagcaaaagcaacaaaaacagaagataaaaataagagtattgtgtcattttttctacaattcaacttgaaatagtgacttcatattcatatttaatagaagaggatataatatttgtacctctattctccatatggatcgatttattttgttatattgttaagtttacattgccaatgctttaaacagttattctcctttaaccatgattgacaaagattttgtttcattctaatttaatttcaatatttaaatagagggtaattttcagcatcattcatttcactgaatcttcacattcttgagtctgttattttaatttctgtctggcttgacgtgttttcaagtcaagagtgagaagtaaagctcctcggtgttttcttccattacacttgcaagaacacatgactggcttcagaattctagggtcacattcctttctgtcagaatttagccgtcactgcctcactgccttccatccagcatggagcatttctgtggaaagtcttccaccctagaggcctccattttgatcagttttggctatttattccaaaaatatactggacttcaattcttcttactgatttgttttcctttagcaattgtatttcttaattttcaaaagcttttatgtattttattttttgaatttttttacttgttacagcttcctctacctttgagatgtataggtgttatagattttctctctctgaacataactgcatatcatttttaaaagttttttcccaggcctgtattgtatcttttattatagatttacttgtaattattattattattatttttaccttgatccctgcctttcatgtttgaggttactgtcaaatctcggttgtctattcatttttaagatagaggaactgtaaaacttattggagatggtatttgggtgatgttacatgtctgcttgtgaatttctctatacttattactaccagtgtatggatctgaacagaagaagttatgagagtgatttacaattaatgtaagtacagtgagattttacccttctgtttggtagaccttattctcttgttttgtgaattgtgtccctacacctggcccttctcttgacatatttctccagagaataaatatctagccttatgcctcattctagaaagaacaggtactggactccgtgggatgtaattgggaaatggaagctctttgtttcttctgtgaactttcacaccagccaccaccaactacagtagtactagtgctcattcctaaattcatttgttctgcaaagttgaattgcttgtttcttactagtttctgcaattgtttgaggctttttcactcacaagttagagaatgagacttcagctaattctttactgtgtctccttcttgttctgtgtgttttttgaaggagaaagaagtcaaaagttctctatcatcataaagtcaaaaattcatattttatttgttttgctcttttcttcggaaacatcaaatttatagtacatattgcttttcttgtcatttctctccattttgtaatttgtgtatgcagaattctaagatgacctctaagagtttcaccccctggtgtgtatgtcccatgtaattccaacatcaaggatgagcagacctgtgactatgagggatagttactctcatgagtatataaagctacataagacttcttcctagcccactggagagagatgcttctgctggttttgagtaagcagccatgttgtcacagggcgtggccaacagcctgcaacaacacagagacctcagtcttacacctgtaatgaactgaactttgccagcaactggatgagaactacaggaagccagtgccttaatggcagaatgatgggctccttagcagaagacctacataactcagggctgggctctggacccacagaaatagtaatttccgtgttgttttgtgttgtcttgttttaagcaactacgtatgtggtgatgggttatgtagcaatggaaaactactaccacacttgatcatataattttattctcctgctttaacttgatgctatatgttatggcaggaccatctttccaatggaatgtactatatgctctgaggcagcctactcatgtgactttaatttccgtaatggttataatattttacttttgttgtaagcttctcaaatttactttttattttttcaaattgcatggctttttaaaccctatgtctttttttccaacttaaattgttgtaataatatcattcgttttcaatcataagggagtatttgtatgaaatcttccttcgtttcttgagtgatttcctttagaatgtgtgctcttcattaacctattgattatcatcctctcctcatcaccaccatcaatcacgcttctctctccacccctttccccaactttcactctcaggatttcagaatatgtcttctcacttccttcagtcatttgcctatttttttaaattactcttttattttagatacaggagacacatgtgtaggattgttacatgggtatattggtcccaagtagtgagcatagtactcagtaggtagttttttaacctgtgccactttcctcccttttctgtctagttgtgtgcagtatctattgttcccatgttaattttcatgtgtgcttaatgtttagctccaacatatacatgggaatatgtggagttttgctttttgttcctgtattaatttgcttaggactatggcctccaggtccatctatgttgctgcatgggacatgatttcattatactttatgctgcatggtattccatgatgtatatgtatcacattttctttatgcaattcattgttgatgggcacctaggttaatccatgtctttgctattgtgaatagagctgtgatgcacatctatatgcatgtgtcttttggtagaatgatctatgttcctttgagtacataccaagaaataggatgactgggttcaatggtagccttgttttaagttctttgagaaatctccagactgccttttacagtggctgaactaatttacattcctacaaactacaaatgaggattccctttaccatctgttgttttttgactctttaataatagtcattctgactggtgtaagatggtacctcattgtggttttgatttgcatttctctgatgattagcgatgatgagcgtttttttcatgcttgttgaccatttatatgtcttctattgaggagtgcctgtccatgtcctttgtccattttttaatggagttatttgcttttaatctgttgatttaagtagattatgaatattagacctttgttggatgctgatatggttttgctctgtgacactcgcaaatctcatctcaaaatgtaatccccacatgtcccaggagggacctggtggaaggtgattggattatgggggcagtttcccccatgatgttctcatgacagtgggtgaattctcacaacagctgatggttttaaagtgtggcacttccttgttttcttgctctctgtctcctaccaccaggtaagaagtgccttcttccccttgaccttttgccataactgtaagtttcctgagtcctatccagccatggggaactgggagtcaattaaacctcatctttttttttttttaaataaattactcagtctcaagtaatgctttataagcagtgtaaaaacagactaatacagatacatagttaatgaatattttctcccattccataggttgtctgcttattctgttgctgtgcagaagctgtttagtttaattaggtatcacttgtcaatttttgtttttgttgcaattgcttggggacttagccaaaaattatttgccaaggccagtgttgacatgagtatttcctaggttttactctagtgcttttatagtttgagatcttacatttaaatatttaatccatcttgagtaaatatttgtattagtgaaagataagaatttggtttcatttttctgcttatggcaagccagttaacctgaaacatttatcaaatggcaaatcctttccctattgcttgttttcattgaccttgtcgaaaatcagatggttgtaagtgagcagctttatattttagctttctattctgttccattagtctatgtgtctgtttttgtatcagcactatgctgttttttcactgtagccttattgtttgaagttgatagtgtaaggcctccagctttgttctttttgcttaggtttgcattggctatttgggctcttttttggttccacataaattttagaatagtttttctaattctatgataggttgataggaatagcattgcatctgtaaattgctttgggcagtatggccatttcagtgatattgatttttcatttctatgaaacattaaaacatcccatgagtatggaatgttttcccacttatttatgtcacctgatttctttcagcattgttttctagttctccttgtagagatttttcaccttcttggttacctgtactctcagctgtttcattttctttgtggttattgtaaatgtgattgtgttcttaatatgactctcagcctggatgttattggcacatataaatggtactgatgttttctacattgattttgtatcatggaactttgctaaaatcatttattagttccagtagcctttctcctgcttgattgctctggctctgacttccactactacgttgaatatgaaatggtcagagtgcttgcctttttttcagttctccaggggaatgtttccagcttttgcccattcagtataatgttggctctgggtttgctatagacgactcttattattttgagtcatattattttgatgtctagtttgttgagggtttttatcatgaagtgatgttgaattttattgaagtttttctgcattttttgagatgatcagatagtttttgtgtttaaatctgcttatgtggcgaatcatatttattgatttgcatatgttgatccaaccttgcatcccaggaataaagcctactttatcgtggtgaattaactgttttatatgctgctggattcagtttatcaatattttgttgagaattttttgtctgtgttcatcatggacattggcctcaagttttctttcttcattgtgtttctgccagagattgagtttgaaaggattccctcctttttttgtaatagcttcagtagaattggtaccagtttttctttgtatatctggtagaatttgactgtgaatccatctggtctaggacttttttggttggtggtagtttttttttattacatatgattcaatttcagagtgagatatttcactattcaatgcttcaatcttttcctgattcaattagagactgtgtgtttctaagaatttatcaatttcatctacagattttctaatttgtatgcatagagttgttcatggtattctatgggaaacttttgtaattctgtgggatcagttatattatctttgttatttctgactatacttatcttctctttttttcattgtaaatctagccgttaaatagcagtctattcatcttttcaaagaacaaactcttgcttttttattattttttctacggatttttctatctcaatttcagtaagttctctaattttagttatttttttcttctgctagctttttcttttctagttcctttaggtgcaaagttagattgctaaattgagatctttctaacttctcgattactgtatttagggaaataaactttcctcttaacactgctttggctgcatctcaaagattttggtaagtcatattcctgttttcaatatttcaaagaatttttcttaaatctacctttattttgatgttcacctaagagttattcaggagtaagttgtttaatttccctatatttgtgtagttttgagaggtcttcttgattttgatttctatttttatttcactgtggtccaagagtttgcttggtataatttcaattttttgaatttattgagacttgctttatgattaagcacgtggttgatcttagaatatgttccatgtgcagctgggaagaatatatattctgtggatattacctggggtattttgtagatgtctattaggtccaattgttaaagtgttgagtttatgtccagagtttgttagttttcttccttaatgatctgtttagtgctgtcagtggggtggtgaagtctcctgctgttattgtttggttgtctaagtgttttcatgggcaatgaagaacttgttttatgaatctgggtgctccaatattgagtgtatatatatttagtacagttaaggtttcttgtttgattgtaccctttatcattatgtaatgcccttcattgttcttaatttttattggtttaaagtctattttatataagaatagcaacttctgctcttttttgctttctgttcacatggtagctctttctccattcttttgctgtgagcctgtggttgttcttaatgtgaaataggtctcttgaagataacagatggttgggtcatttatccagcctgccactctgtgtctcttaagtggagcatttagcccatttacattcaaggttagtattggtatctgtgattttaattctgtcatcatgttgctagctgattgttatgtagacttgattatgtggttgctttatggcgcctgtgtgctatgtggttaaatgagcttttgtggtatgactgtcattctttcttttccatgtttagcactcccttaaggacctcttgtatggctagtctagttgaaacatattcccttagcatttgcttcacttcacttttaagcttagtttggtgggatatgaaattattggttaaaatttattttctttaaggatgctgaaaataagctaccaatctcttctgacttgtaagatacctgctgagaggtctgctgctagcctgatgaagttccttgtatgtgactttaccctgcctttaagacttttttctttagtgttgaccttgatgaatattgtactatgtgccttggaggtagtcatttcatgtcatatctatctggggttctgcgtgtttcttggatttgtatgtaaatctccctaaagagataagaggaattttcatgaagtgtatcttcaaatatattttccaagttgcgtattctctctcctctctcaggaatgacaatgagtcatagattttttcgctttacaaaatcccatattcttggaggtttcacttttttttcccatttttttccttatttttgtctgagttgacttaaagaacaagtcttcaagttttgagattatttcctcagcttggtctattctgctgctaatactactgattatttgataaaattctgataatgagtttttcagctctagaatttaagtttggttatttctgaaaatggctattttatcattcagctcttggattgctttactaaattatttgaattccttgcactgaatttcactttctcctgaatctcaatgggtttcctggccacagattctgcattctgtgtctgttatgtcagtcatttcagactggttagaaaccattgctggggagctagtggatcatttggaagtgagggtacactctgactttttggattgccagagttcttgtgctaattctttctcatctgggagggttggcatttctttaactgtggtgtaagttgagaatagtcagttggcttaatttctgaatgcttttagaggcccagggctcttacagaatctttatgtgtgggtaaatttttgacttggtttcacagctgtatatattagcagaataaaatttaggtgttgtagtttgggtggcaatccagtgaatgaggtttaacagtaatgactggtagctaggttaatacctggtcacagggcttttttgtacttcttgagttcacagatatgctctgcagtgatatggagtgatacggttccctcaacagatctgcttgtaaaacttgagagagctccctctgatagctggtgctgtgcccacatttcttttgttagtttttctgagccacatggtcttcttgggcagaagctgtggcagggagatatgccacatgctttttggactggacctgagaagggaggcatgttccactcttaccccagctcaggaatccgtgcatctcacccctctcacggctctgagattggggcctctttctctgtttgagtgccagccacaaatcttggttccatactcccaagctgcacactacagccctggggacactgggatatcccatggcttgggtttgggttcttgctgcactgggggatacagtgtgctccagggtcatgaagaaaatatgtgggtgcaactacacactcaggctgaccttccagggctgcactatgcacctgctcctacagggcagctaggcatggaccctgggaagggctggtaggcagaagggcttgcagagtagatgcaccccagtcgtgcaggaaagctggcccaactctctcctggcttggaggtcagtaggggtccatgcctcccagaggagaatggaaatccctggggaatgggcatctatggctgctcttgcctgcagcagtccagcacacaaaagctcctgggctctgtgctgtccaaagtctgtctctgcctgctccctagggagatccccctgccagctcacacatccatggtcgcgtaaggtcccttgtagctagaaaatcaaatgctcatggcaagagtgaaccatccctcagttccttcattcagtcctttactggaattgtttggggccaggaattagccctggcatttgggtagctaactcagggtttccagcttcctgcctcttcagtcttggcttcgaccttgcctctccatccactttcagcattttctccttgaatacctgttcaaattatggtggtttacctaataatttggcctctcttgagaggagtggcacttcctggctgtgtctagtcggccatcttgttcgtctcctctatcttaaaatggagtcaaccaatccactacaaataatgtgatttgaggaagtccaaagctctaattcaggtttttatttgtttgttttgtatgctttccgggttttttgttgttgttaaaaactatctcaacaattttattctctccaataaatgtacatctcatctaaattttggtattgagcttttttatacatcctatttccaaccaaaaagacttgtttttaaataaatgcaacttaatcatcctatttctattatttagatactatcattccttctatctggaggtctctgtaatggctgtattaacagtactcaaaagtaatgtggataataattgtggattttgttcttgtttttaaatctgtctttaatcatttcatgtaaagttgtaagcctttgaagcatttgagaatttcatacaaaacatttctgaaagataaattttctcatattttcttggacacgctgattgatcattttagttagtctctgaagaaatccatgaaaaagtacttgttactatttttacccacagcagcataatttaaatttgagttaaataggcttataaacaaatttgtataaccatgatgaaaaatcatcttcccaatagtatagctaaactaataaagtaactgtggtagggatgagcaattatagtccaagcaatgtaaactcaattcatacgtggaaaaccacaggggcaaggggaatacagtatatagacagtgtcagacagtatatagacaggaggcagaacccagagccaatacaatgtaacgtccaaagaatccagaatgaaataaaaattctcatatgtgaaggacaacaaccaataactgactataatcaagggaaaaaaactgcaaagagcagcagaccaacaggtgggcagatgttagaattagaaaacaagaaattcaacataactatcagaaatatgttttaaaatgtacagcaaaagatagatttggccaggcacggtggctcacacctgtaatcccagcactttgggaggctgaggcgggcagatcatgaggtcaggagttcgagaccagcctggccaacatggtaaaaccccatctctactaaatatacaaaaattagccaggcatggtggcaggcacctgtagtcctagctactcgggaggctgaggcaggagaatcacctgaacccaggagtcagaggttgcagtgagctgagatcacaccactgcactccagcctggtgacagagcaagactccatcaaaaaaaaaaataaaataaaataaagatagacttaaaggatgaagaaaggaactgtcagaagagatataaaactattaaatgagagccaaatggaaataagagatgtgagaaatataaaataaagtatgtcttggatggatataacaacagatcaggcccaacaaagcaaagcatcttgacctttcaaacagatcaagacaaactaaccaagctactaacaaggagaagaaagactttctattaaagtcataaaaggaaactcactaaccgtgtaacagatgtataatagtatttccagaaaagaacaaaaagagcaagacggggaaaaaaacagcagtcaaaagtttccaaatttggtaggggaacaaaaatcaagccaaagatgcaagcagcttaaataaatttcaaggaggatggtggggtgggcggggtgggccaccattgcatacatgagcccagcttagggaaactgcagaaaaccaaagataacacaaaatacgaaaagcaaccagagaaaacagacatttcatacaaaagaagagatgagaacaacgactctccatcggaatccatggagacaaaacagcggaaggtctttttttgtacaacagtccttctcagttcctgaagaacaactctacacggccttctaggtgttcacactcggcatctcccagcatgactgcagggagcacgtgcaccgccccacgtgctctcaagttgctcagcgtcttttgatctctgccagggagactggaaacacaaccaggccctttaaaatgaaccttcacctcagaggttcccagacctgagaagaagctggagttcagaagagctcacggccaacctcctcccttcctgcccacacccgtttcttgctttctccctttgcacccccaccatctttccagctcgttctaggactgggggaggcctcccacctgtccaaggcagtggctgcctcatctggacccttgctcccaagaagggccctgctatctgagggtttctgttagagtaatttctgattgccaaactgagtactgatagttttatttttgtctctgatattttgtccagatttttaatgtattacacagcaagaaagattttggaatgaacatctctaatcctctatgttgccagccatgaaagctcccatccctcttacactcaatcacgtcgcctcctctatgcgaacgtcccgtagccctgaccctgtgcctcgctgctgccctcacctgctccacagcatggagagagcggagaggctggcggcaccagagcacccccaagaggctcctgagtgaatgaaacagacaaacggctgccagagtcctgacgagcctctttgaataattctacttcctggaaaaagatcccttcatgaagatgtgagcgtttaacccatgctgcatctagttaatattttttcacaatttacacaaacccaaaataaggttaaacttcaaccctctcagtctttagtattataatgttctgcagactatgcacaaacatggttaaaccccaatgaatcattagaattatttgcgtactatcatttaacattcagaatagatccttaagaaaatatacatctagaaaaaaagtgttcacaatttagtgctgtggattaaaaactgtcaaggctgcatggctgtacctcaagttcctgtttatcaaatatggccttcacaggagacggctgggtggccgaggccagcagctgctgcaagaggatcatggggggctgcggcccttcaggagacatgtccccaaggtcaggtgataccactgctccatcatctgaatttaaaaacaaaatatgtgtaagattctattttcaactgtgaacaccactttactattaaagaaaatgcattaagcatgttaaatcaggtatgacttctgcctcattatgtgatagaaaaccaaaatcttcaaggttcagacatcgaacaaaaactagactctaggttgggtgcggtggctcacgcgtgtaatccctgcactttgggaggccaaggcgggtggatcacgaggtcaggagatcgagaccatcctggctaacacagtgaaacctcatctttattaaaaacacaaaaaaattagccgggcatggtggtgggcacctgtagtcccagctacttgggaggctgacacagaagaatggcatgaacctgggaggcgtagcttgcagtgagccgagatcacgccactgcactccagcctgggcgacagaccaagactcggtctcaaaaaaaaaaaaaaaaaaaaaaattagctgggcatggtggtgcgtgcctgtaatcccagctactcgcaaggctaaggcaggagaattgcttgaaccagggagttggaggttgcagtgagccaagatcacgccactgcactccagcctggcaacagagcgagactccatctcaaaaaaaaaaaaaaaaaggaactagactctaaaccactttcactgcctgcttttggtctctgtccttcattagtgcatctgtctcttagagccagcaaatgctccttcccagatttctgcacttggtctgattctttctctttttcttgagatggagtctcactctgttgcccaggctggagtgcagtggcacaatcttggcaaactgcaacctctgcctcctggctcaagtgattctcctgcatcagccttccctgtagctgggactacaggcacatgctaccacgcctagctaatttttgtatttttagtatagatggggccaggctgttgattagatttcaccatgttggccaggctggtctccaactcctgatccacccgcctcggcatcccaaagtgttgggattacaggcgtaagccaccatgcctgacctacacactctctttcatgttcactcacggcttcagtaacccctgacacagacacatcccacgtgcatatttctagctgtagcttttccagctaagccttgttgagatcattaagtgaccccaattccaaatgtgtcatgtgctcagggtgatggctttttgtctgttatgagtagctttaggtgcagcctttaggactctgtttgacacagccccagggagatccactgcgctcaagcccacttcacacatctaggtactcatccaggtactcacagcatttgcatgtgctggttttcttcagtgacaatttcaactaactagaccaggagctggaaatctttctcttaaagggccagagagtaaatagtttaggctgatgggctgtacagtctctgtcccaactactcagctctgccattgcagagcaaaagcatccagagacgatgtgtaaacaagtggtgtgcctgtgttcccataaaaatttacaaaaacaggtgcacggcagttttgtcaatctagctctgttcggagtccctgctcggcccaaagcacagacttgatcatcctgattcaggtctgctgtaattgctcatcgggctgagtgcagaacagaacagccaatccaattcccaggctccaatctcccaatctctacaactgggaaatcttcatgttccctacgacctctactattaattgattctatactttcaattgatttctttcatcctcagcaggtttaaaattaatttcatagcatcctctcctcttaagaagcaaacgcacacactccacattctactggacttatttgtttcaaacacactactcaatattcctccctcaactcaagcttgaaacagcagtcaccttccactttttgctggttccccataaagttatcatctacaagactacaccatcacagtggatggcaccttccttccaccagaaccttctttcccttttcatgccttccccctcatcacctgacgcaggagcaattctccatctctgtcatctcctgtttcagatactcctataccttcctagcaggtgtatcacccgaaggtcaatgcttaccatgtggcccctaccacagctttccaagtgggcctcaagtttcaccctggtctcccaggtactctgtaacaggatgtcagctgcccatctagcttcagccccaccactcatcgaaaaaccctgagctccaagaagaggagagctgctcaacgtgcttccaaagactcaccacgttcactcctctcctcctgcctccaccaccagcagagtgcttgtctgctggcatctgtctgccacagccttcaaaggctgcccgtccagtgctcagctgccactggctccagacgcctgtggaaccactcacatgcctcaccgccccctggccccagagaacaaagagagccatctgcattcacttcctctcctcatccaaaccctagagagcaatgatcatagaaaaggacttctccgcaaaagacttagcataatgtctttcaatagttggagatcaaaaaatgtttttttctattaaaagtaacacaagctcattctagaaaactaaatatagagaaatataaagaaaataaagacagccaaaattccaccaaagattactgggtcactgttttgctaaacagataactatggcatatctataaacggatatacatagcagtgtgcttttctgttcacttattgttttcatgtttccacagcaataaacatatacagctagccctccgtatccatgggttctgcatccaaagattcaacaaaccacacatcaaaaatattcagaataaaacaattttttaaaatataattttaaaaagaatagcaataacaactatttacatatcatttattttattttatttttatttatttatttatttttttgagacagagtctcgctctgtcacccaggctggagtgcagtggcacgatctcggctcactgcaagctccgcctcctgggttcatgccattctcctgcctcagcctcccaagtagctgggactactggcacccgtcaccacgcccagctaattttttgtatttttagtagagatggagtttcactgtgttagccaggatggtctcaatctcctgacctcgtgatctgcccacctcagcctcccaaagtgctgggattacaggcgtgagccaccgcacccagcctatatatcatttatatttttaaagtatttcggaggatgtgcataggttatatgcaaatactacaccattttatagaagggccttaagcattagtgaattctggtataactgggggtcttggaactcatccccatggatattgagggaagactatacatgtaccatcattttgaatggcaccatgatatcacactgtacggatacacaacataagaatgggtattttggtgtctacagtttttcaatacaaaaacaataccaaaaaggaggccataacgacactgttgaatacattatttttatttattattttttttgagacgaagtctcactctgtcacccaggctggagtgcagtggcacaatctgcaccctgcaatccgcacacacggcaacctccgcaccccccggttcaagtgattctcctgcctcagcctcccaagtagctggcattacatgcagccaccactatgccccgccaatttttttttttttttttttttgagacagagtcttgctctgttgcccaggctggagtgcagtggcgccatctcggctcactgcaagctccgcctcacagattcatgccattctcctgcctcaccctcccaagtagctagaactgcaggcgtctgccaccttgcccagctaatgttttgtatttttagcagagatggggtttcaccgtgttagccaggatggtctctatctcctgacctcgtgatccgcccgcctcggcctcccaaagtgctgggattacaggcatgagccactgtgcccaggtggtgaatacattatctttacatgccttttcgtgtgataaagtcccacagaatgacttgctgggccaaagtatataaatacatacatacatctatgcatttcaaagtccaactcatttcctcagacgcccattagatggctacaccaactgaaattcccagcagcagcgtgttcatggagtgcggctttacgcgcatttgaagaaccagcttaggttcatcttgttacaatacaggctctatttctttggtctggggtgcggcctgggagtctgcatttctaacacatacctgtgtgccaccaatcttgctgacccatgcagcaaactttaaatgggaaggcatgaaaatacctttttccctccccacccaccagatgccctcagtcttgtcttataagatgacgatgacaattttattcacagttggtggttgctgggcaggccacgtgtctgttttgtacatttataagccacctatgtccatttttatgaactgattattcacttcctttgtctactttctactgcccttcttataaagatttaagaactttttaaaaagacacctgtgtgaacagttccagtctcctgaacagctggctgagacaggatctgccgcagtttatcctggtgggagaacagcgcccgacctgctttcaggatgtatagcttcaactgctggcaccgcagcaggtccaggtccacttgtcctgcggaaggaaagactcagtgagaagggcgtgccctgctcagactccctcctcgccagcagcaagcctccgccacatggcgacgagtaacgctctgcccttcaggaatctgccgaccgcacacactgtccgtgacgaagggcttgcctttcccagagttacactcggtgcttctgggtaagcatcttctgcctcctgggtcttccttccctgctctccaggcacctaacttgataggacgcaggattcaatgggtttaacacggttagaaccatgttagctactattaatatgatcaaatgttccccaagttgctgaagtttcagccgcttccactcttcttctaagactcctctgagagaatctgtcagccccactagctctttaactgatgaagatcgcagcaatgcccaaggcttatctgatagcagaggccgcagaagcagcacagagagcatggggtgggaaggaaggagggccgcaggtgctgctcggacactggctcaactaactggcagacagttttattcaccacgatgggaaacggcagctactagagaaagccagccagctgaatttcggacatctgatgatttgcatgcactgcacctccaaccagagatgtgaatgggagatccagagttgaaagtgcttacatcatatatgctgaagcagcaatcgtaggtctgtgggagcaagaggggagaaaactcaagaagactgggcagaatatgccatagttatgggtgaaaccacacagacttccaggacataaagaatgagcagagagaagagctccctagaaacatggaaacaaactcaggagagccgcattctagacctgaaggaaggcaaagccaagccaggctacagtcacagtcttagccatcctgaatgtcacaggcaagccaggcgcttccgggacagaggcccctggatccggcagagaacaggctgtgagccatggtccaacagggtgacggggccacagggccctgggatggaggggaggagggaagaggtgaacagacttctcttccgggataaagggtgacacggagaagagggtgtgagccatggggttcttcaagtgtggctccgaacatggcgacaaaggctgactcgaaaatactcattaccacgaacacagggttacattcccaaccgcaactcaacaaatggtgagcccacgtgaaccccaggactttagtacgtccgtgaattcactcataaaagaacactgtacaaacgacacgagtttaagacggcagctatttcatcaagaagcgccatgtactgacctgcaaaggcctgtttagtcgatttctttattttgtgcttttctaacttgcttccagcgaggttcaccaactgagcccagacagacagcatgggctctgtgaagggcaggttgttcacattaaaggccacggcagggagctggagaggacacagaagctgtcagagtgtggccaatatgactaacaaatgaaacgttctgaaagtcatcaaaaccatgggcttaatcctgaaatgccacacatacccgtaagcctttttatagctgagaataatcattttttaaaatgacattaaaggcaggatagagatttacacatataataagtataatctatattaatttttctttacaaacctgtcaacaataattacatcagtgtggtggttactatcttctcagatattttctatatacttcaagttttctacaacatgtatatattcctataataataaaaaagagtactttatagaaaatatagtcaggccgggcacggtggctcacgcctgtaatcccagcactttgggaggccaaggcgggcggatcacctgaggtcaggagtttgagaccagcccggccaacatagtgaaaccccatctctactaaaaatacaaaattagccaggcgtggtggcacacaccgtaatcccagccactcaggaggctgaggcaggagaatcgcttgaacccgggaggcaaaggttgcagagggccgacaacattgtgccattgcactccagcctgggtgacaagagcaagactccatctcaaaataaaaaagaaaaagaatatatagtaagattgcacttgggctacatgaaaataatgtaaatggctccttctccctgtgcatccttgattcacagattaagatgacagtagctgctacattaagtcacgtcactcaaaactactaagcattttctacatgaagaaaggctgtttttttaaaggtgtttaaacatgtttgtttttttaaaacttgagttgttgaataaaaagtaaacttcataaattcacattttaaaataattagaactacctcatagatgcacggtaccttctaggttgctaaagccctcttcgtgtctctgaggctgaaatacacacgaaccactgctttaagtgccctgtgagacaggccctgcttaccacagaagcacaagctcacacagcttcctggaaggcaaacttcaagtaccagaatcaagttctttcaagtgctgatgttggtgctcggttctagtgtaaagtcaatttcccttatcatgcagtaactaagcacaagttcacctactggtttcagctgattcaatgggcaaacgtgacacgtccgcatgtcagagaactgcacggtgattttgcccttcagggtgatgcgagtcatggtgacttctccaaagtcatcgtgcacaacttggccgcccaggcacaggcgaccatcgatgcctccaaccacagccaggaccgccatgaggccccccacttcagggttctcggaatcagggaagtagtcctctaactgggcctagtgcagaccaaacagcgagctcgaccggggacactcacggagctgcccaatccctacaggtttactgttcaactaaattaattctgagaacacaaacccacccctttggaaggccttcccgcaaagctgtgggtgatggagcggagctgggagttgatgtacttgttgatgagcccattccactgagtcagggagtgcagcgtgtgcagcagtgccaccacctcctccgccagtgtgctgctgtgggtggcagtcagcgaggcctgcgggcacaccctgcgccgcctcagcgtggactctgaggaggaaaccaggggagaagctgctgcaccactcttcaccagggcacagggaagggagacggccactcacctctgagtgacggcactgcgccgctcttcaccaggacacagggaagggagatggccacccacctctgagtgatggcactacacggctcttcaccaggacacagggaagggagacggccacccacctctgagtgacggcactgcaccgctcttcaccagggtacagggaagggagacggccacccacctctgagtgatggcactacacggctcttcaccaggacacagggaagggagacggccacccacctctgagtgacggcactgcaccgctcttcaccagggtacagggaagggagacggccacccacctctgagtaacggcacgtcagaggagcacatagtgagcaagctccccaagaagtcaaacagcttctccatgaggcatttcatgtccctcgccctttcggtcttgtcccatgacggaaggactgcttgcaacaaatgcacagctaagatctgataaaagaaaatttaaaatgacaagcattaaaaaaaatctgatgaggaaactacagattgttattttcttttttttttttttttttgagacagagtctcgcactgtcgcccaggctggagtgcagtggcacggtcttggctcactacaaccaccacctcccaggttcaagcgattctccttgcttcagcttcctgagtagctgggattataggcactcaccaccaagcccggctcattttttttggattttcagtagagacaggatttcactatgttggccaggctggtctcaaactcctgacctcatgatacacctgcctctgcctcccaaagtgctgggattacaggcatgagccactgcgcccagcctctctttattttctgttctcataatgcaagtaatcatgtgaaaattttgagattcattattttacagccaggtaattacactcaagttgattagtgattaggattgtcagggactttagaaaaaagcaacattacagatgcatgtgtttaattaaaaaagaattatttttagtttaattcttaagacaattacactacaaattctgtgaagcagatgagtaagtagttgcaggatttaccacttaagagaaaagcaggtaaactgaaggttagcaacttaccaattatcaaggacctctgccccttgcctccagaaaatctaccctgtcacttctagaccctttctgcactcgttacggaataaaggcccctgactctgagggcagggaacttcagtacatggaggcctctctcagggaactggttttgcctggcagcacattacctgcctctgcagcgaggtggcagtgaagggtgcgtgcccttccacgaccttcatgagcagcgtgatccactgcagggagctgagggtgccgcacacctgcagcgtgagagcgatgctctgcacaaaccccagcgtgcaccagctccggtgttgctccctgtacaccagcctgtttggagaagcggcgggagggaaaatagacatgcttggtaacaagtccctaaagacaaatccctaaagatatatccttatttttttatcaacttattttctacaataagctcctttaaaatatattgcagtttgtaaattaattcaaactaattcaaagtgagaagtggaaggcggcttttaagttagttcaagaaacatttccgaagttttctttttttttgttttttttagagatgggccctcactatgttgcccaggctggtctaaaactcctgggctcaagtgattctcctgccttgccctgccgaatagctgggactacagacatttttaaaaccttctaaatatgtgtcgtaaaagtagttagggaattttagctatgtattgtttctaggcaataggaaaatgatctataattcaaatagtaatttgcaacagtgcatctattatatttttaatttcgtgttttaaatatctccacaatcttggttatatttaatctgcaccacttaaatactctttttgtaattttagtagagacagtttccaatccaagtttaatgcatctgcattaacaaaatgagtttttcactaggtttacaccactggattctggcaccagtgggcccacctctgctccgcctggctccaggactccactactccctgaatggaagctgaggcttggaggctgggccccctgagggaccccgcccacagccccacaggacctgctctccctcccacctcccccaccctgccctcagctatccaagcttatgaggacaactgccttccttcagcacactcacatgcgctcacacacacacacactcactctcacaccctcatatgcatcctcacactcacactgatactaagttattcagacacactcatgggcactcatacacccaccctcacactttcaggtgcactcacaccactgtcgcaatcacacacacacaatcccagtcacacgtatgcacaaacagatgcaagctgacacacactcccatgcactctcacatacacttacccctcccaatgcatacaaaaactcacatatgcactcacactcctcaacactagtaatgaccgattactcacccactcacacctttacccacacactttctcactttacactcacacctatactgttataacctcccattcactgacacaagcaaaatgctcacattcactcacacgcattcacaataacatcactcgtgctcacactgacacaaggcactcatacatttacacaaatgctcacactcaatcgcacacttacacttgtgcctgccacccactcatacttcctcacactcaccaaccctcactgacttacacttacactgggtgtctcatttgcacacccagtaatcccctcacactcacactcatgcctccctcgtgctcaccctcacacacacacattggctcaatgcaccgacgctttcactcccacttcacctgaatgtagtcacctgcccactcacatgctctcatggacatacacacacccacacaaccacatgctacaaacacaccatcacacttgcaacacaaacgctcagccacttgcccatcgaccgctaacacactcactctcatcaatatgtgcggacgctccagcacaccactaatacacgcatgctctcacacacactggaggacgcccacatacccacccacactcacatgtgctcactctcagtcacatgcacactcaccccactccctcagctcacatttctcatacttactctccacacacacaaacactttatggattaaactgtgcctgtcctccaacttcacatacattcggaacctcagaatatgatcttatttaatgaggtctctgtagacgtcattaaggtaagaatttaggtgacatcatgttggattagagtcaaagaaactcaatgaaagagtcctttcagagacagaaaaggacatgcagaacacaggggcaggggccatgtgaagacgcaggcagagactggcacaatgcgtcccaacaccaaggaagcctggagctcccagaagctggacaaagtaaggaaggaccttcccctagagcctgtggaagaagcatggccctgcccgcacctggatttgggacttctggtctccagaactctgagagaacaaatttgttgtttgaagccagtgttacgggttgaattcagaattgcaaaattcgtatgttgaagccctaacccctaccgtacctcggcaggtgaccttgtttggaaatagggtcgctgcagatgtaatcagtttgatgaggttgaatgatgtcctcatgaaaaggggagatttggaggcgactcacacacagggagaatgccatgtgaagatgacggcagagataggggtgacacctctacaagccgaggaacgctaaagagaccagtaaactccagaagctggggcagagccctgaagcagcttctccctcacagccccagaaggaactacccttgatctcagccttccagccaccagaaccgtgagaatttctactgtgtaagtccccaagtttgtatactttgttacagcagccacaggaaaggaatccacacacatccacacccacccacatgcacacccagacacgacaagcgtgcggcccccagcgctgactccctgggccctcgatctctcattccatacatgtcttgtccgtcattccgctttccactaacatttgcagcagtccgcataaagtcttggtggcttcactctgcatgatctcagcatgaactccagcagacagacaaagagtctgcagtaagttaatagtgctggtaaacatcattgcagtggggtgaatgttcctttcagtttgttcggcttctaaaaaaaataatcaaaattacaaattatattggcagccccagcctcttggatggtcttaccaagcccaaccatgtgaagcttcacgtgttttaggaacagctaagaaatgtcacgaaacctcctcccacaacctggatctccacagataggatctagctttcttggtccacccctaaattctcacctctgcttccctagaagcgataaagtgctgactaactccacattacatgaagagttcagagtcagggaccacagaggaaaggtaaaggcaggtggcaggtggggtgtgcttgggcaggggctctcactggaggaggacgcgatggaccgagaccgcagggcaattccaccaggcctcggctcactcgctcagatgcaggctcagcaccaaccacatgagactcactggtgatgcagctgcccccacctggccaccacattctcaaagaggggcgggtgcacacatgagaggaaaatgcagaaagtcagttccagccagatcgccggatcccacagtcactccacacacctgcatcggaggtgcctgggagcttatttaaattacaggttccgaggacagagcgccagctgcaggtgtgtcctgacatcccattctaaggcccagatggcagtggcagcacccagcaactggacagtttgtaggctgccttggactaaacaccttcctgagtcacccaccagagtcgtcctctgtgtccgaatcctctgctgagggctgtgcaggggctggcagctctgccagcttgaggtcgtaatttccttctttccccatcctgtaggagttggtgctgcctgtgtcccactggactcttatccacccgtcctctcccagctcaccaatcactcggcctaggcctggaggaggcctatcctgagaaagccaaagtagagatcagttaggagggtgcgtaacctgccctggtccttccatggctcccagcagacctcagttaggagggtgtgtgccctgccctggtccttccatggctcccagcagacctcagttaggagggtgcgtgccctgccctggtccttccatggctcccagcagacctcagttaggagggtgtgtgccctgccctggtccttccatagctcccaccagacctcagttaggagggtgcgtgccctgccctggtccttccatggctcccagcagacctcagttaggagggtgcctgccctgacctggtccttccatggctcccaccagacctcagttaggagggtgcgtgccctgccctggtccttccatggctcccaccagacctcagttaggagggtgcgtgccctgccctggtccttccatggctcccaccagacctgccacacagatgtcgccatatgccaccctgtctgtcaggggctgtccccagacacagatttcacctctcctacaaaatgtgtgcttgcatcattttaaattaaatggcataaaataacgtgctcatgctgctttaccaaggaagtcggggaaatctcatctcaatgaggatcctctgagtcaatgcagagacagggctttgcagcaagtcctgtccccacaatccctcacgggccttgcaagagcggaaacctgaaacaagcaccagcacctccacattccctttgcttcagtttcccctgggccccagggggaagctctgtctctcacttctgcaggagaaagctgtttctaggatggatgctgtctccagacactgctatttctaagatgactgtgacaaagccagggcttaccagcgtggctgagaaaagccagacagaccatgggaaggtgaacactgccctaacttagctagggctgtggtaagtgacttccacctgggggcacctggcagagatttagaagagatctgcgatgagggaagatggaaacgtggccacaggcccatgaagtagatccctaactactggcttcagggcacttcgcagcacatggccatcagcccacaggggcagcatctgggcttcctgcctcagagccttcactacaccaactttcagaatgagatttactctcttgctcactctcacactcttgttccagtgacccatcaaactgagcctcatgccagtgagtttcctgaaaagagctgcctctctttccagacttgattctgctcagatgccctacttatgattccctgtttgtgttcactcccttcagctgctcgggaaccaacacctgtgtcatcgatcaactgacacatcctggattattccaatttccacccaccaatatcgtacagaactatgcagaagataactaatgtgtggctaatgtgttcacatcaaatctctgagtacctgatcgccccatttccagtccacacctctcatgacccttgttccaatcttcatcatggcagccagttctggccctgaaacagggagctgcacaggagccgtttccttccttgtttcttccaaaactgtggcagaagcaccttgagcagaagcattcatatcttcctcaacgctgtcacaactggggcctgacggagcatcaaaaacaatagctgagccaacaagtagctacagtgtccccttaatacacacaaaacattcacaaagtactaatgaagatcgtaattttgaacaatccatactatatgttttatcaatataatattatgaatattttactgatataggataaaaagaagataaacggaaggatgaaatacataaatatcctaggaagatataaaagatattaaaatgctcagtaaagctactttctctacttctaggaattactcccctgaaaaaagcaaaataactgagttagaaagatcctcatcacattttttattaatagaaaaacaaagataactacctaaatatctaacagtgggaaactaacaaactttaatcatggttctgtgcagaagacagctaacagctggcccgagatacaacctcagacagggttgctgcaggctggccctcagctggagtctggatctcaggagggctcccccattccctaggtggtaggtgtggttccctgtgcctgaactgtctgtacaaacaatgtggtctgtgctgaaacctgctttccttagtctggaacttggtacacgccaggcagggggtgcccgtgtgatcagtcctgatggaaaccatgggcctggagtctctacccagcttcccggcagacagcacttgacacggctcggtgccagggcagttaagctcgtcctgtgtggatcctgtggaagcttgtacctgctttcctctggactttacccatgtcctttttcatgattttgctctgtgtcccttcactgtaataaactatagccctgagtacaactacatgctgagtcttgtgagtcctcctggccaaccatcaaacctgggggtggtcttggagacccctgacaattggtgccctgggtggctacagagtcatccatagcacaaaacagaagccgagctgctgtcacctgagagaagtaaaacttcccaatggatctgaaaataggagcgctaaccctaggagagtaggctagatttttaaccccccttttcccacttgctaaactgagagggggtaggagtgtggttctggtaactcccttgattttagttttctcctccaggtgggagggaaaaagatccaaacagtcccaaaggtgggctggggtggaccaaaaaatgtaaaaagtttgtgtttctctctcttccaagagaacaaaaaaggatattcaattcccagggctggagcaaaactttagataaactagcaggagaaacagcctttcctttagcctagccgctactttagggcccccaggaaggggccccaaggaagggacaggagttgcattccaggtggatctcccaggatcccctgggcagctatactgttaactctgtaaagactgaatttattgctaagggcttgaataaatttgcaaccaaaaccggggggaatttttttttattttacatagctttatgttttgtggctgttacatgtggatgtatacattaagctggtataaaatattatatgtttataatttcttaaatgataagaaggataccctgatcagggcaagctgcaaatatagacggatattcatgagacacaacttccttgctttttgcagccagtgggccagatgaaatttaaacacatgaatattatcaacagaacaagtccccatacttaatgatttgtgctgtgatttttacttattggaacctctgggggaaaagtagacaacataaaaaggccatttctcgatggagatatgcttttgtaatttttaaatgcaacttttggttgctaatgaggcctcaggaaatcagatataacccttactagatgattcttttcagctgtaatacacatattaaaatatatatttaacataatacaacatataaacataatatataaattaaaaaataattatatatatatatatatagagagagagagagacagacagacagacagatagatagaaagattccacccacccccaagacaggatttcactctgtcaccaaggctggagcccaggctggagtgcagtggcttgatctccgctcactgcaacctctgcatccctggctcaagcaatcctcccacctcagcctcccaggtagctgggaccacaggcacacaccactatgcccagctaattttcgtattttttgtagagagagggtttcgctatgttgcccaagttggtctcaaactcctgagctcaagcaatccacccgcctgagcctcccaaagtgctacaattacagcctggcctgatacatatttttgaatggattaatgtgaactctaaaactgatgtgattataagagcttgggaaaaccttgctttttcactgtgactttgacaactggccctgcagcatctcagttttagccaaagaacaccaccataaaccaatcagacctaatagacatatacagaacatttcaccaaaaagagcagaatacacgttcttctcaagtataccacaggactactctcttagactgaccaaaccatatgttaggccacaaagtctcaaatttaaacagacgaaaatcatacaagttaccttctccaaccaaaaggaaatgatgagaaattaataacaaaaggaaaagtggaaaattcacaagtatatgaaaattaaacaacacatggtaaacaatcagtgggtcaaagaagaaatcacaagggaaattagaaaatactatgagatgaatgaaaacacaacacaccaaaacttctgtgctgggccaaaagcagggctaaaaggggcaattatactataaaagtctgcatttacaaaagatgatctcaaatcaataactctacatctggaagaactaaaaaaataagaacacaataaaaaccaaagttaggccaggtgtcgtgcctcacacctgtaatcccagcactttgggaggctgaggcaggtagataacttgagcccaggaggttgaggctgcagtgagccatgagtgcgccactgtacttgggcctgagggacaaagtaagaccctgtctcaaaacaaagacaaaaacaaaaacaaaaaaatacaaagcagaaagaaggaaacgatagagattagagcagccataaattaaatagagaatagaaaaataatctacaaaaccaaaagttcggtttctggcaagaacaaaaaatctgacaaacttttggtaaattaagaaaaaaagaggtcagtcaaggtggctcacgcctctaatcccagcactttgggaagctgaggtgggcggatcacaaggtcaagagatttagatcatcctggtcaacatggtgaaaccccatctccactaaaaatacaaaaaaaattagccaggcctggcggcaggcgcctgtagtcccagcttacttgggaggctgaggcaggagaatcacttgaatccgggaggcggaggttgcagtgagccaagactgtgtcactgcactctggcctggcaacagagtgagactccatctcaaaaaaaaaaaaaaaaaaaaaaaagaaaaaaaagagaaaagatgcaaataactaacatcagaaatgtaagtggagacagtactaccaacataaaaataaaaaagattataaaagaacactgtgaacaactgtatgccaacaaataaaatagcctagataaaatggacacattcctagaaacataaattacccaaactgactcaagaagaaatagaaaatctgaatagagccataacaagtaaagagattgaatcggtaattaaaaatctttcaggccaggcgccgtggctcacgcctgtaatcccagcactttgggaggccgaggcgggtggatcacgaggtcaggaaatcgagagcatcctggctaacacagtgaaaccccgtctctactaaaaatacaaaaaattagccgggcgtggtggctggcgactataatcccagctactcaggaggctaaggaaggagaatggcgtgaacccgggaggcggagcttgcagtgggccgagatcacgccactgcagtccagcccgggcaacagtgtgagactccgtctcaaagaaaaaaaaaaaaaaatctttcaacaaagaaaagcttaggtggtcaactctaccaaacatttaaagctgaactgacaccaatcctcaaactcttctaaaaacagaatatatgggaacactacctagttcattctatgaggccattattaccctgataactgtaaaacaataaaatattgctgaaagaaattaaagaggacagaaataaatggaaagacattccacattcagagaatggatgttaacattgttaaaatggcactattccccaaaacaatctacagattcaatccctagcaaaaatcccaatggtctttttttgcagatatggaaaagccagccttgaagttcatgtgaaaatgcaagggacccaaagtagccaaaatcatcttgagaaagaaaacacacttctcaattttaaaacagtacaaaactacaatgttcaaaacagggcggtacctgcacaattatcaacatatagaatgtgataatgtaattgagagtccagaaataaacctaaatatccacagccaactgatttttgccaagggtacccagaacttcagggaaagaacagtcctcaacaagtggtattgaaacaatcagatcaacaaaagaaaaaggctggactcttacctcacactgtgtaaaagaaattacctaaaaatggaccaaagatctaaatataagagctgaaactataaaacttacagaagaaaacatgaggataatcttcatcaaccttgtgtttggaaatggctttttggatatgatatcaaaagcatagacgacaaaagagaaacagataaattgaacttcatcaaaataaaaaacttctctatctaagggaatacaatccagagaacaggagaaaataccctcaaatgatatacctgataaaggtctacagatctgtgaaggtctagtatacacgaactttttaaagagtctgaggactggtgttaattcttctttaaaggtttgatacacttatatagtgcatttattggtacaacaagatgacgacaaataaccctatttaaaaaggagaaaggggctgggcgcagtggctcacgcctgttatcccagcactctgggaggccaaggcaggcagatcacctgaggtcaggagttccagaccagcctggccaacatggcgaaatcccatctctactaaaaatacaaaagttagccaggtgtggtggtgtgtgactgtaatcccagctacttgggaggctgaggcacaagaagtgcttgaacccgggaggcggaggttgcagtgagccgagatcgtgccactgcgctccagcttgggcgacagagtgagactccgtctcaaaaaaataaaataaaaaataaagagaaagggacttgaatagacacttctccaaagaagatatacaaatggccaacaagcacaaacatgtaaagaagctcaatgtcattcatcattagtgaaatgcaaaccaaaatcacaatgagataccacttcacacccgctaggatggccttaatccaaaaaaaaaaagaaaaccacaaaaaatagtgttggcagggaagcagagaaactggaaccctggaatcctgcccactggtgatgggaatgtaaaaatgatatggcactgtggaaaactttggtagtttctcagtaagttacacatagttgtaccatatgaccctgtaattccagtcctaggtgtataatcaaaagaactagaaacaagtgttcaaacaagtacttgtatataaatgttcctagcagcactattcacaaaagtcaaaaggcaaaaccaacccaaatgtccatcaacagataaatgagtaaacaaaatgttatatattcatacaatgaaatctttttcagccataaaaataaagtactgatatataccaaatgaaataacccagacacaaaggccacaaatggtatgattccatttatatgaaatatccgggatatgcaaatccatagacagagaaagcagatttgtaactaccaggggctggagagcaggggagtcaggactgatggctaaatggggtgcatttatagtgatgaaaaagttctacaactagacagtggtgatgactctagaaaattgtgaatgtatttaataccgctgaattgcgacgttaaaatgctacactttctgctatttgtgtcttaccataatttacaaaaagctttttttaaaaaaaagaaagaaaataaatcaaagcaaaatcttgacgttttcccaaaggctctcaagccagtgcagacctaccaatcaggcgcagtgccgtctgagcgagggccagcgtgccggaattgagcaggaggtcaaggttgtttgcgctgtgctgcagggtgagcatgctgagcatcaccaggaggaagtgggcttgcgggatggtccccaagctcggtcccgatgggttctcattggtgatggtttgcaggggaaccggctggatacctagtgagcattggcacccactgacatttcttgtaatggatacaagaataaatgtaatgcagaaagcacgggcaattactctaaacatctgactaataagcactgacacccactgacatttcttgtgcgtggatacaagaataaacgtaacgcagaaagcatgggcaattactctaatcatctgactattttgacacccactgacatttctctcgcatggatacaagcataaacgtaatgcagaaggcacgggcgattactctaaacatctgactatttttcagtggtttccacagagtgggcagctctgtcatgctgcacgatgggcctaccccctgcattctatgcacaggtcgttccatctgtctacaggacttagtatgttgctctctgaatacaccggtgccctattccattccttccatttcaaatataaaagttatgtctcacttttcctccacaaaaccaatccaatcaactctctgtagatgctcaaactatccaggaaataaatatcaatataggacacagacactttaggatatgtggtgatacacataaaaatgtcaaaatgtaaaaatgttatactagagtacttcaacattgtgtctcctgctaaattttaaagttttgtttaaaatctgagaaagctgacagcagcatagactatacaagtacaaagtacaaacttattaaagtcttctcaaaagcaaaaattggcatttgcaagtttccacaacatataattaaaggcaaactataaaataacattgatacaattattgactcaccaagctctttaaatttggcactggcatccaccaaaacatttcgaatgttctgaacagcccaagcgtacagcttgccaaaggtgacttccagcagcatccgattaaaaggcgggatcaaatcaacatcctttaaacaatcagtaagaggttccctttcaaataaagataaagaatttgactcgggacactgccagacttctaactgttacagaaaaacattctgttgccacagcttccttaattaagaaaaaaatatgctaacattttaccctatatcgattccctcaggaataagtctttgccatccacaaaacatcgcatacggcacagatggaagtaagaaattcttgctcaccagatacaattttaaaattgtatctatcccttccaggcgaacctctgctctctccaactgcaaaatatcaatgcatacagttaagtgttatgtatattacccaatgcagagaagcatttctcatcaaatgttacctgttttagtaggcactttctcttttccacatccactggctcttctttaagggcaaattcagcaattgtactgaggagtggagactgcggataaagaccctgcacattctgcttcaaccacttgtatttgtgaacacctgtaacagtactcaacagcggctgccatttgtcctaacaaaggaaaacaattttcatcattagtctaccctatttaataataaactgtgctctaaaagttattcaagtaaaatataaataatgcttatgggtttaaattggttaaaatacgttaaatttagtaatacatgtttttaaaactatgctataaatataagtgaatttataatctctatactatatgttggaacaggctagcttggcatactaagttaagttatggttcatattaacagccacagggcccagcactgtttctggaacaaagaatatatttaaggaatgaatggtgaataattaatgatacaatctaataccaaaaataaaaggaaacccttctccagctacagctctgaccaggacatcataagtcaagttcatgaagcatcactggggccgtatttctaacaaccgcccgtccctccctccagatgctcaggtacagaggtacaagactgtggattcctgtgctacatgctacgattctattcagccaacctcagaatcacagaaaataccgcaccttgggtgatttaattgcaatgggtctcttgtccacatttattggactatgaggcaaaatgcaagcttcttctaaatcactctcttcgtttccaattttttcttcatcatccgtagattctggcttcttaggaactgtgttttaaaacatcattcactataaaaatcatacacttaaatattaattttaaattaagacatatttagatttacatgaaggacaaatatttcattcaaataaacatctgaacaacattataaattgcaatgctcaacaacaagagtgaaatgatcaccctggcagaacaaaaagacaaagtgagagtgcgacgaggggagaagccccgaagcaggggaagcccggcagccagcaagctcttcctcaagtgccagagagtgaacatttgagtctttcaggccatgctgtctgtcgcaaatactcaactctgctgctgtagcacaaaaagtaaccacagataaagcaacaggtgtggctgtgctcctgtaaaactttatttatggtgctacaattttagcttcatgtaattttcatgtgccaaaataatatacttcttttaatttttaaataacaatttcaaactggaaaaaaaaaaaaaggtcttagtccatgggcaacccaaagccagcaagaggtagaatttggcccatagttcctggcttgtccaccctggtccagttcagtggttctgttactgtgtaactgaatcaactgaattcactgtgatatgtggaatctcctccctatactttatctcttttaaaatttttggtctaagtctcctcagcatataatataaaaaataagcaacatgataatacatctgggcagtaaagagctaacatagcaggccggggttgctcaaaccctgcaaattcccaaggaaggtctgtcccttcaggattggtccttcttctaggagctgagctctgagcccttggaacatcctgcctgagaagttttttggtatacctgacacccaggaccttgtggcagtggtctggccaggtagtttatgctaatgatgggacttgcgagggaccacttgtttttgcactggggcactggagcctgagtgaggtcagtcacaggggcactgcctgcgtatgtgactggcccccaacaaaatctctagactcgaggctcaggtgcgctggcctggttaacaattcttcacacatgatgtgacactattgctgggagagctaagcacatccacgtgatgccactggggagagacaccaaagcgtgtgcctagtttcctctggacttccctccatgcacccttccctctgctaattttaatctgtatcctttttgcagtaaaaacacagctgtgactataacagctcttctgagtccttttagtgaatcatcaagcctgagagaaggctcggggatccctgacacagcaacaggaatattaatcacttaatcttttcaagttacttaatttccaaaaaaaaaagaaaaccagcttgaaacaccacacgataaatctataaacccacaagaaactctaaaagtgacagtgtgggctcagaacccacggatatgagatggcaaatgtggagtctctctccctcattccgaggcagcctgtctcctgggcccaggctgagttcctgcatgcctgggttaaaggaatcgcagcagtgtgactgctgtgacttcctgatccagagcacccctcgcattcagacaggctgttatggtgtagggtttgttcaggaacaatcaaattaggatggcttctaacacactttagtctttcataagcttattgttcaaaatgcccatcagaaagtcagtaatcaatactgttcaataagcaggtttgtgagtaaatcagtataagtcataatatgatcagaggccaggcgcggtggctcacgcccgtaatcccagcactttgggaggccgaggcaggcagatcacgaggtcaggagatcaagaccatcttggccaacatggtgaaactccgtctctactaaaatataaaaattagccaggagtggtggcgcgtgcctgtaatcccagctacttggaaggctgaggcaggggaatcgtttgaacctgggaggcggaggttgcagtgagctgagatcgcaccactgcactccagcctggcaacagaccaagactccatctcaaagaaaaaaaaaaaaggatataatcagaaatttctgtagtttatttataatcacaagtgactaaattctaaactattttataatttctaagcatttttattcaaatttggatttaatgcaaaaagacttttctgtacccttacacagctacttccaggaaaatgtcagtaactcttttagcttccctttatagttcttcatgtatcagaatactcaatatttccaaacaaaaaacatttctttagaagaatggcaataagtttaaatgttcccattatatctcattaccaggataactaataaaagtacttccttgttcccatcaatttagcaaagattatttacgttttcaacatcaatttactagtaatcaaatcataccacactcaattcctaaactgcctcattgtctgatcatttggaaaaataagcgagatgtctgtatttaatcctaactataataaaaatgatggcagcaggtagaaatgttacatggaatcaacagtagagaaacttcactctgaaatcacagatccaacgtggcagggtgaagcacaagctttaatagtatcttctgtccttttacattcttacctctctttttccttggttctcgaattatcttctgagctatcctcctccaatggggcaaagaacttaacaatttaaacttagacattatagagaggtcattacaaacagcaggtctcaattcattaaagaggaatctcaaacgttcgatgacaggagcgcagacctccttgtaagaacggccctgttcttgatgagtctgcaaagttaaccaggaaaagacaactttaacaacaaatatttcagcaactgtctgcaaagcacagaataaaaagaattaaaatctatcaccttaatgagcgaacattttgcttggtagacaactctacaaacatccaccactgacttaggcaacgttctgtgctttacttgctcaataccaagtgcacctgcatgaactaaagataatgccacatgacctgtaaaaagacatttaaaagaagggcagtgaaggaatgaatacgtaccacaggttagtcgaggaatcgcagtgtagctaaagtacaaagatattgagctccttacctaaatcttcatgttttaagaggcaacataacagcaagcgaccgacctcttccacgggatgctcggggggaaacatgatcggtgtggtcaaatggcactgcctacagtacctttctatttgacacaaaaagtcctgcaacaggaacagctggaagtaacttcagggaaacccagtgagtcttcacaaatcttaaacatgccacagcttctgacacacttgcaatcactaatgcttctgaagcctcgctagcatgttaacacaatcaggttctcacctcaaaaccctccaaataatacatgaaacaaagtctgtgctgtgttaaccaaagagcacataagtattcctatgtcaaagtcctcagataaacagagcactgaggtggcagtgggggcaggcctagctcaccttcacgttgtgatcctgaatgttgttgtctgcaatggcttgcagaaatgcctgggaatggtcccccagggcccgtctgtgggagcagagtcgagatttgctggcaggtgtgccccctggggagctgcagtggtcctcgtctttctcctcgttgtagctgtagtggatctggctggtctgcaggcctccagagaagatggatgactgaagccattctagaaaatgcacacgcaaacatgaaagagaaactcaagtgcacaactcaaaataaatactaaaaaaaaaaaaagatgctcaactgaacactcaatttagaaggtgaaattcagcatcattcatatgaaagagctccacctaacatgtttacacaggttgacttataattcctctatctacgtgaacacactttctggtgattccacacgcctcaggcatggcatcagaactcaggatcgtagttccagtccaacattctctggatacctgtgctctgcctgcagctgcctggttccacaggtaccgtgtgaagactgaggtgcacattctaacagggaaggcagcaaagggcaccgctgacacaattaatcacaggatttcaagtccaaaactgtgcaacagatgactatgggggtaccagggagactggaagacagaccaccgctattctgagggtcagtgagggacttgtggaagcaacaactgagctaagatgaggaataagacccagacgctgagtatccaggcagggaacagcacatctgaagggtttctacaaagaattacatcctcagggtaggctatgtattcctagagcacttataaaggaatgaaaaggagaaaatatttaagaaacacacaatctgtaatgaaggatagatccttggagatgggagggccgatggactggaaaggagacctgtgcgtggtgcaaggcatgggatcaaccagtgcgaatgttaattacaactgcttatggcaacttgagggagtgcaccactacagatctctattaacgatctgtgttatcaaatactgctccaaatccaagcaatcaaagcgggatgcacttagtgttcttttactggacatttagattttagagcactcaggagcattccccaacacaccacattcgttcttctgaaacactaatccaatgccgactctctctggccccctctctttaagcacaggacagcccctccttactgctccaagataagcctctgatcctcctgtggatcggacccacctgccagggcccatggcaccctctgccctggagttcgccagccctgccctccttgccaatttaaacaaagcccatcttctggcaagcaatgagccttgaggaggagggaaggaagcagacacctcagagggcaccacaggcagcccagcacctagcactgcacaaaggtccgcccaacggggggctgtatggacaccaagatcctccttccctgcaagcctctgccacacccactcctgcaagcagcaggaaagccctgctcctctcagcagtgcccttgacactcctgtgttttctgcccagaatgctctctcacgcaatttcaggactgctgccaatgtgaagcctttcttctcccagaaccatgtatgaacatctccatttcaccattcaccaccttgtaatgtgacctgcttagaatggtggctcatcaacaagcagcagctgaaagcagaggcgtgtcctacccatcactgcatcctgaacacctcgcatggtaacggcaccagaaagcagaggtgtgtcctatctatcactgtatcctgaacacctcgtatggtaacggcaccaggcaaatgctcaacagaagctgctcacatggatggacagacagacagatgggaaatgcacaactacatgaaggaaaatggaaacacatcttaggagacagaaagaagcttattattttaggtggttacaaaggctgccatcctgaaatataactgacttgagcctggtctggtaaaaacgcagtgctcaaatagtatgctcttccctgagaggacagctgatccacattctgtgcaatttctgggcatgcagggagacaaaagccatgctgggcccatcaggcagaggctgcaatacgtgagaccaccaagggcagacgggtagacattcctgcacactttttagcttcctctgcagcaacagaccatgagggcaaatgacaaccactcacagctgtttctacctgattgagtctcactatccttattatttttttttttgtcatcatcaactgtgttgaatcctcctctcctttttttttttgagaccgagtctcgctcttgtcacccaggctggagtgcagtggcgtgatctcagctcactgcaacctccgtctcctgggttcaagcaattctcctacctcagcctcccgagtacctaggattacaggcacccgtcaccacacccagctaatttttgcatttttagtagacatggggtttcaccacattggccaggctggtcttgaactcctgacctcaggtgatccacccgccgcagcctcccaaagtgctgggattacaggcatgagccactgcctggccatctcctgcttttttaaagagagtcttgctctgtcacccaggctggagtgcagtggtatgatcatgactcactgcagcctcaacctcccaggctcaagcaatcctcctacctcagcctcctgagtatctgggactacaaatacgtgccaacatgcctggctaatttttgtgttttttgtagagatggggttttgccatgttgcccaggctggtctcaaaatcttgatctcaagcaatccacgtgccacaacctcccaaagtgctgggattacaggcatgaaccactgtgcctggccctctcccactcttaatggcacttacagttcaaaaaaaaaaaaatctgctaattagcaaaaagtaaagattttcttactggcacattcaatctcgacaggagacagcggtgtgctcattgctaaataggaagcgtgtaatccgagaagcaggcccagattcctctctgtgtctatcagaggtgaggagagactccccagatctggtatggtgacgccttcttggtcaggctggaaaaataaatttaatcatcaatctgaggaaacagaattaattaaaaacataaaaccaaaaggacagctctctcctgcagctgtaccgcacgtgagcccaggggtgctctgggcgttctgcccctccatcctgtaatgagttggtgctgctgtgcccaagtaacagcagataccatataaacccacatgccctataaagcaggcagcaaccgcacagccctactgtagaaaaactaaaccacagatacatgatttggctagaatattccttaggaatcagtttccaaagtgactgtacaccatgcttcagaaagtataatgaattgttacatgcataaagaacccactgggcaacaaaactatgacaagtattcgatgacaagtattagtggactgtgaccacacatgtagaggaaatgaaatttattctaacaaaaatcaaactctgaaaaaagcaagagttcaactttttcagtcacagaagatatttacagcaaagttaattctccccttcataaactgttttaagccctgccctaatggcatttaatacatcttattacttgtcgatacctagtaagctaatcccaatatataaattctatgtgttcgtgaatacataggaaggacatatttctattgtaaagaattacacttctacatagttcttcccaaaaaatacatacctcaagattataagccattccaaatttctacataagaccaaagtttaacctcttttcttgtggaacactgcctatatttctcacaaattgatcatttaaaaaacaatctttcaagaccagtacatcacagatcttaacatgaataaatgtaaattcatttatgacaaaacttctaaaggatctttatatttatccctaatgccccgcaaaagacccagatatcagtacttctagatccaaatattcctatcacaaacacacagagggtatcccctgccatcctctgcatcactcaaggcatacagcctcacctccaaatactggccaacacaaaatgcgtgcatggattcccgggtgtcttcaaactgcaaagcagcttccaaagctaccactgggtcttcccctgcaaactgagctgaaacaaaaagggaaaaagcaacatgagttcaattcagcttgcctgaagagctacaggagaaatagtgagtaggaaataagttaggctcttaactcaaaagtgagggttaccagaatataatgacctcccactgtctcccagggttgcctgggccaactcggaacttgaaatgagttccaagtattaaaacaaaagatacataatgaaaggaaattcttcgaatgtgctgaatttgttgataagacagacaccaaagccacagatacattaaaatatgcgggggctggcacaaaactaaaggaatcatttataagccaaatactctgcttaaaatgatacaggctgtaacttttaaccaggaaataacaagtgtaatcttaccaagaatactattttctgttaacgactgtgtctggaagtcctttatatcatacactttcccgtcaatcacagtccagaagcctccatcgttattatggttctccaaatcagctatgcgtacaagtgtcactttctcattatttctacagttctgacctgtaaaaaatgactctgtatatacagaaaccagaatcagtccattgatcaatcaacaggtaaaatgaaaagaacaaactgtgtgaaagaactacaagcagaaataaacaaatccacaatcacaatgggagaaatacatacctagctctgaaactaataccacacatacaaattctgttaaatatagaatgctttaaaaaaaagtctaggcagcatgaataccaaatcgggccatgccaggccatagagtaaatctcaacagatttcaaagaaataaacttacagagcatgtgtgctgactacaatgcagttaaattacaaataggttttcaaaaattcattcaaaataaaataaaaatgactctgtatacacagaaaataaaaatattcatccacatatttgaaaattacaagatacacttataagtaacccaaaattctaagaaaaaatgactatgaaaattagaaaatgtgttcagttaataatcaaaatactgcagatcgaaattggtgacatacaactaaatgcatgcttgagggcatttatgcctttaaatgtatatatttacacattaaagggggaaaaagctaaaaaagaaaagaaacaccaaatcaataaaagtctgttagttcataaaaatactcaaaaaaaagaaaacctgagtggtggtcacctatgcaagtgctaggataccaactcaatattatgaaaaatagttaaagggaggtggcagttcaagaagtcaagcttagattatgtccttgctgtacaaattgtacctcctgctaaccagacagcagagggcaaggttggtaggggattttatagaggatacgcaacacatgaattccctggtctagcttcacagaactaaagcggggagccaccgagcattacaggcctcctgagccaacagaaagcatgcagcatgaccccagacataacaccgccccaacgagactgaattcaaatccaaccaaacctctagatctaaccagcagattaatgtaactaacagaagaacatgttggtctagaataagagaatgcaatcaaccaagttcagaaaatgtgaagttctccaaaataaccaacctgcttctttgaaaaagaaaacggtatgatcagagacagggagaagagggcctggagccatgttgtttggggaaagagactagaagcatatgtcaagcaatgccaatacgcagaacatgctcaggtcttaattcaaaattaccacctaaaaaaggcatttttgagatagtccaggaaaatgtaacatggactgcatgttagattaaggaatcactgttaatcttatagacaggataatgatattgtagggtttttttaaaatccttatcattaagaggtaaaataccttaaaatgttttaaagacagagttatgctttaaaataatccaatcagccgggcgcggtggctcatgcctataatcccagcactttgggaggccgaggcgggcagatcatgaagtcaggagatcgagaccatcctggctaacacagtgaaaccccatctcgtaccatgccatattactgcatttaacaggtatgatgaagcaactgaacaggctatttttccatttccattgcatttcaacagagcccattaaaaagtagtataaatggcccttaaatactaatatattttaaaatgctcaaactatgtcggggtcaccactttgtgctttagcaggcaaaatcccaaaagcccacacacaaggctgggagaccagcatccctattggtggtgagagaaatcaagatgtacaggagcaatctggtgacaaccagcccacacgaggtccatccccacctgtgcatgtgcacaggcacacacgcgtgcacacatggaggacacgtgttccaggccaggccttgcagtactatttgtgttttctgttgttgttgtttgagatggagtttcactcttgttgcccagcctggagtgcagtggcgcgatctcggctcactgcaacctctgcctcccaggttcaagcgattctcctgcctcagcctcccaagtagctgggattacaggcacccgtcaccacgccccgctaatttttgtattttttagtagagacggggtttctccaagttggccaggctgatctcaaactcccaacctcaggtgatccacccacctcgacctcccaaagtgctgggattacaggcgtgagccactacacccgaccctcagcactatttgtatagcaacattgtggcaataagcccaagtgtccaccaataagagactcactaaagaaagatagataaaagacacatccacacactgaagactaagctgatttataaaaacaaagagggacactctgataaggtactccagtatatatggttagttaaaaaaaaaaacaaaaaacaagcaacacaagtaatgaagcatgctaccatgaacgtactcatgccagagaacaaggaggttacagaggagactggaaagtcagagggagcaggtgggaaaatgggtggaaggggtgggcaggggaagcgacagtgtgtctctgcctaggtttgatttttgaaccatgtgactgtatttttttttttaatgactgtaaaacaaaataaatactctttatactagaaataaaatgttagaaaaatctggattcaaaactaggattactgttctgcactggcaaagttcactaccattcccaaaggcagttttctcattgacataatgagatacaacagcgtgcatgaggtcctcagcgggcctgcaccctacaggtgctccacacatgcaaatcactaccattactattacataagagatataatacataattatactgtcactactataaccagcatgacatactaagacagcctgcgttcagagtatgaagaaggctgtggaaccccctgcagaaggtgggagggcctggggctgtggataaaggggagctctctggggctgtgccacctgaacctggaacccgggcccccaggttgggtcgccaggcctgtgcgcctcagcttgctcatcactcactctcaacacggataacaccttcaactgcaaacacgtttaaaaaccacaggccagctccccctaccaataccagaaaaaacaagtctccacacgggcccaggatgagaacctacaagtggtactagctacaaaacacatggagaacacggttcttgcacacaccttatgagacgtcggagagctacacagaggaggcatctacagggtgtagccagacggtctaaatgggccatgacaacaaccgccgtttgttgcagatcaatggcaagcctgttgtcttgtggaagggtgaggtacctcaggaaactctcactggggctcagaggaccagacaaaagctagaaaggaaaagtaaacaaaaattcagaaatggtgggaaaaactaaagtaacacagttttttacccacgctttatattttggtattgactcatttgacccatcaaatgacaatgttgatgatacagttatactatacgtctatatatttatgcagcatataaactgtataaatctctaaatctgctgtatacatgtacacaacattgactgtgcatgtatacatttatgataccataggtaagttgaatccacacagattactaacatgaccaaaccactctacaagcctaggacccctggagaaaggcagaaccacctctgtgggaacccagcacagcatctcaagctggccttgaaatctaaaaccaaaacctttattttaatctaaatgttgcccactctggagaacacctactttcatttgcaaattaaatcacagttctaattcttctaaaggcagaagacccctattatcattagtttaaagactgccaaataataggctgggcatggtggctcacatctgtaatcccagcactttgggaggccgaggcaggcagatcacaaggttaggactttgagaccaccctggccaacatggtgaaacctcatctctattaaaaatataaaactgagctgggcatggtggcgggtacctataatcccagctactcgagaggctcagacaggagaatcattcgaactagggaggcggcagttgcagtgagccgagaacgtgcactgcactccagcctgggaaacaggcagagactccgaagacgggaagggacgggatgggacgggataggacaggacgggatgggataggacgggacgggaagggagaaagaaagcaatgtacccgcaaaacaaacaaacaaacaaaaaaacagtctcggggacctatgggactataacaactccggtcactgaactcacgaagggacaggagaaagaaggtggggctgaaactgtactctatgaagtgatggcttacaagttcccaaatttggcaagagacataaatctacagatctaaggtaagcaaaccctaaacaggatgaacccaaagaaatccaaactaagacatataataatcaaactccaaaaaacaaaagacaaaacatttcaaaagccactaaacaaaaacagtgccttaactatcgtagattaacaagtcaaatgacagcgaatttctcatcagaaaccatggagcccagctgaaagtacaaaatatttttcaagcgatgaaaagaaccattaacccagaattcttatatccagcaaaaatgtccttcaggaatgaaaaggaaagcaaaacattctcagaggaagtgaaacagaatttgtcaccagaagacccacaccaaaagaaaggctaatggaagttctctaagcagaatggcaaccatcaaagaagaaaaccctggaacttctggaaggaggagatgacaagcacaccaacgcataaatacaatagacttttccctcacctcttgactttgctaaattatgtctgaaggttcaaccaaaaattataacattgtcatatgtggttatcaatgtaagtaaatgaaatatttaaggcaagtatattatgaacagaagaacataaaggaacatcaagggaggtagtttctatatccctgaagctggtaaatgacaacatcaggtaaaatctgataagtgttcatacatacacaggctgagtgtcccttataaaatgctcaggagcacaagtgttccaaatttcagatttttatcagatttaggaatatctgcatataaataatgagatattttggggataggacccaagtctaaatacattcatttatgttttatatataacttatacacagagcctgaaggtaattttatatagcatgcttagtaattttgtgcatgaaacaaagttcatgctaagtacttatgaatggaattttcaatttgggggcgtcatgctggagtgccataaagtttcgaattttggggcatttcagattttggattttgggtttacagatgctcaatctgtatgtaatatattacctagaaaagccactaaaaaagctatacaaaaagatacactctaaaacactacagatgaaatagaatgctaaaaatggtcaagtaaaccacagagagccaggaagaaccaaaccgaaaaaatgaaaaacagaagaaatagaaaatgcaaaacaaaatggcagtgttaagcctcaatttatcaatgacattaaattaaatgtaaacaatctaaatacatcaattaaaagacactaggagagtagactagagaacatgatccaactatatgttgtccataagaaagtgacttcaaacaggcaaactgaaaatagaagtatagaaaaaaaaagatcatgcaaacattactgaaaggacagcaggagttggctatatttatatcaaataaagtaaacttcagaacaaagataattaccaggagggccgggcacagtggctcacgcctgtactcctagcactttgggaggccaaggtgggtggatctcaggagtttgagaccagcctggccaatatggcaaaaccccatctctactaaaaatacaaaaattagctgggtgtgatggcagaagcctataatcccagcttctcaggaggctgaggcaggagaatcacttgaacctggtagggtcggaagttgcagtgagctgagatcatgccacttcactcctgcctgggcaaaaggagcgaaactccgtctcaaaaaaaaaaaaaagataattaccaggaaccaacggcaacattacaaaatgagaacttggtcaatccaccattaagacacagcaattcgaaacgtgcagacaccaaacaaacaaaaaaacaatgaatagaaccgaaaggagaaaaagacatttatacttttatagttggagacctcaaaatctctctctacagctgataaaattaggagacagaaaagctgccaggatatagaacgcaacatcaccatccatcaactagagccaatcaaaatttatagaacactccagccaataataacagaatacataatcttttcaagtatccacaaaacaaatactaagttagaacatattctgaggcataaaacaaacctaacaaattttttgaaattaaaatcacacagcatatgttccctcaaacaatgggaacaaatctgaagtcaacaagagaacaattacaggaaaattgcctaactctcagaaactaaacaataaacttttacataacccatggatcaaagagaaagtctcaagggaaattttaaaatatattgtgaactgagagaaaatgcaagtacaatacatcaaaatgtatgggaaagagctacagtgggtgacgagagacaaatttacagcactaaatgaatggtacattagaaacttggaaacaaatcaataatataagtgcccacgttgacaacctaaaagaaaattaaaaatagcaaaatcaacccaaaagtaagcagaaaggaagaaataattaaggtaagagtagaaacaaagtgaaaacagaaaaacaataaacagtaaagcaaaaagctggttctttgaaaagatcaataaaactgacacacctctctaagcaagactgaaaaaaaaaaaaaagacataaattacccaacattagtgatgaaacaggctctaaagatatgaaaaaagataattaggaattactaggaacaactctacacacataactttgacaacttgggcaaaatagacttattcctcaaataatgcaaattaccacaactcaccaaatataaaatagatcatttgaatagctctaccactatcaagaaaactgaattcataattcaaagaatcccaaaaaaaaaaagaaattaccagatccaaatgaactcactggataattccatcaaacattaaaaaagaattaacacagactcaaaacaatctcttctggaaactagaaaaggaaaaacttcccaattcatattaagaagctaatattagagctaatattagcattttaagaagctaatattagagctaatattagcattttaagaagctaatattaggtaccgtacctaaagacagtacaaactacagaacaatataccttaatatatatatagacacaaaaatattcagtgaattattagcaagtagaagtaaacaatatataaaaagaattccacatcatcgccaagtagtttcattccaggaatgcaaagctggttcaacagtcaaatatcaatgtaacccaccctattaatagactaaagaacaaaaatcacataattacatatcaattgatttagaaaaagcaaatgacaaaattcaatactcgtgaatgataaaaattctcagaaaatagcaacaaatgggaacttcatcatcttgataaacagcatttacaacaccttaagctaaaacctatgccaacaagaatgtcagaaagggtcctcccagacctatttatacagcagagagaatcattaagaatgatttagatagttactaagagtttactctcctaagagattacaacacccaatggccagcaagcccttttcattagacaaaaagaaaagctgtgatctgtcaacactctcagaaggttcactgtgaaatgtgcacttctgaactcctgctgagggcctacacgctgcaatgttgagaagcaagtgtccagaggtctccttggaaacattgcaaaaaaaatgtgagggactgatggatgaatagaaggatgaaaaggtggagagaacggtgataaagcacgtgggatgatgccagcggcacaatcttaggtggtgaatatgtgggtgcgcgctgtaaaattctttcaacttttctgtatatatttttttcataataaaatgttggaaaaaataaacctgtgaaaaaggaagctttagtcaaacatatctaagcaaaagacaaaacaaattctaaattcctatggctcaaattaacgtgtttttctttttaggctgagatggaagagtaaaaaaacagaaaaagaaatgaaaggaataggagctattctaacagctacaaattccacctgcagtttgattaaagatggcgtggctcaagaatatgctttgaatccaagccccttcaaggctgccaggtacagagtcggttctgcaaaagctctgtacctgtgaacaagcagagcttccaaataaaccgattaaagctgccctgagtcaataagccgggctttaatctgagcaagaaaggtacatttttagtctagttacccacccataactgtaggtactttgatacctaggtgaggggaaacatggagaaaggcaaaataacagatttttaaaatcacaacaaatctttatcaaacatttgtgccaggcactgacttaagagcttcaaatgcattatttcatgtcatttgcacagcaactctctgagtaagtactttcacttattttatatataattttaattatttacattatattatacttattccttttttttgtttgttttttttgttttgagatggagtctcaccctgtcacccaggctagagtggtggtgcaatcttggctcactgcaagctccgcctcctgggttcatgccattctcctgcctgagcttcccgagtagctgggactacaggtgcccaccaccacgcccagctaatttttttgtatctttagtagagacagggtttcaccacgttagccaggatggtctcgatctcctgacctcatgatccgcccgtctcagcctcccaaagtgctgagattacaggcatgagcctctgcacccggccacttattcctgttttatacatgagaggcccaaggtgagacaaagtgatttgtgtagagtcagagataaagccaaaattgatacccagacagactgaaaaacttctctgtcagaaaatctagaaatggtaaagggagatcttcaaactgaaggaacatgataacacaaggtagctgggacagaaacaaaaccttaagggcccataatggtaaaatgaaagttaacataaaaaacttttttttggccagccatggtggctctttgggaggccgaggtgggtggatcacctgaggtcaggagttcgaaaccagcctgaccaacatgacgaaaccatgtctctactcaaaaatacaaaattagccaggtgtggtggcgtatgcctgtaatcccagctactcgggaggctgagccagaatcgtttgaacccaggaggcagaggctgcagtgagccaagatcatgccattgcactccatcctggcagcctgggcaacaagaccaaaactccgcctcaaaaaaaaaaaaaaaaagaggccaggtgtggtggctcacacctataatcctataatcccagcacttaagggtggctgaggcacgtggatcacctaaggtcaggagttcgaggcgaacctggcaaacatagtgaaaccctgtctctactaaaaatacaaaaacgttagccaggcacggtggtgtgtgtctgtaatcccagctactagggaggctgaggcaggagactcgcttgaacctgggtggcggaggttgcagtgagctgagattgtgccattacactccagtctgggcaacaacagcaaaactccgtctcaaaaaaaaaaaagacttttttttctcttttcaaatttgaggggaaaaaatgtaattgcctatttaaagcaaaaacaaaaacatcatattgtggggtttataccatgtttcacttggacatgacacagcaacactaccaaccaagaacatgtcagaagcaggaagctacagtcagagcactgccccgcggctcaggcagtgtaataccatttgagagtgggcagtgacaagtgaaagatgtaactgaaaacgccagagatgatagatttaaacccaagtagtctaaagattccaaataaaaaacagaggttgtcagggtgaataaagaagcaagacctaattaaatgatacctgaaagaaatctactttacacatacacaaagtttgaaagtgaaaaaagctaaacctggcaaacacaccacgcaaacaccaaatcagaagaaaggagagtagtcagaccaaggtgacttcacaacaaagaatgtcaccggagattaagggggtcaaatttatgaatatggcgtaaaaatcctaaaagtgcatgcaccttataacattctcaaatacatgaagcaaaacctgcagagctgaaagaaaataatccataattagcatgagagatttcaattctcctcagaagaaagaggaactaagcagtgaaattgctcttcatgcctccccagcacaatggagatactcctgggaaataaagccagtcactggggctgatctcccagaacactgagactggcttctctgtaaataaatgactggtatttgctaggagaagtgtccttatctatgaaatgtttttagcaagatgtggttagtttaggattgtgtttggtaaacatacctaaaatccatggacttatgggacatggctccctggaaaaggttccctaaggtgtataaactatctgactacaaaacgggaacactgcacatccttaatgctccttgtgcagtgagatgacgacacacctcagtgagaggaccacacgcctcagtgagaggtctcatctcgcaggccgggctcaaagaggatggacctgcgggggttgcacagactctcccacatctctccccactttgcctgagcacacaagtgaggatattacttgtatctttaaagttactaagtaatcagctacgggtaacatctctgagattcatgtcaaactaatgtggtaagccaaccttgtgtgttagttcaactcctctcctaacagtgactagaacaagcaggcagaaaactatttcaagtcaaggatacctgaacactatcaacttgatctcactaagctttacagagcagcaaaatacacttttttttttttttgagatgtagtcttgctttgtcacccagactaaagtgcaggggtgcaatcgagattacaggcacccaccaccacacccagctaatttttgtatgtttcgtagagacagggtttcactatgttggccaggctggtctcgaactcctgacctcaagtaatccacccacctcagcctcccaaagtgttgagattacaggcaggagccactgcacccagccacattcttattacatgtgcatgaaacattccacagaatgcaccatattctggggcttcagacaagcctcagcattgaaatcacagaatatgttctctgactacaactaatttagaaattgttaacaggagatatttgaaaatccccaaatatttggaaatgaaataacacatttccaaataataagtgagtaaaagaagaaattaaaagggaaattagaaaatattttcaactgaatgaagatgaaaatgaataaacatttccaaatttgtgaaatgtggctaaacaatgcttagagggaaatttatattatagttttgaacacttgttagaaaagacaaaaaatctgaagtcaatgatctaagcctttaccttaagaaactagaagagacagaagaacaaatggaacccaaagccagcagaaaaaaggaaataataaagagtaaagcagaaatcaatgaaaaagaaaacaaacaaaatcaataaaaccaacaactggttctttgaaaaaactcaaactgatgacttctagaaagactgatcaaaatcgaaagagagaaaatacaaggcacatttcagcaaatttctggataacaggtagtatatgctggtacttactacatgcaaaataatagcatacgcactttgtctggcctactgtactgatcccataataacctatgaggtaggtactactactaaccccaaatacgaatttttttttaagagacagggtctcaccctgtcacccaggctggagtgtagaggcacaatcatagatcactgcagcttcaaactgatggcctcaagcaattctctcacctcagcgtcccaaagtgctgggattacaggcgtgagctaccatgcatggtgtcactaattatttttatatatgtacatttacatatgtatgtccatgccaggaaagaaaagcctgaatatccactctgaagggataatagtggctaactcttagaggaaaactgaaattggggtgggcagccaggtgaaatttctgcttttataatcgatacatttttataagaaaacatttatttgatgtatatttttaattggaacgaaaatgcatcagacattttaaaaaattcaattacacacaaaaaagtaagcaaagaataaatatatgggttttactgggttggagaaagggaagagattatgaaagtccatccatgataaggaactcctataacccaaaacaaaaaactcaattaaaaaatggaattagctgggtgtggtggtgcccgcctgtagtcccagctactcgggaggctgaggcaggagaatggcgtgaacccggaaggtggaggttgcagtaagccaagatcatgccactgtactccagcctgggtgacagaacaagactctgtctctaaaaaaaaaaaaaaaaaaaaagaaagggcaaaagggccaggcacagtggctcatacctgtaatacagcactttaggaggccaaggtgggtggatcacctgaagtcaggagttcaagaccagcctggctaacatagtgaaacttcgtctctactaaaaatacaaaaaattagccaggcacggtggcggacacctgtaatcccagctactcgggaggatgaggcaggagaatcacttgaacctgggaggaggaggttgcaatgagccaagattgcaccactgcactccagcctgggcaacaagagccaaactccatctccccaaaaaaaaaaaaaaacaaaaaacgggcaaaggatttgaatagacatttctccagtgaatgtatacaaatggccaataagcatgtaaaaagatgctcagcatgactaatcaacagggaaatacaaatcaaaacaatgagatgctgtacctactcacacaaattaggatggttatcatcagaaaacaaaaagtgttggtgagggtgtggagaaattggaaccttagtatactgctgcaagaatgtaaaacaatgtagccactgtggaaaacagtttactgcttcctcaaaaagttacacatagtgccaggtgcgatggctcacatctgaaatctcagcaactcaggagtctgaggcaggaagatcccgtgaagccaggagtataagaccggcctgggcaacacagtgagattctgtctctaattagtcaagcgtgatggctgggcaacaatgtcaatatatttaatgccaatgaactgtacacataaaactggttaaaacggtaagttacatggtatgtatattttaccacaatatttaaattttttaattagtttttaaaaaattgttaccaaaaaaatactaagaatccattcaagttatttagaaagggagtgtcagatcaacctttccaaagtgccaaaattcgcaagatcacctggttgcttgccccatacccagctgtccagaattgacttggccctatatataggtgcaggagtttcttcttcatcttttttctctttgtcattcagatctttctttgtcccacttggttcgacactatcatctgcagaattaaaaattttttaatctgtcaccgcttttcagaatgtcataccgttagcctctgcaaatgtccctccccgaaatgttacaacacacatgattaactgaatgcttgacaacttaaaaataaaatacatcaatcatacctgtaacagatccagtataattttcataaagaaaccaatatattggccgggcgtggtggctcatgcctgtaatcccagcactttgggaagccatggcgggtggatcaggaggtcaggatatcgacaccatcctggctaacacggtgaaacctcgtctctactaaaaatacaaaaaattagctgagcatgatggcaggcgcctgtattcccagctactcgggaggctgaggcaggagaatggtgtgaacctgggaggcagagcttgcagtgtgctgagatcatgccactgcactccagcctgggtgacagagcgagactccatctcaaaaaaaaaaaaaaagaaaccaatacaacaaattatttaaaggatgtcttccaaaatgatattccatctacttcctagtacatttcttaactgagaaacttaagtctttcatatttacctacttcaatttcacaccaattgcttttatccagtgagtctcagtgcttgtgtatccatgggaaaagggagggtgtagaacaagagtatgattcaaaaatcttttaactctttacaaggccctactccactgccaactgggaagcactgctatgcaggggcactgtcactgctggcataattcaagagcactgggacacaaaggaaaagctgagaaaaatcactttaggccactgacaatgtcaagtttcagtcaaaaacaactgtcataaaactccttacacagtaagcgaagagaagagagaactaaccttaaccttgaagtgtaaacacactccatcacagaaggctgtgactaaatgtctaacaacataattagaaaaatgtatctcaatcggggaaagacatgatatcccatccagattacaaataatgactatctaaaaatctcgaaggaaacagttcctctgtttacaacacttctgacaccaaatgtatggacttttgcaccaagcaattctccagttctctgcgacacccagctttgtgtcccacagtgcaattcaattctgaaactaactacctagaattagcacagaccccacaggttaataacaagagagaaaaggtgaatgctgaaaaaaatatccaaagaactaatggctgaaaacttcctaggttcagcaaatgacataaacccaggcagactgaagaatctgcacaaagcccacacaagataaatccaaaggaagccatgacgaggcacatcataatcaactgctaaacactaaggacaaaaccttttgaaaagtgccacggaaagtagatacagaagaatttctcgtgtggcctgaaattaagactaaatattacgtgctgccttgacattggtaaaatcaagaaggcctcaaatagcctaaccacaaggtctcccctgagctctgctctcacggataagatcccaaagccaaacaacctccttatcgcggaaacccgaccccagcctgctcatccctgccggcccagagttattcaaacaagccagtcacatcttcccatggaagcaaggtcatctcaccctcctgttactacaaaatgtgcctcccacagcccctcgtggttcgctctgttcccaagtgcagcccccgtgtggcatgcggtgtcccccaccccagggctgtgagcatgcgtgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaactcacagaggatacaagagtggcaaaaaagaacatgatattcagcattgttagccattacagaattgcaaattaaaaccacaatgagatcccactagacttgttagaatggctcaactaaaaatcactgataacaccaagtgctaacaaagacacagagcaacagaaacgtgacagattgtcagcgggaatgcaaactaaaacagcctccagtttaccaaggtagacacctcgagtcacagaatacagagtagaacccagccaggaacacggctcaggtgagaacacaggtgctggctctgaatgccagactctgccgtgtgtgtgtgtgtgtgtgtgtgtgtgtgtgtgtggtcactaaccacagcccacaggacaaacccagcccacagcctttttgtgtatggtctgaacacagagaaagtattttagttttgttgttcttttgagatggagtcttggctcaccacaacctctgcctcccaggctcaagcgattctcccaggttcaagtgattctcatgcctcaacctccgaggagctgggattacaggggtgcatcaccatgcccggctaattttttgttttcagtagagatggggtttcaccatgttggccaggctggtctcgaactcctgacctcaggtgatccgcctgcctcagcctccaaaagtgctgggattacaggtgtgagccaccacgcccagccaccgtattttatagtttttaataattgaaaaataatcaaaagaaaaacagtattttgtgacttgcaaacattctgtggacttcatcttttcgtgtccataaataaagtttacagaatgaacgtccccagcccgctgacgtagtattgtctgtggctactctggcactacagctgcaaggtcccatggctatgacagagaccatagggtccattgagagcttaaaatatttactatctggccctttacagaaagtaggccacccctaccctacatctggctataaattttacaaatttgacaaattctgagaccctgtctcagaaaataaaataaaatattcatagtcttaataatggaaaacaaaaacatttactgaatgccaaaacatctccctaacaatcccaatcagttgggatctacataaagaacaattatgctctgctttccaaccatgatttttaaaagaacaaaagacaaaaaaattcatcaaatgtgggctgggcatggtggctcacacctgtaaacccagcactttgggaggccgaggtgggcagattatgaggtcaggagttcaagaccagcctgaccaagatggtgaaactccgtctttactaaaaattcaacaattagctgggcatggtggagggcgcctgtaatcctagctgagtactcaggaggctgaggcagagaactgcttgaacccgagaggaaggggttgcagtgagccaaaatcatgccgctgcaccccagcctgagcgacagaacaagactccctctcgagaggaaaaaacaaaaaaaattcatcaaatgtaatgaataaaacatatactttggattttgccatgtacttagcttttcttagagcaccttttagaactattgtttcacagaaaacactttgggaaatgttttaatttataaacaaatactggagggctaggaagaagaggttaaaactttttaaaatatacagaatgaattactgatacagaaaaacaaaaaaaggttgctgattcctgtcttggaagacactgtcatatggacactcttagcctcagcatccagaggtccagaaagggaaaatttcaagtcagagagaattctatatataccacttacttggaacattcagccctcaaaatcccaacatcatgacctcagtttcaacacaattgtccttagtccttatgtcactgcttttggtgctgcctgctgtcaaggcagtggaagccagtgatgcaactgctctctcgttaaaaggtgtggttctcagtattacaggtgttcgtacttgcttgcgggtatacgcacgaaagataaaaatgaacagatgtgactttgaagggcctaatgaatgaaacctcaccctgaaaacctttgtgctactgaaactaaatgtaagctttggtgtctgaaagtttccaagaattagtaagtaggagagttttactttctgagttgattccatgaaatgggaacaaattggtacataaatggattttgcccagaatcctaggaaatcgccactgttcagtcgtaatcactgcctcctaaatcactgagtctgttctctgtatttttattagacttttgtcatctcccaaattcagatatccaatagtcagccaaaaagggaaacttttatctctggaaagaaaaaaaatcatttagaaaaatgtattcagtgtatctaatactgaaatggagaaaagacttaatgttaaagaaaaaaaaaaacactatagacattgacatggaaaagagatttaatgttaataaaaactttatattaactgagtaacacctcctgatgagaagtgctatattaaatataaacccattatgttgtttaaaaaaaaaaaaacatgaaaatcaaaagcactaaacagagtgaaagaagccaagacacagaagaacccgactacatgattccatgtatggagttctagaacaggcgcaatttgtcaatgctggagaaacatcaggccagctattgcctctgggaagaaggggcaggacaccagagaactttctgagcaagagtcatgataaagatgtgggttacacgggttacatttgtcaaaacttgtgaaatggtaaactcaaaatagatacatttcattatatataaattttacctgaaagtcaaaaacaaagttgaactagaatcaattacatacatgagtgtctaaggagctaggtgagacaaacggtggatggacagacagcaggatgtggagccaaatacggtggtagaacatggaggtgggtctgcagccactcactgtacacgtctgtcagttattgtgtgtgtgtgtgtgtgtgtgaatattttcaaacaaatataaaaaataaattaaaataaaaacacaggtaactctgcttgacactgaaactgaagagggagactaatactttttcccatggtttgttttgtgttttttgtttttttttttttgagatggagtctcactctgtcacccaggctggagtgcagtagcacaatatctgctcactgcaacctccacctcccggctccaagcaattctcctgccgtgccctcccaagtagctgggattacaggcgcccgccactatgcctggctaatttttgtattttttagtagagacggggtttcaccatgttggccaggctggtctcaaactcccaacctcaaatgatctgcccgcctcagcctcccaaagtgctggaattacaggcacgatccaccgcgcccggtccccaagtattttcaagtggacaccatcccaattcattccacaaaagaagaataaatacttgccaggcacggtggctcacgcctataatcccagcactttgggaggctgaggcgggcggatcacgaggtcaggagattgagaccatcctggctaacacggtgaaaccctgtctctactaaaaaatacaaaaaattagccgggcgtggtggtggacacctgcagtcccagctacttgggaggctgaggcaggagaatggcatgaacccaggaggtggagcttgcagtgagctgagatcgcgccactgcactccggcctcagcgacagagcaagactccttcccaaaaaaaaaaaaaagaagaagaaatactttcttcagactaatgctctcccaactgagctatttcaacttagaataaatactttctaaagtggtagctttatccacgttgatgactctcaagcagggggaccaacgaacttcaacagtggttctcaaccaaggatcttttcagattcaacaagtttagggtgtatacaagcatccatttttttaaacctcaatggggactctgaaacacagccactgttatgaacaacccaatgatagtcctattgagcatgcaaaactacaacgctaaataagattgttcaatggcatttccttgcaggccaaaggcttccaataagtgtttaatacacccccaaagaacaccacaaatgcagcaagacggttttgcaataaaaatgccttcaattcacgtaaaacaataaaatccgggcagcttgtattaactaccattttagacaacaatctccaaagtaaaaagcaaaacttcaaagagttaagctcaaagctcctgttcctatagcacattacaaaatttctataaaatgcattttataatggtctttaccaaataaaaaacactagttaaaggcccttaccttttccaggagggagctatccgttctgggttgattctgttccagtgtatacaatttctccatctttaaccatttcattccacagaccacagagcccatctcttgtgaatgcaagctggcaatgataaacgagataagctcacactcacactgcaatttttaaagaatgatatgggaaaaaatctcaatcccccttatgtattcgatcattcggtaataaaatcaatgatttactgaattagtgacttaatcattttacatttcatgaaagtcatccaagaaatataaatgaaaaggtgcataatagtataaatactattctacctcttatgtaacatacaagaaaaatgacacgtggtcgggcgaggtggctcatgcttgtcatcccagcactttgggaggccgagcggggcacatcacgggggatcaggaatttgagaccagcctggccaacacggtgaaacgccgtcccaactaaaaatacaaaaaattagccaggcgtggtggcgggcgcctataatcccagctactcacgaagccgaggcaagagaattgcttgaacccaggaggcagaggttgcagtgagccaagatcgcgccacagcactcagcctgagttgataagagcgagactcggtgttaaaaaaaaaaaaaaaagaaaaaaaaaaaaaagaaaaaagaaaaaaaagacacacacacaaacacacacacgtgcatatgctctgaaaagataaaccgaaagcaagtaccaatgactacctacggggaaatggggaggggacatggacaaaggcagcaggaccagaaaaagcaacaacattgtgagtatactttagatgtctttacttctgaaacatacatgactttcatcctcaaaaattaaaattaaatcataaaaaagcaaaacctacaactggcaacaagcaaattaacccatgcatatacaaagaaaagtatgtcaagggacttttgaactacatatcattaatagaatatactataatgaaaaataaaatatttatcggtattgataacactctcacaattttagaactacttcatgttgcacaataaagcagtgtaaatacaataaaacatgtttatgataaagtattaaatgttcttagaaattaaggttttaggccggccatggtggctcacacccgtaatcccagcatttggcaggccaaggcaggtaaatcacttgagatcaggagttcatgaccagcctggccaacatggtgaaaccccatctctactaaaaatatgaaaaattagccgggtgtgctggtgcatgcctgtaatcccagtcactcgggaggctgaagcagaagactagcatgaacccaggaggcagaggtttcagtgagccgagattatgtcactgtgctccagcctgggtaaacagaacgagactccatctcaaaaaaaaaaaaaaaaaaaaaaaaaaaaaaaaaaaaaaaaaaaaaattaaggttttcagtggaaaggaggaaaaaaaatcaaagaaattttgaaaaacaacttaaattggaaatctatgaactttatttttgaatatatttgcttactctgttttttaaaggactagaatcaaaggcaatctgacagcggcacccagattttggtctcttagaaccatttcccgataaaagacgctagggctcttgggaaaataagtagattcaagggccagggcagacaaagatgagcctgtttcctcaaagaaaaagctgtttcctcaaacatggccaggtgcggtggctcacgcctataatcctagcattttgggaggctgaggcgggcagatcacttgaggtcaggagttcgagaccagcctagccaacatgccgaaaccccatctcttctaaaaatacaaaaattagctgggcatggtggcaggcgcccataatcccagctacttgggaggctgaggcaggagaatagcctgaacccaggaggcggaggttacagtgggccaagactgtgccactgcactccagcctgggtgacagagcaagactttatctcaaaaaaaaaaaaaaaaaaaaaaaaaaaagcagctgttcaaagacgatagggactcctggccaaatttataataattataataactgtgagcatcaaaatcaaaaacgcctttgcttgtcaacatttgtgagtcagaaaaggcttcccagaacaggaaaagggagcatttcagacactgggggaaggcatccattctgaaaactgcgtatgtgacagaagctcccttgtctggcaaaacaaaagccatttttaattaaaagagacagatgtttgcccatctttttttttttttaacttctgtggatacacactagttgtatgtatatatatatgggttatatattctatctaactctttttttttttggagacggatctcgttctggcactaagctggagtgcagttgtgcgatctcagctcactgcaacctttgccttctgggttcaagggtttctcctgcctcagcctcccgagtagctgggactacaggctcacaccaccacacccagctaatttttgtatttttggtagagatggggtttcaccgtgttggccaggatggtctgggtctcttgacctcatgatccacctgccttggcctcccaaagagctgggattacaggcgtaagccactgtgcccagccctatctaactccatttttatacccattaaccatccgcacttcacccccactttatccttcccagtctctgataaccatcattctactctatctccatgagttcaattactttcatttgcttagcacctacaaataagtgagaacatgcaaagttcgattttctgggtctggctcatgacattctgttcctgacttaacataacgacctccagttctatccatgttgttgcaaacggcagtatcccattctttttcatggttgaatagtactccgttgagtatatataccacattttcttcatccattcatctgctgggaacacttaggttgcttccaaatcttggctattgagaatagtgctgcaataaacatgagagtgtacatatttcttcaacatactgatattctttcctctgggtatatacctaccagtgggattgctgaatcatatgatagtcctatttttagttttttgaggaacctccaagctaatctccataatggctgtgctaatttacattcccaccaacagtgcacaagggttcccttttctctatattcttgccagcatttgttcttgtcttttggatataagccattttaattagggtgagataatatctcattatagttttgatttgcatgtctctgatgaccaaccatgttgagcacctgttcgtattgcctgtttgtcatttgtatatcttcttttgagaaatgtctattcaaatcttttgcccattcttattggattattagatttttttcctatagagttgcttaagctaattatatattctggttattaatcctttgtcagatgggtagtttgcaaatattttctcccattctgtgggttgtctcttcattttgttgattgtttcctttgctgtgcagctttttaactcaatgtgatcccacttgtccattttagctttggttgcctgtgtttacgaactattactcaagaaatcattacccagtgcaatgtcctggagagtctccccaatgttttcttttagcactttcatagtctgaagtcttaggtttaagtctttactccattttgatgtgattttcgtatatggtgagagatagtggtctagtttcatttttctgcatatgggtgccccattttcccagcaccatttatcaatgaggctatcctttccctcatgtatcctccgggcacctctgtcaaaggtgagttcactgtagatgtatagatctgtttctgggttctctattctgttccattggtctaggtgtctgtttttataccagtaccatgctgttttggtatacctttctagtaaactttgcacttgatctaagccaaaaaagaccaggaagtgactgtagtataattttaagtcaggtaatgcaatttctccagttttgttttttgctcaggatggctttggctattctgtctcttgtgattccatacaaatttcaggatttttttttctatttctgtgaagaatgtcattggtattttgataaggattacattgaacctgtagattgctttgggtagtacagacattttaacagtattgattcttccaatccatgaacacagagtatcttttccttttctgtgtgtcttcttcaattttctgcatcaatgttttacagttttcgtggtagagatcttttcacttcttgggttaggtttattcctacgtattttactttatttgtagctattataaatggaattatttttcttgatttatttttcatattgttcactgttgacatatagaaatgctactgatttggctgggcaaagtggctcatacctgtaatcccagcactttgggaggccgaggcaggcggatcacctgaggtcaggagttcgagaccagcctggccaatgtggtgaaaccctgtctctactaaaaatacaaaaattagccaggcctggtggcaggcgcctgtaatcccagctactcaggcggctaacacaggcggatcgcttgaacccaggaggcagaggttgcagtgagccgagattgtgccattgctttccagcctgggccacagagtgagactccatctcaaaaaaaaaaaaaaaaaaaaaaaaaaaaaaaaaaaaaagagagagagagagaaatgctactgatttttgtatgttaatttagtatcctgcaattttactgaatttatcagttctaatcattttttggtggagtttttaggtttttccaaatataacaatcatctgcaaacaagagtaacttggcatcttcatttccaatttggatgccctttatttcttcttctttttttttttttctgagatggagtcttgctccatagcccaggctggaatatagcggcacaatctcagctcactgcaatctccacctctggggttcaagtgatttccctgcctcagcctcccgagtagctgggacaacagacacccgccaccacgcctagctaatttttatatttttagtagagatagggtatcaccatgttggccaggcttcaaactcctgacctcaagtgatccactcacctcagcctcccaaagtgctgggattacaggtgtgagccactgcacccggcctttctctctcttatctgactcctctagcaagggcttccattattatattgaataacagtggtgacagtgggcatccgtgtcttgttccagatcttagaggaaaggctttcagtttttcacctttcagtatgatactagctgtgtgtcagttgtatatggcttttattgcgttgaggtgtgttccttctataaccagttttttggggtttttatcatgaaaggatgttgaattttatcaaatgcctgttcagcatgaatttaaatgatcatatggttttttatccttcattctattgatatgatgtatcaaactgattgatttggatatggtgaaccatcctggcatccctgggataaaccccactttggtcatgatgaacgacgtttctaatgtgttgttgaattcggtttgctgatattttgttgggtatttctgcatcaatgttcatctgggatactggcctgttttgtttttttgattatgtctttgtctggttttggtatcagggtaatattggccttctacaataagtttggaagtattccctcctcctctatttttcagaatagtttcactaggattggtaatagttcttctttaaatgtttggtaaaattcagcagtgaagtcactgggtcctggggtttttctttgctggaagactttttattattacagtttcaatctcattacctgttattggtatgttcaggttctggatttcttcatggttcaaacttggaaggctgtatgtgcctgtgaaattatccatttctttttccttctttttttgaagacacagtctcactctttcacccagggtggagtgcagtaacatgatctcagcacactgcaacctccccctcccagggctcaagtgactctcgtgcctcagccttccaagtggctggaattacaggcacgcaaaaccacacctggttaatttttgtatttttagtagagatggagtttcaccatgttggccagactgctctcaaactcctgacctcaagcgatccacccgcctcagcctcccaaggtgctgggattacaggtatgagccaccacgcccagcctgcaaacttatctatttcttccatgtttcccaatttattgacatatagctgttcatagtctctaatgaccctttgaatttctgcaatatcagttgtaatgcctactttttcacctctgatttgggtcttctttttctcttagcctgcctgaaagcttgtcaatttatcttttagaaaaaccaacttttcatttcattgatcttttgtattattttcttcatttcaactccattttatttctgctctaatttttattatttctgtccttaaaattatgggtttggttagctccttcatttctagttctttaagatgtatcattaggttatttatttgaagtttttctacttttttgattttcctcttagtattgctttcactatatcccacaggtttcgtatgctgtgctgccattgccatttgcttcaagaaattgtttaatttcattcttaatttcttcactgacctgttggtcattcaggagcatattgtttaattcccatgtgttggtggagtttccaaaattcctcgttattgatttttagttatagtccattgtgatcagagaagatacttaacataatttttttaactttaatatggcaaaagaggaatctagcttcattcttctgcatatgaatatcaagttttcccaacaccatttattgaagagattgtcttttccccagtgtttgttcttggtacctttgtcgaaaatgagttcaccgtagatgtgcggatttgtttctggattctctattctgttccgttggtctgtgtctgttttatgctagtactatgctgttttggttactatagctctgtagtataatttgaagtcaggtaatctgattcctccagtttgtttctttttaattacgagagcttcggctattctgggtcttttgtggttcaacatgaattttaggattttttttttttctgtttctgtgaagaatgtcattggtattttgctagggattgcactcaatcggtagattgctttgggtagtatggacattttaacaatattgattcttccgatccatgaagatgaaatatttttccatcttttgtgtcctctttaatgtctttcatcagggttttagagttttcattacagagatctttgtaattatcttctttggttacttcccaggtacttaatttcatgtgtggctactataaatgggattagttttctaatttttttcatattgtttactgttggcacacagaaatgctactgatttttgtatgttgatttcgtatactgcaactgtactgaatttatcagctctaatcattttcttgtggagtctttaggtttttccacatataagatcatatcatctgcaaacaaggataatttgacttcttcctttccaatgtggaggccttttatttctttctcttgtctgattgctctagcaagaacttccagtactatgttgaataacggtggccacactgagcatccttgtcatgttccagatcttagaggaaagactttcagtttttcaccattcagtatgatactagctgtgggtctgtcatatacggcttttattatgttgaggtatgtttcttccataatcagttttaagagattttatcatgaaaggatgttgaattttatcaaatgccttttcagcatcgactgaaataatcacatggtttttatccttgacatgatgtgtcacatcgattgatttgcatatgttgaaccatccttgtaccccagggataaaccccacttcatcacaatgaacgatctttctaacgtattgctgaatttggtttgctagtattttgttgaggatatttgcatcaatattcatcagagacattggcctgtagtattctttctttgacgtgtctttgtctgcttttagtatcaaggtttcaatttttaatgacttattttgtggcctaacatatggtctaaccttgaggacgatccatgtgctaaagagaacaatgtaaattctgcagccatcagatgaaatgttctagaaatatctattaaatccatttggtctacagtgcagattaagtttgatgtttcttcgttaattttgtctggatgatctgatctgtccaatgctgaagtggagtgttgaagcctccatctattaatgtattaacgcctctctctctctttagctgtaatatttgttttatgtatctgggtgctctagtgttgagtgcatatatacatatatttataatagttatagcctcttgctgaattggcccctttatcattacataatgacttttttggtctccttttatagttttggtcttgaaatctatttggtctgatataaccgctatgctcttttgtgatttccatttgcctctccctttttccatccctctgcaccgtcctgaagagatggtctccaatctgaagaagcaagcagccaatgaactgcccgtggggaggggcagcctccaagagcccagggtttcagtcccacaaccacaatggattcaattctaccaatgaggacctgagctccagatgacagcgtgccctagccaacaccttgactacagcctgtgacacctgaagtagaggatagaactaagctatggccagactcctgacccacagaaactgtgagagtgtaaatgcttgttgttacaagctgccaaatttgtgtttggtaacttgttctgtagcgacagaaaccaagccagcatccttcagtttttgtagaaggaacagctttctctcagcactgttattttttctgttcacatcactaacaggataactgccataaacatacttggaaccaaaacatatgacttttggtaaaaatatcagctggtgggggagaggtaaactccttcctaaaaagtgagccctggccaggtagagtgactcacatctctaatcccagcaccttggaagactgaggcaagagaatcacttgtgcccaggagttcaaaaccaatctaagcaacatagcaagaccctgtctctacaaaaaaattgtaaaattagccagaaagctgggcatggtggctcacacctgtaatcccagcacttgggaggccacggcaggtgaattgtttgagctcaggagtacaagaccagcctgaacaacatggcaaaaccgcatttctaccaaaaatacaaaaaattagccagaggtggtggcgcgcctgtactcccagctacttgggaggctgaggtgggagaactgcttgagaccaggaggtagaggctgcagtgagttgagatcactccactgtactccagcctgggcaatagagcaagaccctgtcaaaaaaaatttttaatttaaatttaaaaaattaaaataatataaaaaataaaattaaaaagtgagccaaaaacattcagggcccctgaagtttaacgagtgaatggaaagctttgactcttctagtcttcagtcagaggagagcagtgaatacgtgcactggggttcagtccaaaccctaccacaatgcacatgataagaggctaacagtggtcagaactcacagctccatgtgggccgtgctccaggagtttcagactatctttaggcactcaagggaatatgacatttgacccatgtcttaaagtgtttcagaaaacagaaacagagaaggtgaactaagaagctattactggccaggcacggtggctgacgcctgtaatcccagcactttgggaggccgaagcgggtggatcatgaagtcaggagataaagaccatcctggctaacacagcgaaaacccatctctactaaaaatacaaaaaattagccagatgtggtggcacgcacctatagtcccagctactcgggaggctgaagcaagggaattgcttgaacctgggaggcggacgttgcagtgagtggagatcgcaccactgcactccagcctgggtgacagagtgggactgcatctcaaaaaaaaaaaaaaaaaaaaaggctattaccaagggtccaaaaaagaaaggatgacagcagaagtcaacacagggaagtacagtctttaagattatttcaggcagggcacggtggctcacatttgtaatcccagcagtctgggaggccgaggtgggcagactgcttgagcccaggagttcgagaccagccagagcaacatggtgaaacccggtctctacaaaaaatacaaaaattaaccaggcgtggtggtacgcacctgtagtcccactactcagggggctgaggtgggaggatcatctgagcccggggaggttaaggctgcagtgagccgtgacggtgccactgcattccagcctgggcaacagagtgagaccctgacttaaaaaacaaaaaaagaaactatttcaaatcacgtaagttaaatcaaatgtgaaagggaaaataagggagggaacagaagaggaatgagaattagttccgttttaaccactaagatttgcactaactactgaacataaacatggagctcctccccactccaccaaccctcagtaaatatagatccagatcttagcagagtgttcagggctagagactcaaatctgggagtagtcaacaaatggactgtaggtgatgtcctggagaagatgccaacacccaagcagagaggggagacccctgcccagccctgaaagcactctaagatcgccccagactggctgggctccacacatcagtgttctgcggtacagcctagattgagaaacattagtgttacagaggtaccatttaaaaaaaaaaagccaaaagatggaacatttaaagactaagccaaggaggaagcccagtttacatggaaacaagaataattaccaccacctttcgattattacctgggtagcactgggaaggaagaggataggccagaccttgtccttctgagtaacaaggaattcttttttggaaggtagacactggactcctggaaggacatgcactgtggaagcctcctaggaactgatgacccaaataaatggtaagcaccattcaaaaaactatttgggcaccttaaaggtggaacattactaaagcaataaagcaagcctcactggaggaggtctccagagagttagactgtgaacaagcaaaagtgaagcccaggagaagagctctccagatcacagacagtacaggatcctgactgaggaagcagcagcctgggaacaactggaagacagccgtggcactgagaagaatggagactacaggcagggcatggtggcccacgccgtaatcccagagctttgggaggccaagacagaagaactgcttgaggccaagagttcaagatcagcctgggcaacatggtaagaccgtgtctctacagaaatgtaaaaattacccaagtgcatggcacgtgcctgtaatcccagctactcaggaggctacagcaggacggtcacctgcacccaggagtttgaggttacagtaagctctgatcacaccacagcattccaacctgggtgacagaggccctattcatttaaaaaaaaaaaaaaaagaaagaaaaagaaaaaaatgaatgggactttccatttgtaaagtgagagtatttatttctacaactgtctccaattagctttttattagtagctgacttacctaaacgtgcccagtagcttttcaacttttgacttttttggttcagatcccagaagcttctaattaggttatttgggctaagaactcttttccaatcttttccaatctcacattcctatcttacacctctgaaatgacatggcaagtaaaggcactttcatcatcaaaagaccccagcaaaagaggcagtaacaggctcactttttgtaagttactaaactgaagctcagaaggccaatgacttgaccaaaggccacacaacactgaggctgtgagaggcgggatttgggaagaggcccaactccaaggcttattcgcttcccaccaacaccataacatgcacccacacctgcagcacggcagccagggcaagccttcacgctcccatacataggccaccaatattttaataccaatcaggactaggcaagcaaacagttaaggcttttttttttttttttttttttttttttttgagacagagtcttgctctgtcgcccaggctggagtgcagtggcgccatcttggctccccgggttcatgccattctcctgcctcagcctcccgagtagctgggactacaggcgcacgccaccacacccggctaattttttgtgtatttttagtagagacagggtttcaccgtgttagcctggatggtctcgatctcctgaccttgtgatccacccgcctcggcctgggattacaggcgggagccaccgcacccagcccgttaaggcatttattaaagtgacttcagaactatagagtcaggcaataaaatccaaaactgaataatataacaaatgaatatctgattaatgtataggttagaaaatgtttctttttcatgtccttacaatttgacagaaaagtaatcttcaaatatttgcagatgagtaaaggtatacggctttttttcttaaacctacagaaaaatactaaacacctactgaacgtaggacaacatatgaaaaaatgttaagaacaggttcctagaacaattagaaaggtcagacaggaacattaagtacgtcgatttgaagacatcctagaagcagcaagggagtgaggtcttcctaaagtctaagacccacgagaggaggaaagaggcccagagaacctaagcacgcagggatgagactgagaagcaaaacggagcttctgagagactcccagggccctcatacaggagaaagaggcctggcagatcccatgctctgagctggaacctcaaagggccacacaccagaaatacaggtgagttagaagtagaccagccttcacggaaaaccagcccagtttcgcattctctcaatttccaaagggactgcagtgacctgagattgcctagaacatcctctctggaggaagatattgttacctagagcctcgatttattgctacaatattgcatatacaatatctgaaagtcaagcaaatataataatgacaaagatacaagaccacatcattgaaaaatgaaaaaaaaatagaagtcattagaacagaccgagtagatcctgaaaacagaaacataaagacttctgtcatgaaagaagagcctgaggaatgaactgaagtgttgacactctgctcagcagatgtcagctcggggcaatggggtgagggaagtgggaaagcgagacaaggagatcaatgaagtaacgatatgcagtatatgacttcacagtcagctaagtgtgattttagcctactctgcctatgtaggagccattcttatttcctttaatttcctaaaaaaagaaaaatatatattaaaaaagagtgattttatatttttcaatggttgccacataatcaaaagaatcatatgtcagccaagcacggtggctcacacctgtcatctcagactttgggaggccaaggcaggcggatcacgaggtaaggagttcacgaccagcctggccaacatgatgaaaccccatctctactaaaaatacaaaaaaaaaaattagtgaggcatgatggtacacgcctgtaatcccagctactccagagtctgaggcagaacaattgcttaaacccaggaggtggaggttgcagtgagccaagatcgcgccactgcactccagcctgggcaacagagcaagactccctctcagaaaaaaaaaaaaaaaaaaaaaatcatatgtcaacaaatgaaaattatatgacattcaaattctggtatccacaaagttttcctggaatatagccatacacatgtttggcagcttctcgcaggacaatggccaaggtgagctgttctaaaagagcacgtacggcccacataaacatttactatctggtgctttacagaaaaaatgtgctgacccctatgttagtgccacctcttctcaatgagctgcaaatacaaccaactgttcagccagcacattcactaggcatatgtggcttttccagaaggtttgcaagaagaaactacaccataaaatagtccaaagaggaaagaaaaaagggaggaataaaaacactgagttccctcatctctccttgtaaagtggtgaacgttcataccacaaggaattcacacccacacacactcgccacaccttccaggctgtgtcactggctccttggtaggcagtcaggaagccatattccaactctcttgcgtgacatcacagcggagactggagctgaagggcggctcacaggcatgagtcagccaagagggacagagagaggcggctaaggaatctatggggtcggacaaggtttataaacacacttttaaaataactacctttaatagagtcaagcaattaaaagatcctattaacagccgggcacggttcatgcttgtaatcccagcactttgggaggccaaggcaggcggatcacgaggtcacgagttcaagaccagcctggccaatctggtgaaaccccgtctctattaaaaatacaaaaattagccaggtgtggtggcgggcacctgcagtcccagctacttgggaggctgaggcaggagaatcacttgaacccaggagatgcaggttgcagtgagccgagattgtgccactgcactacagcctgagcgacagagcgagactccttgtcaaaaaaaaaaaaaaaaaaaaaagatcacattaacaatttcaacacagaagttgaaactagaaaaaagtacctaaagtggcagttaaagaaactgtcaaacatttcaaactaaacattttaaagggatgtgtttaatataattatacctcaataaagttgatatgtttaaaaaatggaaattctggaatagaaaaatataatagtaaaatttaaaactcaatggatttgattaaaaacagattgggaaggcctgtgcttcctccacctataaaggatgaattctgtagaaatcacttccttgctataatcaactagaaaaccagacagaatataccgaaaagctgttaccaaaaactggacaacagacagcccagagctgggatccctgagagaagggaaacactgcccagaagcagcttccaggctgcagcacaggaaaggggaacccaaatagagcccaaagaacttgctgagctcaggagacagatcagctatacgtaggccaaatgacaagaatacagcaagctccagagatgagtggaggggccccttgagtatctgtctgagtactactctgagcataggttaagaaaactatggaatactggggaaagcagcactagaaagtaataaggagcattgccatgatgcacagtctgggaaaagcctgtgtttccacaaacaaggacagaaagatcttctcatacaccaagcatcaggtggagtcctgagaacagtattgccttcgttgtatggataaatgagcccaagagtaaagcctgtgtggatcagcctaacaaacctcagaatcaagctttgaaaagatcaaactgaccccatgtaacttacatgtatggcagaagaaaactaaggctctttaaaaaaataaaatcctgcacagaagataaaattaatgcctagcattcaatcaaaaattagcaggcatacaaccatgcccccataactagggcaatcaatcaatagaaatgacagaatcaatcaacagagatggatctagaagtgatcagagattacagaattcacagacaaggacattaaaagctctcttacagaaatgctccctatactaatagaaggaaagcatgaatgttataaggagtgaaacagaagatataaaaaggactcaaatggaatctctagaaatgaaaatacaaaatggatggatgagattaacagaactgcataacagttacaaccataatctacaatgtctaagcacatggctatgccatgctctctcccttaacactcatgcagtctaggtttaaaaaataactgtttcatgcccatcatcagttgcaggttgatctacagtcatccagttgtctaaagatctttctccactccattcctaaggaagggctcatgagaacaatacttcctaagttacagctcactgagaagtttgtgtgtttttcatctgaaaagtcggttttgctggaacaaaaaatgctttactcacattttcttttcttgagtgccttaaacaggatactcaatttcttcttcataaagaattgtcatctgctgggctcagtggctcactgctgtaatcccaccactctgggaggccaaggcaggtggactgcctgagctcaggagttcaagaccagcctgggcaacatggtgaaaccccatctctactaaaaatataaaaaattatctgggtgtggtggtgcacacttggaattccagccacttaggaggctgaggcacgagaatggcttgaacctgggaggtggaggttgcagtgagctgagatagtgccactgtactccaacctgggcaacagagtgagactctgtctcaaaaaaaaaaaaaaaaaaaaggaattgtcatcaaagtcctacggctaaacccttttccttttttttataacaagtattgctagtcttttccaagaaccaaagttaaaagttagttctttaaaacaccaggccaggcacagtggctcacacatctaatcacagcactttgggaggccaaggcaggaggatcacttgaatgcagaagttctagaccagcctggacaacaaagcaagaccctgcctctacaaaaaacttttttttttgctgcaaaatgctcttaattaacctgacaaaatgccacatacagggttactgcatcttttttatcatggaattttgaaaacaaaaattgttctcttgaggcagcagtatttggatattagaggtaaaaaccacccttagaatccagtcctaaaaacatcaatgaatattcctatatttacaaattcttctatttctacatgtcatctatcaacaggattatgaacctgaaagcctgagaatagaatttatcaagatactcatgtttgtactttttttatctactgcccttttttattttttttgagacagattctcgctctctcaccaggctgtagtgcagtggcgcgatctcagctcactacaacctccgccacctgggttcaagcgattctcctgcctcagcctcctaagtagctgggactacaggcacgtgccaccacacccagctaatttttgtatttttagtagagatggggtttcaccatgttggccaggatgacctcgatctcctgacctcagcctcccaaactgttaggattacaggctaagccaccacacccggccatctactgatatttctaagcatgaagtgacatttttttttttttgagaaggagtcttgctgtgttggccaggctggagtgcaatggcatgatctcggctcactgcaacctccaccttctgggttcaagcagttctcctgcctcaacctcccaagtagctgggattacaagcgcacaccaccacacctggctcatttgtatttttagtagagacagggtttcaccatgggggccaggttggttttgaactcctgacctcaagtgatccgccctcctcggcctcccaaagtgctgtgattacaggcgtgagccaccgcgcccagccgaagtgacaatatttatatacaataagtttaactgtaaaagcttacatttatgcgtggtcatttttaattgatgattagatgaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagatcagtggttggcaggagttagagatggtggcagaagagaggcaggagagagatctttctggtgatgaaacagttctgcataggaaattgtagtagtagttatatttacagacacttgatagaatggcacagaactacgcacacacattgtaccaacttcaatttctgggtttttatactctattatggttacataaaatgtaaccactggggcagtatgcgcaaatatacaatgacctctctagtttctttacaacttcctgagagtctattattatttcaaaataaaaagtttttttaaaaattgcttcatgcatatctagtttcatgtgccacttaaaaaagaacccaaaaatagaaactgtaggaaattcatctgagtgcagcttatgcaagaaggggcaggataactccattctggacctatgctcaaagacatgcacctttaccttacaacaaaactggcgaacaggcatgtgttttaagaataaaaagcttttaaggtctcatatattggtttttatgattcctttgcttaactgactttttggtttgctaaaaaactaccaatcacatcagattagaagtactttcacggtaaaaataaaaagtgatgtgactgacacctcttacctctgtaatgtattactcttcacgagagcagtgaaggaaaacatggtgattcaatcactccacacatcaagcagaaaagagtgttgaacaggccgggcgcggtggctcacgcctgtaatcccagcactttgggaggccgaggcgggtggatcacttgaggtcaggagttcaaaaccagcctggcccacatggtggaaccctgtctctactaaaagtacacaaaattagccaggcgtggtggtggacacctgtagtcccagctactcgggaggctgaggcaggagaatggcatgaacccaggaggcttgcagtgagccaagatggcaccactgcactccagcctgggagacagagtgagactccgtctcaaaaaaaaaaaaaaaaagtgttgaacaattaaactgtttatatgtaataaccagatatatatgcctggcataaaatgagccctgcattagaggttgctggatgtagggtcctaggcctgacgtatccaaataatgtctatgataaagaagtcaataagtgctctctataacacacaagcattataagttttcacactccaaaaactcttcctttctaaagttactaaaacttttaagggcatttcaaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaaacttagcaatcacttttttcatgctacttagacctgtaacacatttttcctctggtgcacactatccaaaacctagtcatttcccttactcctaggaggaatttagatgacttttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggtaggagaatcacttgcattcgggaggcggaagttgcagtgagccaagattgcgccactgcacgccagcctgggcgacagagcaagactgcgtctcaaaaaaaaaaaaaaaaaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaaaacttcattacgtaaagtcctttactccaaaaagtttctcaaaatacataaacactaatataaaaacaactattaaaactttgcctgaatctcaggatttcagaaatatgaaagtactcatctctcacgtctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagctttttttttttttttttgaaaaaaaagctctcattgtccaggctggagtgcaacggcacaatcttgacccactgcaacctccacctcccgggttcaagcgattctcctgcctcagcctcccgagtggctgggattacaggcatacaccaccacgcctggctcattttgtatttttagtagagacggggtttcaccatgttggtcaggctggtctccaactcctgacctcagggcatccacccgcctcggcctcccaaactgccgggattacaggcgtgagccactgcgcccagccacacaacacagctctaaacactggactctcatatctaccaacactcaatacctgtttaaaaagaaaaaaaaaattaggaaggggcaataacacttcagtgtaagtatccatgatcaactactgcttaacagcctacacgacttttgatgaacagtcaaggcacattacttaatacttaaaatggttaaccttagggagtaggaaaatacagacacacacaaaatatttcaaacacttctttttgctgctgataaggagttccaaaagtagtttttccaagccatttccaaataaaagtagattgggtgtaaagaactgtctatcgaaatattaccgttattatttatttaataatgtcctgacaagcttgcaattatctcattaaatcaaaaaattaggatctaaggccaacattgtttcctcatattcttgatgtgaaaatctgagcactcctcttaataaggagttacaaagacaaaacaaacagctcaactgaactaactcttgtctctccagaaacacaaacacaagacctcataaaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttctctattaatagatctcaagtttcgtgcacttgcaagaaactaattaaaaggcagccgcgcacgatctacaaaaacagccataagactgttacattttaagttacaggaaataaacctgctcctctaattcagcaagatacaactgacttccccttacataccctaaaaaaaagccttacacgggaaatttaaacatggaagcagaaacacaccaagaaaaagacatgtcaaaccccacctgtatatctgttttcaaccatttggagtcgaggcgagcctgggcagccaaacacaaagattcagagggcatcttttctccagcttcctcccaggtctcaggcctgcaagtaaacacatacgctgaagacctaatgctttttaatagtttacaaagacactcccgaaaggttcaatgcagaaaagaaaaaagagagagagaacagaaaggggggagagaagagctggtggaggggagagaaggggagagagggaaagagggaagagatggagagagagggaggtggggaagggaaagcctccttccaaggtaggcagggtgtgccgagtttctgcaccacgctgacgagaccttgagaatggacggtcacaggaagccaagttacaatgtcatccccctgccctcaaatccaagaagtacacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgccccgccccgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagtcaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgaaatggagtttcgctcgttgcccaggctggagtgcaatcatgtgatcttggctcactgcaacctccgcctcccgggttcaagtgattgtcgtgcctcaggctcccgagtagctggcattacatgtgcctgccatcacgcccagctaatttttgtattttgatacagacggggtttcaccatgttggccagggtggtctccaactactgacctcaggtgatccacctgccttggcctcccaaaatgctgggactacagacatgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggaggatgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtagctgggatttcagtcatgcaacaccatgcccggctaattttgtacttttagtagggatggggtttctccatgttggtcaggctggtctcgaactcctgacctcaagggatctgcccgcctcggcctcccaaagtgctgggattacaggcgtgagccaccacacccagcctttattttttttctttttttttagacacagtctgactccgttgcccaggctggagtgcagtagcacgatcttggttcactgtaacttctgcctcccaggttcaagcgattctcctgcctcagcctcccaagtagctgggattacaggcatgcaccaccacatctgactaatttttgtatttttagtagagatggggtttcaccatgttggccaggctggtctcaaactcctcacctcaagtaatccgtccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggtgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatgctttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagggagccaagatagcaccactgcactccagcctgggcaataagagtcagactctgtctaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctccccaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacgtgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctacgttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcgagagggtcacttgagcccaggagtcagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacaatttactactctctttcttttttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcaccagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggccgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaattttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattactgatttagacctatcttttttgtaatatataatgatttgatgctataaattttcctctaagcagtgctttaattaaccccacaaattttggtgcattttcatttatgttcaaaatattttctaatttcttttgagaattgttctttgacccatggatgatgatgatgatgattattattattattatttttcttcaatacggagtttcactcttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgagcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaaaaaaataaaatttaaaaaaagtatatgtaaagtgtatgtatggccgggcacggtggctcacgcctgtaatcccagcactttgggaggccaaggcaggtggatcacgaggtcaggaaatcaagaccatcctggctgacatggtgaaaccccatctctactaaaaataaaaattaaaaaaataataataattagccaggcgtggtggtgagcacctgtagtcccagctactcaggaggctgaggtaggagaatggcgtgaacccaggaggcagagcttgcagtgggctgagatcccgccactgcactctagcctgggcgacagagcgagactctgtctcaaaaaaaaaaaaaaagtatatgtattttgctgttgttgggtgaagtgttctataaattagatccagtttattgaaggtgttctacagttctcctagatttttgccgattacttgttctctcactatgaaagatattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccacggactggcccccgccccaggagaaagagtgcgtggctgtggcaacgctgaatcttccccgacttcaggtattcgtgatttcccttcctcttgctccttttataagtgtcttagcgatttgtaagaaggtttatgtattttgaaggacataggttttagcctgctgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgagggttctgtaggtttcacagactccaggtgagtttcggtggtcatttcctgacctgtgatatctatacctagatgagtggtgtgcttttgatttcacttctacttacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccgcagtctaatttttagcagctcttttttttttttagacagggtgtcactttgtcacccaggctggaatgcagtggtacagtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttccacgtcggcctcccaaagtgctgggattacaggcatgagccaccgcctgtggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagttttttttagtccagtttttaaaaatacgtgaactgagaagttattttgtctatttagataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttctttttttttttttttttttgagacagggtcttgctctgtcacccaggctgtatacagtgacctgatgttggctcactgcagccttgtactcctaggttcaaatgatcctcccacctcagcctcctgtgttgcagggactacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttttgtgtgtgagaattctagctccttcttgtccttacagagcagctggatgctgtgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacagatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttatcaattacaggatacaaaaaaagaagcacggaaggaaaaagaaatttatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggcccgagtgcagtggtgcgatcttgactcactgcaacctccgcctcccaggttcaagtaattcctctgcctcagcctctcgagcagctgggattacaggtatgcgccaccatgccccactaattttgtagttttattagagacagggtttcttcatgttggtcaggccggtcttgaactcccgacctcaggtggtccatccactttggcctatcaaaatgttgggattacaggcattagccaccacgcctggcctatttatttacttattaatggtgtttttttttttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcacaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactgattgtatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggctgtggcgtggggtgggcctgtggcgtggggtgggcctgcggcgtggggtgggcccgcggcatggggtgggcctgctgtccacagccagaaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcatggggctgttggtctttggcagggggtgagtgcagggttcctgttgtgggtcctttgttctcacaagggcagtgcccgttttccctgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgtgttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattattacaattaattttatgtgttgttgtttttcttgttggtgtttttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctaatttttgtatttttagtagagatggggtttcaccatgttggccaggatggtcttgaactcccaacctcaggtaatctgcccacctcagcctcccaaagtgttgggattacaggcgtgagccaccgcacctggccatgtttattaatacaactaagaacattttgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcataagcatggatcatgtgtccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaacgtatttcagagtagatcgttatttacatgctggcgaggagccacagaataccatttacatttgaaaatagagtgctgcgaagtttttataagtagtgaatcccatcagaattacacattttgattatggctctaaattttatattaaataaactaaaaatttcattgtattgtattaccgtctcttgctccttcaggtgtagcatacatgttagattctagacctgtttcttgtgttacagtggtgttatccaggcagggtatcatgtagtgaaggtgatgtctagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagccacgggggcaagtgggattgacaagcctgctgtcacattaggaacctgagttaaagtggagctgaaagcatgtcctcgctcttgatgttgtgcagagagccacctgtgctcctggctcaacggggcgtgtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacaccgaagctcccagcttctagctaggagtcatttggtccctctttatcccaaaggacttgccaccatctttggttcccaaagcccaggagggtccaggctcttcagcctccaaccactttgcatttcttgtctgcttttcattcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctccaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatgccagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccatgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggtctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgtttttatggcaccaccgcctctggtcacccaccctgaggtgtggcgggcctggacagccagcttgactgagggccaggctggtgaagtcaaaactaccactcaggaagaagacctagcccttctccagacagagttcaaatgtgaggactgccttctttgggcctcaaattccccacatgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacacactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagaatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacaggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcatctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggtggctgctccccacagccaggagtccggcccagcacccacctgagtccgcctcagtcctgctcaattgggttatccatgctcttggccctctggtcccacccacagagggaggtctttggggcgaccaggtgagctggcccttgtgggaggatgtaactgactcctgagcctggcgagccaggcagcccctcgccaacatccccacccctacctctccagcccccccgcattccctgatcctcccatctgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtctctgcacctcacctttactcccagacatgggagggagatgacatgaagacccaaacgccacttagcaggagatctggggtatgcagaggggcagaacggaggctctggaagctccaggggctccctgcaggaggccacatgtaagctggctattgaatgtggctctgagctgagacctctccttgaagctccagaccaggggccagctgctagctggacccctccatttggtgcctcagagaaactttgcactctctaggtctaactttgaacccagaaaattcccccatgtcggccctgtctcttcatagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagatcagtctgccactgtatggcacatggatggcaggggcagagtgcaggtggagagaatagaaggtgggcagggcgggggaggcagggacatggctgtagccgtggagatgggaggacagacaggacttggtggctacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccagtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcttcctcatcctcccagccccaccctactctctcccccagcttgctcaacaggtgaccttataggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaatgagcggctccctctcccaggaggaagcacaggtgaaggatgtggagggcagtagagttgtgtgtgctccgccccctttctccgcagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaacagaaattatacctccaattaaaaacatgttttaaaagacagatgggccagatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaaaaacaacaaaaaaaggacagatgaaggttttcaactttcagtaaaggcagaggagcttgttacggattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcaccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagagacccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccacatcgtctcctcctgttcttgcatcttctcttcctgctcacacatcttctcctcctgctcccccatcttctcttcctgttcctgcgtcatctcctcctgctctcgtatcttctcctcctgctcccgtatcttctcctcctgctcctgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgcctccacatcttctcctcctgctcccgtatcttctcctcctgctcccgtatcttctcctcctgcctccacaccttctcctcctgcttccgtatcttctcctcctgctcgtgcatcttctccttttgcctccatatctcctcctgctcgtgaatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggcgcggtggctcacgcctgtaatcccagcactttgggaggccgaggtgggcggatcacgaggtcaggagatcgagaccatcctggttaacacagtgaaaccccgtctctactaaaaatacaaaaaattagctgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagtttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaatgttaagtcaggatagagcaggcacagcagtagctggacgaccaggaacaactgctacagtgactactccacagtaacacttcctcactctcaatcacacctgacgtgttctcaagacatttccaagcccatggtctcatttgtttttctttctttctttctttcttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtgaatgtggaagggacagggaaagagattgaatttagagctggctaacaggggcccagagcgatcagataatattgttattgctattactgttagtactaccactgttcgaacctttcttgagtgcttcaccaggcactatgctaacaatcccatttaatcctcacaacctccataggagatggttaccattattacctctattgtgtagatgaaaaacatgcggtattaaaggttaagtgctgcctaagatcacttggagctgggatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggtctctgagctctatgtccagtgctcgctccccacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacacgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttgatggcttgccttctgttcctatagaaagaggaaaacagagctcttgctaggtggaggcagagatggcacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagatagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaataccactcgtattttacggatgtgaaaagagaggcccaaagagctcaagcaatttgcgctaaatcatatccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttacagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaagtctctctggagagtagaagcctgggagaaaaccaaaccaaacccattctcccattgccacccagagacactgtcaacgtgttgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactgaggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatgaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagtttttttaaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaacgtgactctgtctctaaatacacacacacacacacacacgcacagacacacacacacacacacgcacagacacacacacacacacacacacacacacacacacacacggctttccatttaataagcactcaaagttctttacaaggttaaagcaaatacaggacccttctaaagtaagactaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactatgcttttttctagagttctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcgatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggctgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggttgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaaatgacaaattacttactgggagaagatctttgtaaactcaatgacagattaaaggtttgtatccttagcctataaagaaatctttaaaattactcagaaaaaaaaatgaatgatttgcaacagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaaggcggaacctggagctctgtccctgttggtgggagcgtaaactcaaccaattttcctataggatgatttgaacatttgttttaaaaatcctaaaactgttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccaggatatatttctcccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatcttatttatttatttatttatttatttatttatgttgagatggagtctcactctgttgcccaggctggaatgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcaaactcctgacctcaagtgatccgtctgccttggcctcccaaagtgctgggattacaggcatgagccactgtgcctggcctgtcatattatttctaaacatttgagtgacatttcaattaagtgaaatttaattcttactgacctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttccccgcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattggtgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaaccagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccacccagctggactgcagtggcgtgatctaggctcactgcaagctccacctcccaggttcatggcattctcctgcctcagcctcccgagtagctgggactacaggcacctgccaccacgcctggctaattttttgtatgtttagtagagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagcctgctcatcatcaaaactttctatcacaagtttttgtaaagggctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaacatataagctgatgagccacaatgatatataaaacctgtcaaccaagtatttgtgaatcagctgtatagattgctggcaggaaaagcattacaaatctatttgcttggagatatatagagaattagccttaaattttctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacagtgaatttgtgatgctgagaggaccaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtcttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctcttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttatttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcacccgctagcacacccatctaatttttttttttttttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacatggtgaaaaccggtctctctctctctctcttttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccctgcccagctcttttttttttttttttttttttctggtagagacaggtctctccatgttggtcaggctggtctcaaactcccgatctcaggtgatccgcccgccacggcctcccggggtgctgggactgcaggcgtgagccaccgctcccggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattatttttttttttgaggcggagtttccctcttgttgcccaggctggagtgcagtggctgggtctccgctcgcggcaaattctgcatcccgggttttggtggttctcctgcctcagcctcctgagtagctgggattacaggcgcctgccgccacacccggctaattttttttttttgtatttttagtagagacgggttttcatcatgttggccaggctggtctcaaattcctgacctccggtgatccacccacctccgcctccccaagtgctgggatgacaggcgtgatcggcctggcgtggtggttcacgcttttgattccaggactttggactggccaagcgtgggggattgcttgagcctaggagttccagaccggcctgggcaacatggttaaacccagtctttttttaaattcctttattattattattgtttttttttttttgagacggagtctctctgtcgcccaggctggagtgcagtggcgctatctcggctcactgcagcctctgcctcccagggtcaagggattctcctgcctcagcctcctgagtagctgggattacaggcgcccaccaccacacccggctaatttttttttattttttagtagatcgtggtaactgccttaaaatgatgattgttcagaaagtcagtttaatttagatactaaggatattgaggttatgtaacatttgagcaagttctaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaagtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaaacacacaaaaaaacacaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacctaatgtacagaaaaaacatatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttattaagcatacaaagcttctatggggtaaagcagtcaaagggatatgcaaatttacacagaaatccaaccgatataaatccttgaaagatactacatacagatatttcatcagttctcacatgccaaacccagcaaagccaaactttggagcctcccctgtgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagaggtttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatctaataaaccatagttcagaaaataatttctgaattaagaaaatatgaataataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatagatgtaaaatgtaaatgtaaaatatgtaaatatatgtatatgtgtaaatatatatgtgtaaatatatatgtatatgtgtaaatatatatgtgtaaatatatatgtatatgtgtaatatatatgtatatgtgtaaatatatatgtatatataacacagcatacagcatatgccaggtgtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaactttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgcgtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaactttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatgtaaaactaaaattgtcttctaagcagagatctacgtatcaataaaatgaagaaataaaatttccatactgtttgcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcgcgccactgcactccagcctgggcaaaggagccagactccgtggcaaaaaaaaaaaaaaaaaaaaagagattctattcacaataacaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgagggaccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgattttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagccttcagccttggtctcccaaagggctgagattacaggtgtcagccattgcacctggccaaaactgtaactatatatacacacacacataactacatatatatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcatgaatcccaatacagtacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaatttaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaataccaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagagtgggtggggacagtggttgcatgggcagctttcctcgtgagccaaaggtccctctggacacttgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgccagtcagccccaccccttcagcaagcagcccagtctctgccctcaccaatcaccccagggtgactgggcaggtgaatcctggggatccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggtgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacactgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacctctctctgaaatgaggcttgggttgtcctctttctgataaattcccagatttaacagaaaggctgccttctgccatgaggatacattgatataagagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggtaataccccagagtttggagtcagaagactgagtttcaaagttcgtctgtcgcctttttcttttcttctttttttttctagccatgatatcaatctctttgagtcattaaatgattgtgacaacaccttgtacagttgttggtgtcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgcttgacctcatcgggcctctcttttcacatctgtataatagaggtggtattgtttcacttccatttgtgaagtttaaatgagatctgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttctccttggggccctgaagaaaggggacaggggcccctggtgccaagggcgaatagggagctggggcacccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcgtgtttccagaggaagtagtgagtatcataggtctctgttagctctgagagtctgagatttaaaggcctcctagaatggaaacctcagggccaaaggctcctgtctgtccttttccgccctaaatctgctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtggacaaaagccaacaaagacccaaatcctctgtccttgggagcttgaggagagtttaccagttcgtgttcccactgggtctgagaactttgcctttaaaatccattcctggtccctgcctaccacttcctgctctggggaatagagttgagggggccaccctccatcaccttaatgtgactctccccacagaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctccgcctggttagatctctgtcttcctcttcctacaggaaaagaaagcaaacaacgagaaacagaaagctgaaagggggctagaggtgagtggacagtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctgggactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccgcgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagtgggggggcactctggggagagagcacaggacgtagagcttggaggccaagtgcctgccatgcctttacctggctgtggtcttggccaagtcctaagtggggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagacgctggagaggagcttgtccaaactcaaacaccagatgggtaagatggggctggcatgacctgacagcaggactggcatcagagggctgtgagggtggcttggagtgccccagcgaggtgggtggatgggaagggctttgaggcagagggaaagaggtctgtgccaggagacggcaagtcttgtcatctcaatgagcctcagtgtccccatcagcaaagagggcccgttgtcagccacccgcagtgctctttctctgaaagtggtttggaagactggctaccatctgggtgcgaggaatcattagcagtgaggccaagtttgaggagcctgagaggagctgtgcgccaagaggagggtttttcttttccgagaatccagaggcccttattatctgcttcctttctcagctgaacccttgcccccagagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctggtgcgttgccccagctggggagcctgccctcctccctagccctccaggcctttgtttccccacctataaaatgtggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccgggggcaggtgaccccagcaccctccagggcagtcctgtggctgtttcttgcttcctgccctctgattttagaggtgggtagccctgggctcctcccaggtctggacatcatcattccagctagagacatggagcacccccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaaggaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcgcatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggctgagatggcctgccaaaagttgcaggaggcccaggggagggagctgccgaggatggggccgtgagggggacgacctggcaaactctgtgccttctcactctttcctggccccttaggagcgcctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccaccccccacaggacacggaggagaacatctggacagtgagggggaggaggcacctcggcccatgccgagtgtcccacaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctgccgagatgtgaccccattattttggctccagagcggctttatggaccacctggaggagaaggcagacctgagtgagctggtggagaaagaagaacttggattcttccagtactacagagagagatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccacctccctctctccaaagatctttgtgaggtgagcctcactgacagcgtggagcctgtgcaaggagagaccagggagggttctccccacgacaagcctactgcacagccgatcgtgcaggaccaccaggagcacccaggcttgggcagcaactgctgtgtgccattcttttgctgggcttggccgccaagaagaaggagataaacatgaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggttattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtagttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgatactgtaatgtaataaattattaagttgttgcaaagtgctgtttttgccttaaaattttattctgtgtgtcttgaaaaatatagtattaaaggtattgatactgtgcaaatgctgagcatgcttggcatgagataatgtttcatttttacaaaattgtaatataactatgcaagggtttattaaaagaacacaaaataaaaaagttatgggattaacaaaagttatggggtgaaaaagttatgggataaaaaatgtaaaaaagttgtggcaaaaaaatcttgtgaccaaaaagtagaagaaagttttatgaaaagttaccaaaaaaagttatgaaaaagaagttatgggattaaaaaaaaaaggcatgggataaaaataaaaattaaaattaaaagcaggcccctgtcagcaaagcctggagaagtggggctggggtctctccaccaccacactgtccctatctccccttcccagtcacccctttacaattagggtagcaagacaagaccactgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctcgaatcttcttattcagagaggtagctgaggcaggacagtggggctaactgtggaccaggtgaaggcatgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagcctcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctccgcctcctggttcaagcaattcttatgcctcagcctcccgagtacctggggttataggcataagccactgcgcctggctaatttttggatttttagtagagacagagttttgccatgttggccagattggtcttgaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatacacacatacattgacatattcccccttccctgctgtcttgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacataggatcatatgaaagcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcctttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagacacttagcggtcacataataaattaaggttttctttttttaataatctccatctttctaaatatggtgagtcacagtcagctatttttggattgttgaaagctgtgactgttctaaatcggagcccagaaatcatgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacatgctggataatccttgcaaagacatacttgaacttccccaaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagttttttttttttggttgttttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggtgtttcaccacgttggccaggctggtcttgaactcctgacctcaggtgatccacctgcctcggtctcccaaagtgctgagactacaggcgtgagccaccacacctggccacagccagttttgtttcatttatattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggatcagtattttaagaggtatgttaactaaaatgtggcaatgtaaggagcaaagcaggaagaacctttaagtcctcaacttacaagtcaatttcctagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaacctacaactttttttttttttgtcaataatacatttcttttggaaaagtggcaccctcctgtgggggacacctgcagttccactaagcgaacatcggtgtctgctaacctttgcctctttgtctctcaataatatactgtcaagctgttccttgatttagcacttttgtatacttttttttttcctctcccgtttcctgagacacagtccctctctgttgctctgtctggactgcagcagcgccatcatggctcactgccacctccacccccgggctcaagcaatcctcctaggtcagccttgggagcagctgggactacctgtggggcggctaatctttgtggtttttgttttgtttttccgttatgggaccgggtttcgggccaggcgcagtgactcacgcctgcaatcccagcaccccgggaggccgaggccggcggattacctgagggaggagctccagaccaccccgaccaacatggagaaaccctgtctctaccaaaaaaaataaaaactaaacaactaatggggtatggtggcacatgcctgcaatcccagccactcaggaggcaccatttattaatctttttgacatcagatgctcagtggctcacacctgtaatcccagcactttgggaggccaaggcaggtgaatcgcttgagccgaggagttcaagaccagcctggccaacgaggtgaaaccacgtctctgttgaaaatacaaaaattagccgggcatggtggcacacacctgtaatcccagctactcaggaggctgagacaggagaatcgcttgaacccaggaggtggaggttgcagtgagccgagatcacagcattccactccagcctggacaacagagtgagactctgtctcaaaattaaaaaaaaaaaaaaaaattaaccagccatggtaccacacacctgtagtcccagctactctggggctggtgggggaggactatttgagcccaggaggtcgaggctttagtgagtttgatcatgccactacactctagcctgggcggcagagtgagttcttgtctcaaaacaaaacaaaaatagtttccagccaggcgcggtggttcacgcctgaaatctcaacactttgggagtccaaggtggcgcatcatctgaggtcaggagttccagaccagcctggccaacgtggtgaaaccccatctctactaaaaatacaaaaattagctgggcatggtggctcatgcctgtaatcccagctactcaggaggctgagacaggagaaccgcttgaacccaggaggcggaggttgcagtgagccaagatcgcaccattgcattgcagcctggggcaacacagtgagactctgtctcaaaaaagaaaaaaaaaaagctaggcgtgagaagtgccttgattttgtattttcaatctgccaatacttgcacaggctctggctgcaaaacttttgccggtcaaacattcgcatttgagaaaccacgtccctgctgagagagagatctagacacagccttaactacatcatcagtagacacatgactggtttttttttgtttgtttgtttgtttgtttgtttgttttgagacggagtctcgctctatcgcccaggctggagtgcagtggcgtgatctcagctcactgcaacctccacctcctggattcacaccattctcctgcctcagcctcccgagtagctgggactacaggcgcccgccaccacggccggctaattttttgtattttttagcagagacggagtttcaccgtattagccaggatggtctggatctcctgacctcgtgatccgcctgcctcggcctcccagagtgctgggattacaggcgtgagccaccgcgcccagcgacatatgactgtttttaaccagagggaggaaaatggctttcagatggttgtgtagctggttttaacagccttcagcagcaacactggcagcctccgacctctcagaccgagtaagccaagcgaagcctgtatgcgcacgcttgcagctcagcgcccgcggggactccggaagcctctcccaagtggcgcggtccgcaaggggcggctacagcttgggcgcaggcgccgctggctcaccggttctcttgggctcccctgggacgccgtaggatcgcaggcgcgcagccctcccggccgctctggccgccctgctcctcctttgaagaaagatagggccgctggcaggggccctccgcagccaccggggatggggctgaggccagtttttgtttttagtgcagccgccgccaggccgaccgccgggcttggctgcagccacggcgacactggcccgagttctgcgaggctgggggtgctggcgggcttggaggttgcctggcagctgctgcctgcaaaaagaaaaacaaacaaaaaagcagctgcagcttgggcgcccagggctagcggggcatggcctgggcagtcttgggattgcgagcgcgcgcggcctgagagtccgtacccttcgccgtgcctcctgccctcctcctctgccggacctcagaactgctggccaggccgtccgagggagtccggaccccactccgcagcctacagagatggggttgagcggcaggttctcagttctcgcccctctgcagccgccgccgggcagaccgcctggcttggccgcagccacggtgacatttggccctggttctgcgatgctgggagcgcgagcgagcttgggagttgccaggcagctactgcttgcaggcggagggcggctacagcttgggtgtccaggcagtggaacatggcctgggcggcctctggatcgcgagtacaccgagcctgagagcccgccaggccctgcccccgcctctgccagagctcaggaccgctggccaggggccctccgcagccaccggggatgggattaagtggcaggttctcggccctgtgtagccgccatcgggcagaccatctggcttggctctagccaccgggacatctgtccccggttctgagatgttacgagtgcaggcgggcttagaggttccccagaggctgctgcctgcacacagagggtggctgcagcttgggtgcccaggcgggctggaggggcctggcccgggaggcctgcggatcgccagggcgcccaggctgagaagccccaagccgcgcatcccgcccggctcttccaccacagggagacaggagctgctggcatggggactccgcagtcacctgtgatggctttgagcggcaggttctcagttctcactcctgtgcagccgccgggacatctgaccccggttctgcgacgctggcagcgcgaccgggctcgggagttgacaggcggctgctacctgcacacacagggcagagggcagctgcaccttggcctgggcagcctccgaaatgcgtgcgtgccaggcctgagggccccccggtggtgccacccgccccgctcctcctctgtcggagcctggagcagctggaatggccactctgcagtcactagggttatggttaagtattcttatcccatgcatgcacacaaaaaaggtaactattatgcgaggtaattaatatgttaattgacttcattttggtaatcatttcaaaatgcgcatgtagatagaaacatcacattgtaaactttgaatatgtacaatatttatttctcaaatatacctcagtaaagctgaaaaaaaatgaacaggattgaaaggataagcacacagttctataatagtagttggacacttcaatacctcattttaattaatggatagaaaaaccagacagaagcttcatgagaaatagaagacttgaacaacagtataagccatttagagctaatacacatatacagaacagtccacccaaaaacagcagaatatacattccttttaagtggatatggaactttctctaggataggtcatatcttcgtccacaaaaatatgtcctaatcatttacaaaagttttaaatcatacaaaatataatttacaaccacaatggaggaaacataaataaaaaatgaaacctgaaaaattcacaaatatgtagaaattaaacaatacactcttaaactaccagtgaaagaataaatcataagtgaaattataaagtatcttaagacaaataaaaacaaaacataccaaaacttagtgactgcagtgaaagtagagtttgaaggaaaatgtatggacataaacaactacatttaaaaaaagctcaaatcagtaacctcactctacacctaaaaggcagtataaaaaccagagaaaactaaatctgaagctagcagaagtaaagaaataataaagattagagcataaatcaataaaatagaaggttggaaagcagtagaagaaataaacgtagctaaaagttggttctttgaaaagagtaatctcacctcagtagcctaagattcttctttaggaacgtagagaaagaacaacaacttaaatctaaggaactaaagaaaggagctaataacaattagggcagaaataagtgaaattcaaaaccaaagagagaaaaagggaaagagaagagagactacagattactaacagcaggactgaaagacaagctatcaatacacactataccataaataagtaaagctaaaaataattttatgcacacaaatctaatagatgagatgaaaaaaataaattcctctagagacacaacacatactaccaagtctcactgaagaagaaacaggtaacaaatagtcctgtattaattaagaaattgcatttgtaaataaaacctaccaaaaaatctagtcacatgttctttcactactgatttctatcaaatatttgaaggataaataattttgactgtacacaatcttttagagaaaatagatgagatgggagcactcccaactcattttataaggccagcattacaataacaccaaaaccaaaaaatgatatggagagaaaagaagactatagacaaatatcagtcatggacatatatgaaaaaatatcaacaaaatattgtgacatcaaattgaacatctccccatgtaggatgattcattatgtccaataaaaacaaggctgattcactattaaaatccaatccaagtaatctgctatagaatatttttaaaatattcttctcaagagatgcaggaagagcattcgatgaaatccaacatctatttctgaccaaaactcataaaattaggaataaaagaacttaggatatatgtttatatctgtatactatatggtgatgactgaatgatttttccttaagactggggacaggtcctattcgatattgtattagaaaatttgcaaagtgcaataagacaggaataagaaataaataacatacatattgcaaaggaagaagtaaaactgcctctatttgctgataaaactaatctttatatacacagtctacagtatttatgaaaagcttctaaaacaaatacgtgaaattaagtgttttattatcaaaggtcaatatagaatgtcaataattttcctatgtgtgagtaattaacagttgaaaaaattaaattactatttaaaatagaagcaaaaattaagtgcttaggtattaatgtaacaatagaagtgcaggatctgtatgctgaaaactacaaaatataaatgcaataaatagaaaatttaaaaagaggggaatgaaatatttatgaattcagagtctcaatatagttaagatgccagtcttttccatttctgcttgtagagttccttcattaacaatgaaaattcctgtaagtttttttttttttgtagatatcaccaaggagattctaaaatttacatggaaaacaaaataactagaattgtcaaaacacttctgaaaaaaagttagaggacataaactactgattacaaggcttactattacgctacagttctcaaaatattgtggttttgttaaaatattgttaaaacactagatacgtagaccaatggaatgaatacagaccccagaaatagacccacacaaatatattcaactgcattttgaaaaagatgcagaggaaaaggggaaagtataatctattctgtaaatggggatgtaataatgggatctccccatgtaaaaaaaaaacgaaacttaatgcgtattttacaccttttacaaaagtggactgaaatagaccatataaaagtgtaaagtatacagcaataaaatactatcataaaacaggagaaattaggtatgactttggggtcattgatgagtttatagataaaacaccatacacatgatccataaaagaaaaaatgaaaaagcagactttgttatagctaaaaatgctcattctgtgaaagaagcattacaagagcaaaaagctaaaacaatcagggaaaaatattaagtcactgtattagtctgttctgctgctgctataaagaactgcttgaggctgggtaatttaccaggaaagaggtttaattgactcacagttccatgaggctggcaaagcctcaggaaacttacaatcatggcagaaggcaaacaaacatgttgttcttcacatggtggcaggagagagaagtgcttagcaaaggaagaaaagccctatataaaaccatcagattttatgagaactcactcactatctgagaacagcagcatgggggtaacctgcctccatgattctactaccttctgccaggtccctcccacaacacatagggattatgagaactacaattcaaaatgagatttgggtggggacacagtcagaccatatcagtcacgtatcttatacaagcttttatccaaaatgaataaagaacccttaaaactcaacaatacaaaacaaacaatccaatttaaaacaagcaaaaatcttgagcacgtacatctcaaaagaagacagacatatggcaaataagcatatgaaaacatgtttattgttattaataagggaatgcaaaacataactacaatgggatactactacatgccattagaatagaaataaaaaattaaaatatcaaatgctcctgaagatgtgtagcaacaaagattctctttcattactgttgggaatgtaaaatgacatggtcactttaggagataatttggcagctttttataaagtaaaacatatgtccagtgtgaggttcagccattccactcctatatatttatcaatgtgtaatgaaaacaaattcacataaaagcccgtagtctaggcaaatgttttagcagctttactcataatctccaaaacctggaaacaaccaagacatctttctttttttttttttttcttttttgagacggagtctcgcactgtcacccaggctggagtgcaatgtcacgatcttggctcactgcaacctccgcctcccaggttcaaggaattcttctgcctcagcttcccaagtagctgggaatacaggcacccaccaccatgcctggctaattttttgtatttttaatagagacagggtttcactatgttggccaggctggtctcgaactcctgacctcatgatctgcccgccttggcctcccaaagtgctgggattataggcatgagccaccgcacccagcctaaccaacacatcttacaacaggtgaacagatagactattgcatcaataccatcaactgctattcagcaatacaaaggaacagactattcacttacacaacagtacagatgaacttacatgtgttttgctgtgtgaaagaagtcagccccaaatgtctacatattgtatgatttcattcgtataacattccggagaaggcaaaattataggtcaagaaaacagatcagagtttgcccacaattgggagaaagggaagggttgatcacaaaggcatcacacacagaattttagggtgatgcggctgttctgtgcagtgctggagggtggacacgtgtctctatggtttctcaaaccctaccaaatgctacactacaaaacctctttcttattttttgcaaaataaaaataataataaaaaaatccaccaggaagtcagaggattccaagaggaaaaagaaactgatcaaagacactttggaaaatggtattttgattggatactctaaggttaagaccaaacaagctgcatagaaacactccactttggttggtaattttgtttatcacaggggcaaatgataattttgacaccaggctagaaaaaataagtaagtaagttgcagataatgtgagctagagtttttactgttatgaaatgactttttcttgtagtgttgagaatgtttctttttttttcccaatcatgtgttaattctccccaggattctcaccaacctattcaagtatattttaaaatacttatgattttaagacaaaaacacatgtgttttcagcccagttggagaagcctcattactatcacatcctttgtgttctaaatgaaagtctgcacataaaacaacaaaggagcatgggaagtgttggaaaaatataataaggaagacagactccctggggaatgacacagtggtatgttccttgggtctcctgttcttctcatctgccctggagagagtgctgcagaagcctccaaccagaaaccacacccaacaaaaccaaacctaataaaaccccagctgtctcagccaaagaacctggaaaataatggcctagcaaggaatacccacctgagtgtagccaaacatcaatggaaatccccctgcgaacaccatagttcagtgaaatcaagtgtggagctgatgatccacttcacttacacagagtggaaggaatcagcagtgctctgattcccttgccggatggtgtcagtggggccaagaagggagataaatcttctgtctcccacattgcaaaagaaggtggcattctggtatttccattttttttttttttttttttgagacggagtctcgctctgtcgcccagcctggagtgcagtggcgcgatctcagctcactgcaagttccacctcccgggttcacgccattctcctgcctcagtgtcccgagtatctgggaccacaggcgcccgccaccacacccggctaatgtttttgtatttttagtagagacggggtttcaccgtgttagccaggatggtctcgatctcctgacctcgtgatccacctgcctcagcctcccaaagtgctgggattacaggcctgagccactgcgcccggcctacagttatcttaaatataaattgtgtacatgtgtcaattaaaacacaaggaatatcaacctgaacacggaaacacgatacaaaaatacgtacgttacttatctcaattgatgcagaaagagcatttgccaaaatatagcacagttttatgataaaaactttcagaaacctagaaatacaaggaaacttcctgaactttatcaagagtatttatcaaaaacaaacagctatgtcatgcttaatgatgaaagaatgaatggttttcccctcagggtggaaacaaggcagagacacctgctctcaacaatgctatttgacagagcaccgaaagttctagtcggcacaattgggcaagaaacaaggcatactgattgaaaaaaaaagaaagaaggaaagtggcctctattgcagattacacgattgtctttgtaaagtctcagagaaactaaaaaaagtcttgtagaaataatatttagcaagttcacaggataaatgatccatcctccaaaattcatcatatttctatgaactaaaaatgaatgtgtggaaactgaatatacctttacaattgctctaaagaaaatacttaggcataaatctgacaagacatgcagaatcaagatggcaaaaattacaaaatgtgcatgaattgagagaagaactaaaattcaaacataccttattaatggtttggaagactcacgatagcaaatatgtcaactctcttcaaattgatgggtagacttaatgacagtcatatcaaaacaccagctacatatttttatgcatatagataaacctattttaagtttatatgaaaaggcacatgatactggtggagagatggacacataggtcagcagaacagaatgaagaactcagaaattgacacaagtaaatatgcccaactcatttctcatttttgacaatggtacaaaagtaattgaaagagaaagaatagtctttttaacaaatgttactggagaaaataaacacaggctcaaaatctcagtgtaaaccttgcactttatacactaattaactagaaatggtttgcaaacttaaatataaaaggttgtactataaaccttttaggaaaagagttctaaagaagttattgggatctagggctagataaaagtcctttgttcttatttacatgtatcttttaatttttttttattttcagtaaaagatcaatgtgtacgtgtacttattctaaaaaagaaaaaatgttcaatgtgctcttccaggttaatagacaaatcaaatagactcacctttctttatgaacccatagtgtatcagtgatccagccattattgttttcctgagaggaaaattctctttatgctcatcacacttttggagcattgaaccagagggcctaacgtgaggtgaacacgctgccagtggaggtgagcaggaaggaaatttccaaacccaagaactgacagaaactgctggagagagaaagttacttgggcaagtctagagaccaattgcgttgtgcccttctctgtagaataataaaaacggagtattcaagaaaaaaaataggacaagtgatactaaccaaatgatgttacaacacacccatgtctgtatgtgtatacagacctatgcacatatacacacatagatatgtgtaatatgtgtgtatttataactgaggttaaactgttaggcaataagaatgcagtcctatttttctaccctctcttttctaacatctttcaaacagatgatgttttgtaagattttcaattattttcaataattaaaaaaatttcaaacagaacaaatatgcatgctgaattatttctcaatcccctgttttacatgtggctttaagtacgtgacctgttatatagatatttcagcatcttagatgttaaagtaaacacatagctgctcctcatttttggaagggtgtatttacaatatatgtgtctgatgcaagttgtatatttaaattacttaaaaatacatcttctttggtaagagtttttaaaaataaatttgtggcacattagaatgtttttaagaaaaattgctttttaatttgtattatctaaacttcagaattttactctgaagtatttcaaaacttacaagaatattcatatttgatctataaaataagtaacttagatgggataatttgaatttggaaatttctttataccactaaatttgaagtatcaatgccacatttatttttacaaattttccttgaaacattatattggctactggaaagagctaataccctttacgaaaatatgattttagtgatgcaacttatatatgaggtagattaggaagctttacttcctgtgcccattaactaagaagattttatgaaacaatttttaacaggggccacagtcagtaccgggagtgtggtcaggtggtcaggcacgcctccctcctcattgggcccaccagaagatttcagggttctaggagaaacatacccaggcgtgcagagattgtcacaagggaggaagggccagggtggggaacccagcacagggggcctgccctcacaggggagtcggacaaggttttctgaggaagctgtgtccaagccgagatccttcccactccatgtgctccagcacaaggcctgcaggaggagccctgtgagcaaggccaacctagaccagccgggtggattcccttggcattgagggggagcatggcctgaggagctgagcgcggtctccgaaggacggcatcagaggaactctcaccgtttctatcatgaacacttacagtttgacatcagcatgggagttgtgattgggtgatcttgggaagggtctgtcagcgggtcggggggtcgctctaagttggacgctgtctgatagaggaggcttttctattgttcggcatctcatatctcaaggaatcttatctagaagagggcagagggccgccaggagaaagccgctgctggtaatgaggaagatgctgctcattttcaccaagtgcagtgctagggattttagcgggtggcaaagtgaccttgatatcttttctctgtgcaggtctctgttagagtcactgtgagtgtctctgtggggatctctgtgttggttttgaagggtctccgtgtgcgtctctgtcagaggtttctgtgggggggtccctctggggggtcttcatggggggtgtctcagtgttggggtctctggggggtcactgtggggaatctctgaaatctcaatgaatgtggggtctttgtgggaatctttgcgtgttggggtctaccgggggtccctgtggggttcctctgctgcaggtcacaggatcctgggtcccatagatgttgggcccacactggagctgcccaggtcaccaccccagacaggacttggctccaacagtagcctggacacccaaagtgacaccagggcgtgttcgaaacaggtccccggtgtgggtcccgccaggcctgggtacagacctgacaccttgtcctcagcctccgcagcccctgcaggtgcagagctctccctgggcagaaggcccctgggcagagccctctgaggaactggctcctgcctgccctgcccttgctcctgccttccctggggatggccaggaaggacccagtaccaggacgaagggagtgcaggactgggccctgtggggactgtccctgccaaccatgtgaccagattctctgagccccaatgtgtcccttgccagcacctgggcctggaaccatagatgtgctttgtaacccaggccagcccttgccttctgggtccccctcccctggcagtggcactgaccacttttgcttgtaatggtcaccagactgcaaggaccctggttacagctgtgggcagcttgtggatcctgcacttgcaaacttatgctcgtcttccctgattcttctcccacctctcaccctgggccccaaggtctcctcctgtgattcctgaccacagagtcctgccagaggggcaggcagcagccctaggtgcctcctgaaacagacaccccacactagtgggctgggagactgccctggagagtgaggcaggggacaccagacatgaacccaggggtgttatcaaggctgagccaagtgctggaggggcccaggtccatcccagatccggaactcagcagtcaggaaagggtctggggagggtgtcatctcttccccaccaggagatcccagaaagagcagtcccccctctgacccagggccagcacaagacaccccctacattcccaggctactgtgaggcagggaggctgctgggatccatcactcctccagcctgaggggagcctaccaccccccagtccgtgacgcccctgtagacccatcccctacagcagcacagaagtcgccttagaacagggaatgcagtgagccagagcccgggtgggatctccgtaaggtttgctgtccttacatatcctgaaggctctgggtcatgatccagtttggaaaccagacacagtgtggggacagggagaaaagggggtcctccaggtccctgtcagcttcctctaggcccagccattctggaagccgcactcaggaggagctgacactgagcccttgcctgcagcctagcatggaacagacagaagccaccacctctgcagggaaaacaggtatattgggaacttctccgtggaagtcaggaacacatggggactgttgtcacccacgcaggacaggtttgttgtgtaggcgtccagtgttatttggatagaaccccctgtctcctccaggagaggtgtgggaagcctggtctggttcaggaggcaagacacctctgtgtagacctcagttcctgcagctgtggatggggctgcccgaggtgcttgccactcatggcctgtggtggtggggaccagctggggacacaagctccctgggaggtgggggcccaactgctgtctctgtctctgatgcccttgtttttgacaggacatttgtggcccttgggggtggctttggggctgcagaccagccccatctctctgctatgttcctggtagtagtgactcctgtggcagcaggaaggcacattctcctgggcgtggaggtcgcctttgtggcgactgacctctgagggaccacgtccctgctgaatccccagtttgtccaccaggatttgccccataactctgatgatggtctgggcttcatcagccatgctgtccataaacaaccttgctgggccagacccccagctctggacagcatctgcccaggcttgcctttctgcaggacgtcttcctgccctgagcccctcttcctgggatgtagaccctgtggacggtgactgatctttctctggaagttgctttctggtggtgcctgtcccttctctggctgaggctgattgtatttcctttcttgtttgtctcctatttccctcgtgtgggcagggtggctcctcccactggcttgggaggtcctgggtcctttggacctgtgtccctgctcccctggtctgggcctcctgtgggccttgcccttgtccaaagagcccagcatcttctgactcttctgtggggccttcacttttgggctcccaggttcctgctgccccagtctgtcccctcccttccataggagggcacatggcccctgggaagctgtcgtgttcctcctactgagcacactctgggaggtggacagaggggcctaagtgggtggcctgtatgtggctgggagcatgtccacatggcggcctggaaggcacaggcctgtggcgtcctcctggaggaggatgctggaaacacggcctggcagctgctcctctgagtccacctgcactatgagcgcaatctcactgacaacctgtgctttcaggcacagctgccctggatcctgagcaacacagattgtagacactgaggggttactagtggtccccagagtccctgtgctcctcagatccacctgaacacttcctgatcttgccctcacactggctcccaaggtgactttccaatcagggggcttttcctccttggcctccagtgcctccagggcatctctggcccttgcccactgggaccccatgctgagctcttgcagggctctgctatgacaggggtctcctggggacatgctctcagtctcaagccatgcctcattcccagccatttctgaacccacactcccctcgagtctgggtttcccggaccccaggacagtccctctctgccaggttctgcctacaaggttgcatatgggggactgagaagatgccctgccctcctgtccagtcagagaggcctctgattgctcatgggtgtcagctgactgggaccctcttgggaccctctggacttcctcctgctcagttggtggggcagggacagggccactcatggtgggggctgacttgcttgttgttctattgtctcctggaccattctggggaggttttcccgacaaaatggcaaccttggctacagattcagccagagattcccaggaggcccaggggagaatggtggagtgtgggaggggtggaggctgagcctcccctgactagacatttatgggctctaaggactgaagttctggaccccacctgtgcctcacacagaacttgaaaagatgtgcttccagcatctgctgggtgcagggatggaggaaggacagctcctgggaggtgttcacgtgggctttcccacccctccaggatgtcacctttctcgatttcctgtgggtgtcagacttgggaatggcatgtttggccatgaattaggagcgatgcacagacacagggatccagccctccttgatctcccccaccttcctgtccagatggacctgtggcttgttttccagatgctgcttttctgggtccctgggtgcagaacttactgattggtacttccagggcctcctgaaatcaccttctgcttcctccttgtctttctccagaaccttcactgaagtccttcctgagccttgatcctggttctggctctagtttggaccctaagcaccccttcccagagaaccttccagagctcctgagccctgctttctgcaaatccttcgtgccctttcctacaaattcagaatcccgggagggcaagagggccccctgcgtggcttctgcctgactctggggcctccctgggaattcccccttaggctgcagcaggtctccaggtgccttgaatctgctgggaggccacgggactgctcctggcggatggcactccttccttgccaccggtgctctgggagctcagggctggtggcaatcccgggaaggatgggggctgacttagggttctgggaggctggcctctcctggggaaggtgggaagtgggctggctcaggacagcctgagactttttgaggagagagggcaaaaccctcttccactttggtcatttctgcaagggccactcaagatacttttttccagtggggatgacagactgtgccctcttctgggatgtagggcaagatgctccacagaccctaatctggggtggagaagaggttgggacaggggtggagatttgccccactgtgtctggatcccagctagaggcgggggctgggactggggccaggttggagtgaaaggttggggctgggccacgtggtggggctggggccgtgcctgggaaagctgtgagggtgtctcaacctcagtttcacctggaagggaagtggaggctttatccgatggtacagagtgctcattctgtgaggaaatgttcctagaaacccaggccatggtcaccagggactcgctattgaaagaggggagatcccagaagagatggctgcatttctgctctaagtggtcccacatggccatggcgtcagagacctgctgaggatggggcagcttctgtggtaggtttgccacgttccagaagggatttagagtcgtgatgtcccactccttccccagtgatgtcatctgcgggtagtctgcccacccccattctttctcctgccacatcttcatcactgctctcttggagatgagtctccagcagcttctgcacgttgggatggaagaatgtgcgtccacctgcctccatctgcctgggtgtggggtctccccagaaggaagcctctggggggtggttgggaagatgctgttgctgggatttgccctgtgagcaggtggagaggccccaggtggtggcagcctccctccagcgggagaggtcccggatgggaccgctggagcacccaaggccagagatcaccctggttggagaaggtggcccctggttgtgtagaggggagctctgggggacagggcatattgtggagccacactgaagtccagccaggctgtgttcgggtggaggtggagaggaggccacgggaacatggggctgtggtgaagaaggaaaagcatatgtggccggactgcagggcattttaggggaagcaagggctctggaggcctggaggcactcagggttgagcgtggtccaaaaggctctgagaaggtcattgtgtctggtgacaggttggaggccagaggaactgggggagtccttggggacaagctgtcaggagatggatcttgcatgcatttcctatgcggctggtgggccttagcaggagctggtttgtacatatcacccagggctctccacctaagggcagatgggagccaccctccccagtgagctttctcaggtggctgcacaaggcacaagctgcagccaggggcaggtggggttgggaggtcgggagggctgggcacctggtgcccacagctcctccacctcccccactgctggcttcacagagctctgtctgtgcctgcccagggcttcagtccactcccgcctcttcccaggacctcccctcccaggtcaacactggaccctggggctgcctcagaggccctggtagaaaggacgacatggagagaaggggaatctcatctttccagaaggttggtcaggtcctgagtctcctccagctccctcaggaggattctgcaagctggaagtaaggagacagagttatggtggggagggcggtgccagcgaacctcatgggaggctgagtggtggatgtctctttaggggacaccatggggaactagaccctgaagcccatgcatctgtgtccaaggccacatggccccaatggtgacagcaaggtgtgcattgtgcagaactttgtcatttgcaaaaagtgcttccatgtacaacccctcatgggtgtcacaaccatcttgtggggagagtggatggggtggtctctaagaagagtcagccatggccgaggagaacagctgtccacatggacctggggtctccctgacctccccccatatcctggcaggccttggtcccttccccacagcacccccttatgggcaataccggttcccgggcccatggcttcattcccacagggaatatgaggaggccccgggttctgatttccctcccaggagcttccctctcaggcctctgcaaatgattccctcagggacagacgatgctcagtcacctctggggagtctcagggattagtagggcctcacaattcagagctgggatcttctttctgctcctgggcctcccctctctcttcctttgatgctgagaggcaagcaagggtgaggggctgggaccagttctcagtctcctcttcccagaccagctgcacacacgcagtgctcttgaaggacacggctttctgcctgtagctcagggagctctgcgtgcgtttcttttactcatgtttaccattgatgaaatgttttctgttttccttcttagggaaatgcaagcaggggttttctgtgtgactccaccctggatatccccagtccctgctcctccgctgaaggcatacccaggctcaggcctacaggcacctctgagctgccagtaggattctgcttcagaggaggccagacgtgaatccaggctctagcgggaggctctcaggggttcagcacagctcccagatcaccccacacagaggagcctggacccccaggcacctgccttggaaaggggctgatgagccagagctggggcctgtcctcccacagagacctcacccctctcctgatctggtcctcgccactgagtccagtgttgggttttgccctgatgcctcccgcgcatgtcacagatagtctgggagctgaggatggaatcctctgcccactcccacccctgcctgctctgcccttccctagagggatgatgagatttcccatcgcaggagagtctctcattacttaggaaaagtggaaatgaggggaggaaaagaagagagaatctttctctgtggggctgggctgagggctccttaccttcctgctgctcctcttcctcccatgcgggggtgagggtgggacactggggaggtagggggctaataggaagaggaagcccaggctccacactgaggtgaggatgaaatccacaatccagggagtggagctggggcccagccacgtggcactagggctcttcagaggaaagagcattttttccatctgaagtgcaatgttgccttcaagcaactgagccctgggcatcgcttttgggactagggactggagcccaggcctgcatcacagagctggggcctcctcctcaccaagggctcctgggggcaggggaggggcagtgggaggaggaggctgaagcgcagcccctccttcaggtcccagttccagtccctccaccctcctgggtcccccagatctttccttcccactccagttgctcaccctgtcagagacagccctgggtccattttctattctgttccctggaacacagatgttacctggttttgtggagatctctgtgccagtccctcaatctcctgcatctttaaatctagacttctccctggagtttctgttatttctccagtttcttgctcttaggaactcatttgtttgcagttctaactttcccccttaatatgttcttgccctgcatcaactcagacatagaatttacattttttgtacttattgatcgttgtgaattttgattacaattttcatagttttttaaaagtttaatatttatttttgtgggcacacagtaggtgtatatgttaatggggcacatgagatactttcatacaggcatgcagtgtgtaataatcacagcatggtaaatggggtgtccatcacctcaagcctttttcctttgtgttacaaaccatccaattatactccttattttttaaatgaacaattaaattattattgactataggcattctattgctgtcaaatactacaaatacccagttttattcattctttctaattaccttctttatccattaaccatccccgtctctctccccctgtgccttcccagcctctagtaaccatccttctactctgtatctccatgagtttgactgtttaatttttagctctcacaagagagaacatgtgatgtttgttagtctttctttgcctgatttcacttaatgacctccagttctatccatgctattgcaaatgataggctctcattgtttttttatggctgaagagcactccactgcttatatgtaccaccttttctttatcctttcatctgttgatggacactcactaggttgattcctaatcttggctattgtgaacagtgctagaaggaacatgggagtgcaagtatcccttcaatatactgatttcctttcttctgggtgtgtacccagcagtgggattgctggatcatgaggtagctctagttttagtttttgaggaacctcctaactgttctccatagaagttgtactgactcacatttccaccaacagtgtatgagggttcccttcacatcctcgccagcatttgccattgtctgtcttttggatgaaagccattttaactggggcgagatgagatctccttgtagttttgattacctttctctgatatcattgatgttgagcaccttttcatatacctgtttgccattcatatgtcttcttttgagaaatgtctgttcacatcttttgtgtattttttattattttattttaacttccggggtacatgtgcaggatgtgcaggtttgttacataggtaaatgtgtgccatggtggtttgctgtacctatcaacccatcacataggtattaagccccgtatgcattagttatttttcctgatgctctctcctgcttctgacaggccccacagtgtgttgttcccctacctgtgtgcatgtgttccctttggtcagctcccacttataagtgagaacgtgtggtgtttggttttctgttcctgtgttagtttgctgaggataatggcttccagcttcattcatgtccctgcaaaggacataatctcattcttttttatggctgcataatattccatgttgtctatgcaccacattttctttatccagtctatcactgatgggcatttgggttgattccatgtctttgcttctgtgaatagtgctgcaatgaatatataagtgcattcatctttataacagaataatttatattctttgggtacatacccagtaatgggattgctgggtcaaatagtatttcccattctaaatctttgaggaatcgccacaatgtctgccacaatggttgaactaatttacattcctgccaacagtgtaaaattgtttctatttctccccaacctcaccagcatcagttgtttcttgactttttaataattgccattttgactggcatgtgatggtatctcattgtggttttgatttccatttgtctaacaatcagtgatgttgagcttttttccttatgtttgttggctccatctatgtcttcttttgagaagtgtttgttcatgtcctttgcccactttttaatggggtcttttgttttcttcttgtaaatttccttaaattccctgtagattctggatattggacctttgtcagatggatacattgcaaaaattttctcccattctgtaggttgtctgttcactctgatgatagtttctttgctgcgtgaaactctttagtttaattagttcccatttgtcaatttttgcttttattacaattgcttttggcgatttcaacataaaatatatgcccatgactatgacctgaatggtattgcctacatttttttctagggtttttatagttttggcttttacatttaagactttactttatcttgagttagtttttgtatagggtgtaaggaaaagatccagtttcagttttctgtgtatagctagccagttttcacaccatttattaaataggaaatcctttccccattgcttgtttttgtcaggtttgttgtcttgcctagaggttacacactgaattaccatttggagatcatccattcccacctggtgtggatcaaagataacaggggccaacaggagaaagtttgagccttgccaggtcaacactggtgctgaacaaagtgacttgcgtctgttttgctacatgtattttgctttggctgggatggaaaatattaatttgattccccatgcagcctgttgagcagcatcttgcaaaattgagaagcttatgcctatggttctatcaaacagaaaagcataattttattttgtaatggaacttggctcccatagctatgttacactgagcaaggtcatcaaagctgctctgttcttctgaaagctgcagagaaagggaacccagaaacctggtatgctggcgaaaaaagggtaagaaattcttaccaaccaagtttctcatatttctctctctctccctgtctctctccctccctctccctctgtgtgtttgtgtgtgtgcgtgtgaatgcaaatggtaaatatcactgtttgtcttctctcctctgttttctcttttctacaaatagaaaaaaggatttgtgagactagtcttaggctgtagcaaatctggagcactttgtgctaagaatttatctttctgctttgttctttaatggagagagaggtatcacaggagagaaggtgggcttaggacccctataagcctgcctttcaagccagcctggcagctggtcatttacaaactttgctgggggtccccaagaccagtgccatataaagtttccatcttttcgttttatgcccttgagagcttaaccttgtgaccatgtggggatactttctcttggtgtctgccattcagcggacaggaatttggggattcatgtcatagcactaaaaattatcttgagcaggtagaagcttttgcaaggtcaaaattggcacctctaggctccttctgggaagagcaacagaacctgctgaatgatgtagctcaataaccaaggcttttgtcttttgacagtggctgccccaggttcaattcttggctttgggaatgattcccttcttgtttgttatttgtgtaactgccattttttgagggattcccccctttctatggataatttctgatttcctgtcttgaattttcctttctgtgaactaccctggggaaattctaactcttgtttaaaaaaaactacttaccatctctttgaaacacatcatgagttcatggttaagttataaccttagttaaaacttattaatttcatgtgagaggttacctggtatagaattcaaaagccagaaatgtggggtgtcctcactagagcctggtaataagggattttgaaagtttttttttttttttttaaacagcagagctctatggttaaaagtggcttaattaaaaatagacatccagggttgggtggggtaaccctagatatctattttcatgcctgtaatcccagtacttcaggaggccaaagcaggaggattgcttcagcaggagtttgagacaagcctggaaaacatagaccacatcttaaaattaaataaataaataaataaaagtacccaaactatatctatttaaaaggcctttatcttttcctcttctagattcatgtctttctggaataagttcttttcttctgaattgattttctccattttttcttcttgccatgcttaaagcacacctgagagaacctagataaattctaacagcctgggactcatagggaaaaacagaggaggcatcacagaccccattctgggaaaaacctccattttcctcatgaaaccccaggagctgaaagttgatagatctccctcaaaatctaagtctcggttcaattttcaattttacattatgttacctgactttttttgttttttttttttacttttgggtatatcagaaattgcttcacattatgggagagcttttagccatggtttataataaccagataggaaatacactataagggactgctaatggcaattaggaggaatacttggctccttgcatgcttggatcagagaagcacactcttgaccacctagaaggtatgaaaacatccctatcccccactgagagatgagaatcccatgggggatgggctgattacaaaatgggctgattggctttggattgtcttgcaataaaatgcagggtagaagcactgcactagcttcttctgtagtatttccctctttttggggggaatccaggatcccatataaaatggcacccttaatttgggggatctgtttttgccttccagctgtgcctgcttattaggccctagaaattgcatgctttcccagccctatttttcaaagggctccagcctgaatctagtaatcccactaggaaacttaagaactggcaaatgaaaaatcttacaactactggatcttctgtctgtctatgtatttatatatgttttgtgtgtgatgtttacataaaagctctaattaattggtttaaagaaaagtaggcacttaagtcaaatattttgtcagtaaaattaaaactaatgccctttagttcacctaactttagtaatcttttggtaataaagacagattaaaaattattgataaaataggctgggcacagtggctcacacctgtaatcccagcactttgggaggctgagctgggcagatcatgaggtcaggagatcaaggccatcctggctaacacggtgaaaccccatatctactaaaaatacaaaaaaattagccaggcgtggtggtgagcacctgtattcccagctactcgggaggctgaggcaggagaatgacgtgaaccctggaggcggagcttgcagtgagctgagactgcgccactgcacttcagcccgggtgacagagtgagatttcgtctcaaaaaaaaaattggtaaaataaaatgacttcaaaatttagacatttggtctaaattgggtctgatgttaggtttgctaaatgctttaagatcataaactgcttctttaacttttaaaaattgttcaatttacctagcttggagtcattactttctagataaggcccggtgacatgtgaaattagccccctagctgctcaaagaaggttaaaaagaaaagagattttgtataagaaaggatcttgtatggtaaatttttgtcctaaagtgaaatgactggttgttgaaatgaccgttgtccaagcatgtaatagatggtctaagccatgaaaggattcatgaaagggaatttatgcaagaaacgttgtacaatttaaaggttattaggctgcctaaatgcttcacaaacgccactgtgactcttaactatacacttacctgcgttactgctaggtaagtgctgggcatatgtggagatagccacatcccatagctatgctggaaaaagtcagacttgatctgcacttctgtcctttgtctgtcctaagctccacacttggtacataattaaaatgtcctactaaccaggtttttcaccaaaaatagaagttgcacagagttaacagtgtaacatgtattgaggctactgaagaaacatttccacattcaaggcatgtaagaaaagtagaatgtacttttggtaaaagattataagaagacctgggaatatggatttctttcccaagtttagagggttattgttttaagtgagacaggaaaagtctaaaggtttttttttgttttgttttgttttttgttttttgagatggagtctcgctctgtcgcccaggctggagtgcagtggcgcaatctcggctcactgcaagctccgcctcccgggttcacgccattctcctgcctcagcctcccaagtagctgggactacaggttcccgccactacgcctggctaattttttgtatttttagtagagacggggtttcaccattttagccgggatggtctcgatctcctgacctcgtgatccgcccgcctcagcctcccaaagtgctgggattacaggcgtgagccaccgcgcccggcctaaaggtttaagcaagttgtgaaaagtttataaaaaattaattgtaaaagagattctgtgtgtaaacatattggctaaagttaaaggggtattagtcaatgtttccataagttgaacattggaataaaagcataacagagttttcttaaaacatggttctgctctgtaacaacaacaactaaattgtaaagggttataaaaggtttataagaacattaacttatggtcaaactaattaaagctggatagatttataaaattttaataaaaactagctttagcattaaaggtgcaataatgcaaacatgaaatttggttttctcttttgaaaaagattcttgtgtaatattgagaagcaatgaaaaaattttgtttgccttttaagggaggggagagagaagtgaccaattcaggggacggcttcactgggtcttgtagtttgagaagctgagtctcttttctatcaaactaaaggttttttcctttttaaaactttgtgagttatcattttggctaaataactgacttatggtgacctggcattctattttgtgacatccagtgttttaaaccatatttgacaaacctgacaagatcaaattagaagttaaacaaaaataggtcccctacagtccaaaaagatataatctgcttatttaatgtattaaaatcatgcagaaaacatggccaaatataaaatgatgtttaactttctttgggttatattcacataaatactttattagcatgtgtttcaaaactgtataagattcttataagtttgatatgccttagcatatgttatcagtaataattataattgatacattaaattattgtgtgccacagaggttaaaaattttcttgttttataatcagctatgaaacttggatgggtgctcttgaatgcaagtttctgatagctttggagattgcaacattagaataaaggaaaaaacgttcaggactctcatggagagctgacttgttcaggaacattaagcagaacaagagtttactgaatggaatgaactaatagaaaactgaactaatcttttcctttttttttttgcttaaaatgtggctgttccttttcatttttcagagagccaagaaaacttttcttttgattacagcttttaacaactgagaaaaatatactcctgtgaacaaaatttggagcatgtttgtttctctctacctgatttctcaagaatctggaagctatttgcaagtattcttaatttatggcaacataattatttgcataagtgcaataagaatgttttcttttgcaacaggacacaattggagaaactgtttattttactaaggttttgactgggatggcatgcttttgtttaaggaatcaaacttgatttacaaagccaataaaaacccctagggtaaactggcctcataccttgtctacgcagtccctgtacagggttcctaacgtatggtaagtaaagaatgtcactttccaaaaggccccggaatcttaagttatcttgggatctcaagaagaggggaatgtacccaactcataggcatttgagggtacaaacccatggctgggatgggctttaaaaaaagtctatctaagactctttatgcagagttccatcaaagccaacttaaaaggcccatgtgaaaaataattattcttgctgtgctctttgcaaataatcatgccaagtataataaaattaaagtttatttcacaaacaaaatcggtcctatcaggatttgtttttaataaaaataagaactgaagagagaaaaaattgtttcaaaaactacagtacacctgttgttagttgtttttgaggatttttttttctgccatttagactgaatcctaaattttgggaggctacaagtgctcaaactaatgcttttaagtctttacttttaaaactgggaatggcactccttgttccggaactcattacttaccttattgtacactgtttgtgtaaatgtcgtactaaaactgtagatgagaatacgaatgcctttgtcatgaaagccttggaagctcagcctggcctgcgtgagtacactcaaacagctcagacagctgcaaagcagttccactcctctcaccttggggtcaacacctaccccactatgccccctgtctgcaggaagaatccagagtgatcgacggccttttcccatcttcatagcccacaccttaagaataaggtgctatgaaaccctaagggagggattgaaacagcctttgcaaaaattataactgagaaaataatgacagtgaaagagatcagacctaaccgactccatcttgcttctaacctttaagctgtccttgttcattcctgggcataggccgaactaacctcgggaaggaatttgcagaccctgcactcgatggatcagctgacaccgcctagactggtaatctggctcaatcagttctgagatcctacccaggaacagaagatagcaaggaaacctcacttcgaccccctatgattccatctccaacttgatcaatcagcactccccacttctctagcccctacccgtcaaattgtctctaaaaacttaagctgagcacggtggcttacgcctgtaattccagcactttgggaggccgaggcgggcggatcacgaggtgaggatttggagagcagcctggccaacataatgaaacaccgtctctactaaaaatacaaaaaaacagctaagcgtggtggcgggcacctgtaatcccagctacttggaaggctgaggcaggagaatcgcttgaaccctggaggcagaagttgcagtgagctgagatcacaccattgcactccagcccaggcaatagtgcgaggctccatcttaaaacaaaacaaaacaaatgctcaagaagtctgatttgaataataatgaaactctggtcttccgcaaaaataaagtaaaaatacaggtaagttaattctaataaggtctattgttacaaagtctttttgagtttctatacagcagaacaatattacaagacagaaccttcaaaaaccacttcattgcaactctgagtccctaaggaaaagagaaaaaaatgtggaaaaatcaaacgcttttttaatggcacagaggtcattgttttcttctataattgcaacagcaaaatctagatatctgggtatatatacatgtatatgtgttttttacattttagatagcatgccattctccattttatgaaaatttcatatagaatacatatatttgaaatatgaactgaaaaacattaagcattaataaagaaaataatgaacatctcctactggaataacttaccattattgtttttatatttatcaacagctctagaactttaacatggacatatataaaagtgaccacttccttagaattccattttgagttctcgttttgttgtgttttattttgttttgttttggtttggttttggtttattttgagacgaagtctcgctcttgtcgcccaggctggagtgcagtggcacaatctcggctcactgcaaccttcgcctccccagttcaagcgattctcttgcctcagcctcctgagtagctgggattacaggtgtccgccaccgcgcccggctaatgtttgtattttttttaggtttcaccatgttggccaggctggtgatttcccgttttgaaaagtaaaggtttcagccgaacagagacctactttctgctgtgtcacatcgccctctggtggctaaatggctttcttacacagtaaccccaaataataactatcatataaaagaactttttaaaaaatcgtgataacattaaaatgattagaaatatataactcataagcaaagtcacagcactatgatatttacatgtttatcacacgtcaaatacatttaaatattttgtgatgtgtgaatcttcacattcctgaaccacctataaagttccatttcccaaggttaaattgaggcaggatttttaaagacttttaactagctaacagagaaaagtgtacaatttccattaacctccccagtgacaagctttctcaagacccagcgaggttgtatgtgtgtttgtgttttgtttttgtttttgtttttgttttgagacggagtctcgctctgtcgcccaggctggagtgcagtggcgccatctcggctcactgcaagctctgcctcctgggttcacgccattctcctgcctcagcctctcgagtagctgggactacaggcgcccgccacaacacccggctaacttttttgtattttttagtagaaacggggttttaccgtgttagccaggatggtctcgatctcctgacctcctgatccacccgcctcggcctcccaaagtgctgggattacaggcatcagccaccacgcccggccgtgtgtttgtgttttaatatggtttttctgtgtataaaagctatacgtgttcatcttagaaaatttagaaatgacagaatttgattttgcttattctaaatcccttgggattatttccagtatagatggcagtgaggaaggaataatttcaggacactggctttcttcttccacaagaccccagctgggcaaagggaactggatggccttgggcctgtggccccagtgcaccctcctctggggcctgtacctggctctggatagtaatccccactgcagaatggaagaggctgctcccacataagccgttgagtccagactccagaaacctgggtccgtgcagtactcaaaaaggaaagtaccgaccacccagaccagagctggcaagaaggcgaaatgggattgattcattcattcaacaaatactcgctgagctccagccgaatgctaggcaccatgttcaggatatagatgattgatgtaatccctcgccttggcagtttggggtaaagagctatcatcactgctgacttcataacaatcacatgccttcagagataaagtgaacactcacttctaacaaagcaaaaataagaagaaaaagaaatgcacactcccgatttctttgtccaaagtggtatgactgggtgatttgtgaccttcccatttgcatgcccaattgccaaaaagcatggcaattaccccacacacctttactcatcccaaactaactatgctgaaaacactgcacaatggagatttcctttatgcctgctcaggcctaacagttccatattcactggcctggctgtcttctccaagctgaaagaggcagagccattaccagtatttttcttggaagggcaggaagtaaaaacacatctgagtaacactcaagaaaatattgtttatgtccaagatgatgaattaatctttttttattctctctttctctttttttttttttgagacagtctttctctggcacccaggttggagtgcagtggcatgatcacagctcactacatccttgacctcccaagttcaagccatcctccatcagtctccagagttgctgggactacaggtgcaccttgcctggataaattttttattctttgtagaaatgggggctcactatattgcccaggctgcatctttattctttcatcccatcctcaactaaagtcatgttactgtaatagaagtgaaataccatagccccgtgtgcctcagcaggcaggggctgtcagcactcttcatattgctgagcatttcaaagctgtgttggcagctgttccacagtcgacttcagggtccctgagatgattggctcttggagatgatccagcagggttctggtagctgagctcatccaccaagtccacactggcagtgaaaatggcttctgggcttggggctttctgggcccagccccagggcagactgagtcaacacacgaaggacagccttctgcacccacagcagacaggggaggggcaaagggagacacgcggtcccagtggggcagggaggctagaacacggccacaccctttgcgagccacaaacatttttgctgagcacaaaattctctccagctgggcagacagaggaaaaaagcaaaatgaatgagtagagcacgtggcacatcatcagggagttccatggaggaaagtggagcaggtgaagggcaggacgagggacatggagtgccagctaggggctcgagaaagtgatggcaagagctatgtaaggctgacattgggatatggttctgaagggagtgaggatggtgacgtggctgtgtgtggaaagggaatgtcaggcgggggtgacagcagggataaatgcctggagagcatggctgtgtgtggaaagggaatgtcaggccggggtgacagcagggataaatgcctggagagcagagtggcccgctatttcccaggaggaaggacctgtggctcaagtgtcaatgaaagtgagcggagagggctgaagtcggggtaacagggccagcctgtgtgcagccccctggatgtgggcgagggagttgtctctgccgtgtgagaggaacagccacaggagggctttcaggagagcgcatggtgtgaggtttttcagactcactgtggctactgtgggaagagtgttttaggtgcctcccctttaccccactgggtcagcagggtttctgccctaggcctagggggatggctgcacacacacgcacgacacttgacagaggagatgagcactggcttattagccacatagacagactcataccccgaggaggagaaccccaggccatgcagggggaatccgcgggactgaacagccctgagctcaggagagggtctacatgcattgcaattaaaaaggaaatgcagccgggtgtggtagctcatgcctgtaatcccagcactttgggaggccgaggtggacgggtcacctgaggtcaggagtttgagaccagcctggccaacacggagaaaccccgtctcaactaaaaacacaaaaaaattagccatgtgtgatggtgcatgcctgttatcccaggtattcgggaggctgaggcatgagaatcacttcaacctggggggcagagattgcagtgagctgagatcacaccactgcactccagcctgggtgacagagtgagactgtgtctcgaaaaaaaagaaaatgcatgccgtcaagtccgctcgtgccgagatgaggtgtctccagttgtccagcatcacatcgcggtacagggtcctctgaacagggcccaagcgctgccaatcctcctggcggacccccagccacgtccttgaatgacactgatacctgtaattgtgcatttctcagcactttgggggttcggaaacagggacatggaaaacacatttgggatgtgattcctactatgtttattgttgcaaatctaaacaagttactgtaaggtatgcctattttagttctagttttgccttacgcttttggggtaactcaagcagtaaacatattttgaacatcgtaactcatttgtacatgagcgtgcattagatacatatactatcatgtactaagctaacactagtattgttttaaaaaattcttatttaggtgaaaatcagtgtaattagagttttcacaatttcctttccacactttaaaagatcttgggcattccctgggctgtacacaccctccttgaagatcctgctgtggctactggggagtctgtaaagtgatccatgtaaggcctgaatgtgctgtatcagacttatgtcaaagaagcaatgcttcagaagagtggacggtggctgaaggggaagccagaaccagagacctgaaaaagagatgaccgccttcactaaagcaacagcaatggggaaaggaatcggggactagtcccatggcagaagccgcaacggaatttgtcatccatttcttgagtggcttccctgaatgagtagctgggtcaatgctggtgccatctatagtattaagggaaagatggcaaagtcagagtctataaatgaggattctacggcagttctggaccttgtggaactttatgtctaactggaaagatccagaaatggcagttttcactaatctgcgaagtgcagaggcaggggcagcacgggctctgaggactgagatgaggaaggacaagtggaaagagaagaggatcggttttgtggatgaggccatcagacttgactcatgacaaaccaggaggaatggagaagctgacggggcagggttcaaggtccatgcagccccagtgagagcatgaggtgaagctgtgtcagaacagcaggatgtgtccgggatttagtcgcacctgagaataaagttacatggtgaacttttctcatcactttccccagtggacagtaaaccccactgtgggaaacggcattttcagctgtaactgtgcagatgccacacccctgggcagtcctcactctgcaggctccgattctcacagcgcccagtgatgccagcaaaacactttatcaggagtgtccaatcttttggctttcctgggccacactggaagaagaactgtcttggactgcacataaaatacattaacactaacaaaagctgatgagctaaagaaaaaaaatgacaaaaaatacctcataatgttttaagaaagtttacaaatgtttgttgggcctcattcaaagctgtcctgggctgcatgcagcccgggggctgttggttggacatgaaggggattcttagagagatttcactgcactgaatgctcacagtttatttacataacagttcaaactccagttatcactgtgccttcaaagtgcacacgtcgctcctagcacctctgcccaccagcctctacatgaacaccaggagcacgtggcgatcggtgaccaaccacaccactcccttcagaatctgcagggcccttccctccgcatgcacagctcggttcctgtacagacaacaccacgtgtagtcatcttgtttcttagattcctagtaataaaaccactcggaatgttacaaagataaaaactggaagagtggattggccaacaaagaggaaagtgcaggaaagaaaggaagagtgacagcctcggaagtaccattcagacctccaggaaagggcactgtggtgctgcctctgtgggtgctgacattgcactggtcaggaggtgcaccaagccaggctaggggccaccaagcctggcttttaatacatttttataaagaaataagcttgaactatcagtgtgtctaaagattttaaattacaatatatgaaataaatatcagttttcctgagtttcgttttcatgtgttcatatgaagacaatatgcaatggtaagagacatgttaacgtgtggataaaaaaattcaaaggttgcagaacactcatgattttctccactgattattaagatcactttatagttttggcttgcatggtcgttcttatactcacagactactatgcgaagtgaggactatgtcgatataaggaaatctttgttggatagaagaacactaggagtttcaaaaggagacatgggaagaagtcatgtccccaaagtcctctatttggtactgagaagctactcacttcggtataaggagggggtgacagactttccagagggaggaggcattatctgagttcagacgaaagatgtgctgagcagggcaagagacaggtgacctggttcaggagagaaaacaaaactttgaaatatatttaagaatataaaaaactggccgggtgcggtggctcatgcctataatcccagcactttgggaggccaaggcgggtggatcacgaggtcagcagttccagaccagcctggctgagatgatgaaaccccgtctctactaaaaatacaaaaaattagccggactcagtgcaggtgcctgtaatcccagctactcgggaggctgaggcgggagaattgcttgaatttggatggcagaggttgcagtgagccaagatcatgccactgcactccagcctgggtgacagagtaagactccgtctcagaaaaaaaaaaaaaaaaggatataaaaaactgatagttttgacctaaaaacagcaaaactagaaagacccaatgcccaactggatgtggcaggagctgagagggcgggagggtgggttagggtgacattgtccccagggagcagggggatgggtgtgatgtgggagccaccccaagccgtccggtgcctggccctggggtgaccaggtgagggaatcaatattcctgcaggacaagagccacataaagaaggtagtggaggggggagcctataggagcagttaatttgcttgtgaaaggcgtgtttatcacctctaagaattagctggccctgggaggagcagtctttccccagccagagaggccccagatgccagagcaccaagaacacagaaataaataaaaacatgggtaacgtatttgtctgtagtcaagtcactggtgggtggaagccataggcaaatggtttccatttgtgataatggaatttccacgagagaaaatgcaccaccaaacagggatttggaacatgaatgataagcgtggaaacattttgcagagagcaggatcgtaagctgtcaagagacttgcagatcacaagcattactatcttaatggacatccattctccctccaggtattccagactttatccccgccagaggcaagaacatcataaagacatcgacctccacttctggaagccagtactgagctctggcttgccacactgccttcctcttccattgaagagccagcagggacagcagcctgtgtgagctcagggttgtcactgcaaggtggttgctacatgacttacacaaagacatttttcagatttcacttttctttttctctcacgaggaatcagttaggtttatgcttcttatcaatgcacatatttaaacacatagtatccctcatggccttggctatcattatgctcagaaatagctttgtaccaagagtaactgtgtatgtctacatgccaactttgccttgcaattgatcagttctatgttttctctggttaattggaccattggactacatttagacacacagaccttgaacccccctacagaagccattgtaaagcaaggtggttggttcctaaacagatcacctgaaaccttctcattttctgttgttctggaaggagtgaggaggacaggaaggtgtcacagagcagggaggaaggagaagtggagttgagtgagacctgaatggtcttaccgctcctacatcgcatccacatgcctgaaaccctggaccctgggccaggtgaagtcttccctggggtgtactcttccttggcccttgagccgaagcaggagggccccgtagaggcagcacagcctgtccacccacaacgctcatgagtatgtggactcacatttgtagttttgcagagagttaatgtcaactttgttgtccattgacttattaacaacttatttctcctttgcacggaaaaaattcagagaattgataatatagattacagtagccaaagaatgaaacaacatggtatagaaaaaatagccttattgtttggctgcattcccactagcgctgttgagacttgggagcaccaggcaagtctctgaaaaggggatgaggaagccgaaagcaagctgcattttgcttggctctaacttcctctgggttttcccagtgaatcttttgttatgaagtttctggtcatttactgcgacagagagaacagcagagccctgaattttcctcctggccctgttgtccacacatgggctatcttagatatattattcattctcaagatgtctttcacctttcaagctcagcacctttctccagaagcctgctcctctgtgctgtgtttctggcctcagtgagtgaggacagtcacccagccatcacgcgaggaactcagcggccatctgtgccttcatcttccttgcagtcagaggatcactaagtctcactgttcttctttaaagccctccccatttctgccctgaattactgcagccgcctccctgctctgccatccatctgggcattactgccagggtaatctttccgtatgtgagtgctgctgatattggttctccaaaaggactgctgtggctcctgtctccttcggggtgagattcgagccatggagcagcagcttcagcatccagtccatttgttgggtctcaggtcctccagttttccttggattctccttcctcaccaatccaccgcacacttcactccaaccacacaaaacacagttttcagaacaagccacactgcttcatgcctcccatcggggtctctcaatctccgtattatttatgctcggggctggagagctgtgttgtaggggcctggcctgtgtgctgtaggatgttagcagcaaacctggcctctacccaccacgtgccaatagcatacccaccccccagttttgataacaaaacacctttggacattaccaaatgtgccctgaaaaatcatccccagttgaaagcagttgctctttgcttttacaaatgctggtccttttacctggaataaccttcccttcatactgaactcctacccagtcatctcttcgaaacttcaacccagtcatcttcaaagcttcaaaagtcaacccagtcatctcttcttctctggtgacctccttgctcaggcacagccagagctaatccttattttcctggtgaagccagcattctttgtaatacctctaaaatcaagctcatctcactatactggagtcttttgcttgcaagtgtctttctttgcactggcctatgagtgtccaggagaaatggcagagatcatggcttctttgtgccctccttgtctggggtagatcctagcaaggcacacacctggggaaagtttgttcaaagaaggaactgaattcatcttattctctcatgttaatggcaattaaaacatgttcctttatggtgatgttgacaccaatattttgtgtttactaagataaactctaaaccaaaactggagcctaattttgcttctgaggttctgatttagaatgctaaaaggaaacaggtgtgaaagctaagcacttattctacaggtgggaatgtcaatgatggggaacaaaatcaaaattccttatggagcccaaccaagccgtcgtttcttctcatcataaaactgatcttagcggcatttatttagggtctaatatatgtcatgctatactaagatttaatgagatcactatctgatttcccaaatctttctgaaacaaatagattagcaaattctaccataaacttacacaaattggcatcaacttttgaaaagctggcatttgcacataaattactatttcatgatgactctatgtacaacagatgtctgatgtattctcccagctctagaatagtcaatagaggaataagaatatcaaaattattaagcaaatccagaaagtgaaatttttacccaggcaactggtcttatcccttcaaaaatcgatgtaaatcactagacaaggaaaacacgttaccaaacactaaagaattaatcctggaaaaggtaaacatacaggtaaatataaaatacttttatcttgcttttcataattttttatgaaataatttacagtttaagcaaaaataacaaagcatgatggtgtttaggacgtatgtagaaacaaactgtatgaaagtatggctgtggcatgtcattgaaacatatacatatatgttttcatccacagttccttgttcataactctcatagcccttgtgacagtaaacagaatctctctctcacaccttctcctgcccttctttcccctgcccatggctggattctgtgggtcatgagaccctcattccaaagagggttttgtctcataacctggaggaaggaaggctacacagagaggccaagaagaatctgaacacacaggccttgctgggtttagaacccattttgtccaatcacatttccacagtcacccatgcttcaatcaggcctatccaacaaattccccatataaagacccaagaggacagggtttggaagcttctggagagctgaacacatgaagggtgactaaaaggtgaagaactcattcacgtgctgagagggtggtgctccctgaatccacatggacacaagctcctgcacctgggacccttcaaaatcttccagacctcatcctgtgtgtatctcttcatatggctgtccatccgtatcctttaaaatgtccttcataataaactggtaaacaacataagcatttccctgagttctgtgagccactccagcaaattaatcaaacccatagaggggattgtgggaagcccagcttgaagccagttgattagaaattccagaagcccggacttatgactggtgtctgggggtggggaagtggcagccttgcagaacgggccctctctttgtgggatctgatgccagctctgggtagatagagttggaattgaactggaggacgtccagctggtgcccactgcagaggtgactgcctgcttgctggtgaggagaaagcccccacatactcagggtctcagaagtctgctgtgtagattgctgttgtgttggtgtggacacagaggagaaacagttcgggtttttcctaagaatgacagtagcacaaaagatgggaggaggagatagaaatatattgttgcaaggtttttacaatatacgtgaatgggtatcatattatatgaaattaaatggtgataagtttaaattgcaaaatataaatccagagaattcttctggcccttatccaagaccatcaaggcagtacttctctgagtctgcaagaatcacagtgttactgggtttggggtgccccctaatacagatatggcttagactgcaacacccaagtcccttggaatacctggaaagctttcccagaaaggatgggtacaaacaagcccaactgcaaagatgacactgcctaactcttcaatgcccagacgctaccaaacatccacaagcatcaagactctccaggaaaatatggcctcgtcaaataaataagtcaccaggagccaattccagaaagacagaggtatgtgatctttcagagaattcaaaatagctgttttgaggaaactcaatgaaattcaatataacacagggaagcaatttaggatcctagcaaacacatttaacaaagagattgaaataatttttaaaaatcaagcagaaattctggagttaaaaaatgcaactgacatactaaagaatgcatctgaatctcttaatagcagaattgatcatgaagaagaaggaattagtgagcttggggccaggcctggtgactcacgcatgtaataccagcattttgggaggctgaggctagcagatcacctgaggtcaggagttcaagacttccctggccaacatggtgaaacctcatctctactacaaatacaaaaattagccaggtatggtgatgggcacctgtaatcccaggtactagggaggctgaaacacgagaatcacttgaacccagatggcggacgttgcagtgagctgagattgggccactgttctctagcctgggtgacagagcaagactttgtctttagaaaaaaaaaaaaaagatttagtgaccttgaagacaggctaattgaaaatacctcctagtcaaaggagacaaaaggaaaaaaatgaaatagaatgaagcaggcctagaagatctagaaaatacccttcaagtggcaaatccaagagttattggccttacaaggaggtagagagagataggggtccaaagtttatacaaagggaaatttcttacaactgcatgtgaaatgaatctataattatacacacaattttagttgtaaaaaactagataaaatagtctttttgaacagacatttcacaaaagaagataaaaaaaggccaataagcacatgaaagattctcagcataattagttctctggaaatgcaaattaaaatcataatgagatactactacatacccattaacatagccaaaattacccaaataaccacccagaaaaataccaaatattggcaagcatacatttctgtatgagagaagcaaggatgtcatatatttaatggaaactatcacacattcctggtggaaatataatgcaatgagttttattatcattctatttatacatttttaaaaaagggagcaacggcaggtcatttacttataaaagtctcaaaatcattctaccggtgacttcctttcataaataaccactctctataaaacacttgccaagaaacacatggatcctacaagggtcgggtgttactcttatcaatcattattgataaacaattatgatgaggggacccaaagaaggcgatgtacccgctgtggcaccggtggccacaaggtggcgtgaatgtcgagcggctgccccagccacctagaaagagattggagcagccaggcttccagaagcagaggaggcctcacagagggcaccgagactagacaggaacctctcaccttgtgaatttccctaaagaggggtcttcctagataagctttgaaggaagacccagtacctacacagtaaggcacaagttactgtgaagaaatctacgtcaaactagatgaggcctatgttaccttaactacggcctcatttaccctacctaggacctgatggggcttaaattatcctacacccacattattctagatcagggtttcttagccctctcattattgacagtttgggctggagaattctttgactcctcggtttggggagcctctgcccacctgcccaactgtggcaaacaaattcatctccagtccttgcccatgacccttactgggcaaaattgctcacagttgagagccactgccccaaataaggcttaaattactagtaaggctgatattacaccaaaaccagtctccattttcttagatcaatggttcttaaactagagcctgcaaagaatccccgaaggagcttgtgaagctgcctacacctgagccttcccccggagttcctggtttctgtgtctaacctatttctagatgatgtagatgctgtcgatgcaaggacctcactttgagaagcactgtcccagatggtgactacattacccatacgcacatttctctaaagcctccatttccctaggaccaccttatcctaattgaggcttacaacagacttgaggtgttcatgttactatttttattattaaggtaaaaccaggaaattttcatagaaaagaattcaaaagcttctgaacaaggtattatatgcatagaaatacctcaacataacatagatgctgggaaacaaaggcattgtcagccttgggcatgaggaagggcagggtgcaggcagggcacaggcagggctgctggcttcagccctgggtcttctttgaagatggaaaaggaaaacaatagaagacatcagtttaaacaaatacttcagtaattttcatgttgaaattagaagagcttctgttgcactttgggaattgctactttattttgactctagatatgaataagcaaatagcatgctactgcaatcaactttgacaaagacaaaattgtactggtgactttttcaagggcagcttatggaagacgtccgattacaaacttggtgaatggcgaagaatattcatccctcacagattttttaaaattatcttggtttttagtaaaaatcacgttgtctttaacagccacagacaccaaagaagttctaccacatcattttttcatatgattacggctcatttataagaatttctactatttcaaagtgtatttatttgtaactcaaaagaagatcagtctatttttctgcctactcggctgtagaataccaccctctactaatggctcattgactcaaggttaccttaaaggaaaccagacccagggtcaagaaggaatcaagccctgtgcatactcagtgctattcatgtgttcacagaatgattatgggacagacattgcacgtgggcatttgtttcatatttgcatcacgtggaggtttacatagcaaatattaactattccaggccaggcctgatggctcacgcctgtaatcccagcgcattgggatgcagaggcgggtggatcacctgaggtcaggagttcgaaaccagcctggccagcatggtgaaaccccatctctactaaaaatacaaagtgagccgggtgtgacaccacacacttgtaatcccagctggctcacagagcatttttctctaagcatctcaagcccagtatgaagtggacgtgtcctggctcagaatgttccctcagtgacagcaattgctcctcacaccacctcttacaataggaataggccttagaaaacccagcaatctattgggatacttcagcgcagcaagcaaggaatcactaaagccaccagggggcccctcccctggagctccatatgcactgatacctccagacacatggcaagtgcaggaactgatggggactttggggcagcctcttttttttaggattctgtggttgaagattatatcagattagaactttatgcacagaccctgtttctcaaagcccctgcccccacactcacagtggaatatttgcacagtaacaaacctcaaatttgccctccttcctagtgtcttgccaatgaaaagtgcttccgactctgaccctagtcctgcttatgtttgttgttttgttgtttgttttttccaagcagagctaaagcaagctcagtactattggagatttggaaagtgccttcacattgtctttgccaattctcacctgagagccctgcagacgccccacgagaggaaaatctaaggtcattgagggaggggccgtgatcttggtcctgaagctgttgctttcagaggctttaaatcacttcactgtacttgacttgttctctcccagtgcctttggtttccctaagttctagtccttagacagagcatgtgccttgcaaaacttttctctttaatccatcttaatcctagtgagcaggtgatatggtgggcaggggagcagtatatgttcaatgatttcttgctgtgctttctttaggctgtaccctttacaaggagtctccagtcatacagctgattttcctccgtcctctactccacctcctggctgcagcatacacagattattgtcttgaatctgaccccagttgtttattaattataccccttttcatgacacgggaaggctaagatgaagctgtctgggatggaaaagaatcccttcctctcacatagaataaagatcttgaaaagtattttttctttgtagggtctgtctggagaaagttctgggcatatttatcagaaaatagttctccggatgacagagccatgagggcatctgtttgaattctcgtcttgagaacccagaagcttttggagggaaattccataaaagtgtgaggtgtgtggcccccagttcttaccctaccctttccctgcttctcctccaggcatttatggaattaccatgtaactcttcgcaccagcttgtgctttcaatggaagaatcacccaatctatcaatttagaaaggagattttatttctgaaaaagggttggagctgcaggacggccatcttaacaggctggaaagcaaagcctcccacagagactgtgagcaggcacttcaagagagggaaagacaagaaatgaattcatgcgaatggattggccaagcgtacacactcagcaggctatagaaggacctattgatagtcacatgacaggcaggctctcatgtgtaataagcaaacacaaacgttacatgcatttcatatttgcttttgggtgaggacatgagaactagatgaattacaatctggctctgtacacgaaaacggctttgtgcaggggcagaaagacacacagtgcacagcctccggaaattggccaggacaagtccatggtcagtctcagctctttttcctcaacttcagttctacctggttccacttcagcactgtgcctggaaactcccttaaggaagcatctgagcgtgcattcatcagaggactccttttgtttatttcccacctctcagcaattactgtctttgttacctgttgtcacacatcataaaattgaatttaagaaatttcactatgttttacaagtatttctggtggaaagatacatctggtctctgttgttaaacctagtttgaaagtgatcatcttgcacaaaaaatattagaattaattttatgatgttcaccaagatttatcttggaatgtatacaaatattcaaccttaaatttcaaggtatcacaaaattttgttacatatatatatatatactctatatatagtgtttattttgtcttacatatatattaattataccaatagaattatatagtgttattttgttttatatatatataaacactatatatagtgtttggtatatatatagtgtttattatatataatatatatagtgtttattttgttatatatataaacactatatatagtgtttggtatatatagtgtttattttattatatataatatatatatagtgtttattttgttatatatatataaacactatatatagtgtttggtagaatatcatacctaattttaaaatattcaaaatatctatatctgtcacataagtaaagcacaagctctacattgccctaatagaagagcttcctatttgtctttctcccacaatgtcaggggatgaaagcaggtggtccccactgagagtacttcctggattagatccttggaatgtcagtttcctgcctgatcatctcattttcattcctcaaatcagaacatgaattccatcttgagttaacttctcctccagagtatgaaagcatcattcctgctgcttctcctctaggctgattcaacaggatgtgcttcatcttttgcactgtgaagatattctttggggtcaaaagccccttcctggctatctggttgtctggcgatgcgctcattattgtccctagaaccttcctgtatcctggtccctggagtatgctcttggcctgggggttcagttccttcctgaaacatgatgttttgctcagctccagcatgaggctgtagaactggctcagttcctaatcctggaagctgggaggagtttttcaggtggtagtggcacagagggcaggtctcctggacatacagccatttcttaagacagcctgcatggaaaaaatgaacgcaaggcgtgatcacagcagatttcatgtcccaaacagattcttatcgaaggagttacctgataacagatggcacaaatatcattgtgtttctcaagctgctctttcgtagcaatgggtaacgatttaatcttattcacagcatccctgtggagaagaaagctcttccaccccagctgggcctgaagccacacgttatagtaggaatgaatggatgatcattgagcccatcactgtccattctccaaagatggtctctgagacgcaataggccaccatacagacggccgcaagaaactccagcaggtggtaagtgccattcacatagtagatgacatcatccatgttttccaccggctcttttctgaattcctcaaccgtaaatcagacataaataaaaagtgttcccagaacctgaagagaggtaagaatgctgctggaaataatgataagaagccaaaaatccaggtggaaaaactggcaaatcatataagccatatgagcagggaataccaataaaaataaacaaagtcgcacagcacggaagtgtttccacaagctcttgtctctggatgctcccagtgccaaaaaaataggatctgcaatttctaacatagactgtaggatagaagctgcaacaatgaaaaggataatactgagcaggaatgcccgatgaacaacctgcagttctatcagcccagtctgcactgccaggattaacagcgttactcctcctgtcatgccccaattcatggcaggatcattcctgaaagctcgataaccctgcaagtaaaactcgcagagtgtgagaacacccaaggcaacaaaagaaaccgtgaagaccaaacccaaaagagagtaaggagtgctgcagcattctgcaatacttgtcagaaaaaggaaaagaagcctctcacgtgatgccggctgatctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaaccaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcacaggcaaactgcagttcactccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccaccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctcattgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacacccagctagctgcaagagttgtttttttttttatactcctgtggcacctggaacgccagcgagagagcacctttcactcccctggaaagggggctgaaggcagggagccaagtggtctagctcaatggatccccccctacggagcccagcaagctaaaatccactggcttgagattcttgctgcccggacagcagtctgaagttgacctgggatgctcgagcttggtgggcggatgggcgtttgccattactgaggcttgagaaggcagttttcccctcacagtgtaaacagagtcacctggaagttcaaactggccggagcccaccacagctcagcaaagctgctgtagctagactgcctttctagattcctccttgctatgcagggcatctcggaaaaaaaggcaactgtcctagtcaggggcttatagataaaacccccatctccctgggacagagcacctgggggaaggggtggctgtggacacagcttcagcagacttaaacattcctgcctgctggctctgaagagatgagcagatctcccaacacagcgctccacgctgctaagggacagaccgcctcttccagtgggtccctggcccccatgcctcctgactgggagacacctcccaacaggggttgacagactcctcatacaggagtgctccagcaggcatctggcaggtgcccctctaggacgaatcagaagaagaagcaggcagcaatctttgctgttctgcagtctctgctggtgatacccaggtaaataggatctagagtggatctccagcaaactcagcagacctgcagctgagaggcctgacttttagaaggaaaactaacaaacagaaaggaatagtatcaacatcaacaaaaaggacgtccacacagaaaccccatctgaaggtcaccaacatcaaagaccaaaggtagataaatccacaaagatgaggataaaccagttcaaaagggcttaaaattcccaaaaccagaacacctcttctcctctaaaggatcacaactcctcatcagcaaggggaacaaaactggacggaaaatgagtttgacgaactgacagaaggaggcatcagaaggtgggtaataacaaactcctctgaggcaaaggagcgtgttctaacccaatgcagggaagctaagaaccttgaaaaaaggttagacgaattgctaactagaataaccagtttaaagaagaacataaattacctgatggagctgtaaaacacagcacaacaacttcgtgacgcatacacaaatatcaatagttgaattgaacaagtggaagaaaggatatcagagattcaagaccaatttaatgaaataaagtgtgaacacaagattagagaaaaaagaatgaaaggaatgaacaaagcctccaagaaatattggagtatgtgataagaccaaaccttcgtttgactggtgtacctgaaagtgatggggagaatggaaccaagttggaaaacactcttcaggatattatccaggagaactttcccaacctagcaagacaggccaacattcaaattcaggaaatacagagatactcctcgggaagagcaactgcaagacacataatcttcagattcaccaaggctgaaatgaatgaaaaaatgttaagggcagccagagagaaaggtcggtttacccgtaaagggaagcccatcagactatcagcagatctctctgcagaaaccctacaagccagaagagagtgggggccaatattcaatattcttaaagaaaagaattttcaacccagaatttcatatccagccaaactaaacttcataagcaaaggataaataaaaacctttacagacaagcaaatactgagatttttttgcaccaccaggcctgccttacaagagcttctgagggaagcactaaatatggaaaggaaaaaccagtaccagccactgcaaaaacataccaaattgtaaagatcatcaacagtatgaagaaactacatcaactaatgggcacaacaatcagctaacatcataatgacaggatcaaatttatacataacaatgttaaccttaaatgtaaacaggctaaatgccccaattaaaacacagagactgacaaattagatcaagactcaagacccattggtgtgctgtagtcaggagacgcatctcatgtgcaaagactcaccaaggtctcaaaataaagggatgcaggaatatttaccaatcaaatggaaagaaaaaaaaatagtggttgcacccctagtgtgttataaaacagactttaaaccaacaaacatcaaaaaagacaaagaagaggattacctaatggtaaaggtatcaatgcaacgagaagagctaactatcctaaatatatattcacccaatacaggagcacccagattcataaagcaagttcttagagacctacaaagagacttagactcccgcacaataatagctggagactttaacacctcactgtcaatatttgacagatcaatgagacagaaaattaacaaggatattcagaacttgaaatcagctctggaccaagtggatctaatggacatctacataaatctccaccccaaatcaacagaatatacattcttctcagcaccacatcacacttattctaaaactgaccatattattggaagtaaaacactcttcagcaaatacaaaagaatggaaatcagaacaaacagtctcccagaccacagtgcaatcaaattagaactcaggattaagaaactcttcaaaactgctcaagtacatgaaaactgaacaagctgctcctgaatgactactgggtaaataatgaaattaaggcagaaataaataagttctttgaaaccaatgagaacaaagatacaatgtaccagaatctctgggacccagctaaagcagtgtttagagggaaatttatagcactaaatgcccacaagaggaagcatgaaagatctaaaatcaacacactaacatcacaattaaagaactagagaagcgagagcaaactaattcaaaagctagcagaagacaagaaataactaagatcagagcagaactgaaagagatagagacacaaaaatcccttcaaaaaatcagtgaatccagtaggtgattttttgaaaagattaacaaaatagatagactgctagccagactaataaagaagaaaagagagaagaatcaaatagacacaataaaaaatgaggaaaggcatatcgtcactcatcccacagaaatacaaactaccattagagaatactataagcacctctatacaaataaactagaaaatcagaggaaatggataacttcctggacacacacaccctcccaaaactaaaccaggaagaggtcgaatctctgaagagaccaataacaagttctgaaattgaggcagtaattaattgcctaccaaccaaaaaaagcccaggtcaagacagattcacggatgaattcttccagaggtacaaagaggtgctggtaccattccttctgaaactattccaaacaacagaaaaagagggactccaccctaactcattttatgaagccagcatcatcctgataccaaaacctgtcagagacacaacatcaaaaaaatttcaagcctatatccctgataaacattgatgcaaaaatcctcaataaaatactggccaaccaaatccagcagcacataaagaagctgatccaccatgatcaagtcggcttcatccctgggatgcaaggctggttcaacatacacaaatcaataaacataatccatcacataaacagaaccaatggaaaaaaacacacaattatctcaatagaagcagaaaaggccgtcaataaaattcaacaccacttcatgctaaaaactttcaataaactaggtattgatggaacatatttcaaaataataagagctattcatgacaaatccacggccaatatcatactgaatgggcataaactggaagcattctctttgaaaaccagcaaaagacaaagatgccctccctcaccactcctcctattcaacatagtattggaagctctggccagagcaatcaggccagagaaagaaataaaggtattcaaatagaaagagaggaagtcaaattatctctgtttgcagatgacatgattgtatatttagaaaacctcctcctctcagcccaaaatctccttaagctgataagcgacttcagcaaagtctcaggatacaaaatcaatgtgcaaaaatcacaacaattcctatacaccaataatagacaaccagagaaccaaataatgagtgaactcccattcacaattgctacaaagagaataaaatacctaggaatacaacttacaagggatgtgaaggatctcttcaaggagaactacaaaccactgcccaaggaaataagagaggacacaaacaaatggaaaaatatttcatggacatggaaaggaagaatcaatattgtaaaaacagccatactgcccaaagtaatttatggatttaatgctatccccatcaagctaccattgactttcttctcagaattagaaaaaaaactactttacatttcatatggaaccaaaaaagagactgtaaagcgaagacaatcctaagcaaaaacaaacaaacaaacaaagctggaggcatcatgctacctgatttcaaactatactataaggctacagtaaccaaaacagcatgatgctgacaccaaaacagatatatagactaatggaacagaacaggggcctcagaaataatgccacacatctagaacatctgatctctgacaaacctgacaaaaacaagcaatggggaaaggatttgctatttaataaatggtgtatggaaaactggctagacatatgcagaaaactaaaactggaccccttccttacactttacacaaaaattaactcaagatggattaaagacttaaatgtaagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactgtcattggagtgaacaggcaacctacagaatgggagaaaatttttgcaatctatccatctgacaaagagctaatatccagaatctctaaggaacttagacaaatttaaaagaaaaaaaacaaacaacaccatcaaaaagtgggtgaaggatatgagcagacacttctcaaaagaaaacatttatgagaccaacaaacatatgaaaaaaaggtcatcatcgctggtcattagagaaatgcaaatcaaaaccacagtgagatagcatctcatgccagttataatggcaatcattaaaaagtcaggaaacaacagatgctggagaggatgtagagaaataggaatgcttttacactattggtgggagggtaaattagttcaaccattgtggaagacactgtggcaattcctcaaggatctaggcctagagataccatttgtcccagcaatcccattactgggtatatacccaaaggatgaacaattaatccactataaagacacatgcacgtgtatgtttattgcagcaccgttgacaatagcaaagacttggaaccaacccgaatgcccatcagtgatagactggataaagaaaatatgtcacatatacattacggaatactatgcagccataaaaaagaatgagttcatgttctttgcaaggacatggatgaatctggaaaccatcatcctcagcaaactaacacaggaacagaaaaccaaacactgcatgttctccctcatgagggagagttgaacaatgagaacacatggacacagggaggggaacatcacacaacagggcctgttggggggtgaggggctaggggaggaataacattaggagaaacacctaatatagatgacgggttgatgggtgcagcaaaccaccatggcatatgtatagctatgtaacaaacctgcacgttctgcacatgtatcccatcacttaaagtataattaaaaaaggtaactttgcaaaatatttagagagatttattctgagccaaatgtgaggaccatgccctgtgacacaccttagaagaccttgagaacatgtgcccaaagtggtttgattgctcttatatctaatgtcttagagagacatttgacatcaatcaatacatgtgagatatgtgttgatttggtctataaagacaaaacagcaagaagtgaggcagtgtggggaggggattacagcttacaggtggattcaaagtttttcttattggcaattgattaaaagacttaaggttttatctaaagacctgaaatcagttgaaaaagtttctagatttagagagcgggctttggagaacaatattcttattatgcagatgaagtctcttatgtggccacccttagaggcaatagatggcaagtgttttctattaagacctttaaaagatgctagactctcagttaatctcctccatataacaaaaacacctggaaaggtaaagcgattctctacagaatgtaaatttctctcacaaaatataactgtgcagggcaatttaaaatatgtcaaaaatatactttagggcaaaagactttgattcctctcaaggcctgctgtcatgtgatgctattcttgagtcaggttagaatttggtatcttactgctacaaagaatctgttttctgagccttaagatctgtttgaatgaaaatgctggttagttgtgcttgaattccaaaggcaggagtgcataatgaggcatttctgatcctttcttgctaacatggcctaaactagcttttcaagtatctctggaactcctttttgaagaggaagggtccattcagccagttgggttgcttagaattctatttttagtttataggacatatatgagacttatcctaatcaggggtatcagaaaatattcattgaggtaatcactttaaagttgagacatgaaagatggtcccagattcctccctgcaaaccttctctcctgatactagaagaaaagttacaagaaacaaatgttaacatttcttctgtgttcaaaattgccccccattaggaaaataattaaacttgcaagacttatctttagaaacaagtaatctagttgatttctaaagtccttttacaaacccacagattctgattagtttacagattacatagaacatcccatctaatgggaatctgcaattagctggattcccctgcatttgatttttaaatgttgaatttatacagatacataacagttcaaaacctttatgtggtacatgtgatattttgataaaataatatgtgcagtgatcaaacctggataaccgggatatccttcatctcaatcattgattatttctttgtgttaaggacattctaaattttctcttctagctattttcaaatatacaataaattattaactgtagttgtctatgtaccattttagcattcccaacagcagtaagtgaaagttcctgattttcagctttctcttcaccatttggtattgtctatattgtttattttacccattttagcaggttagcagtattttttgaatattaaatgtacatttacctaataaaaatcaaactgatcactttttatctttacttttagatgtggtttctcttcaggtctttgcccattttaaaaataaattttgtggttttgtttttgttcaattataagtcaatttatatatttgtgataaaagcccttttccaaatattggatttgcaagcaaattctccaaatctatggctgatcttttcagtctcagttaagggtttattttcaaatatctaggttagtttgtccatctatgaaaagaggataatcttaattctaaattcttagaattattagaataataatgtaagttgaaattattccagtatctggcccttcacaagttttagtataacaccagtgagaaaaatttgcagattgttctgtgtagaccagaaatcagaaggtgataaaggggcaattagatttgaataatccggagatatgaagtgtatttggtattcacctccttctatttctctatgaagacaaaatggatagatgacctctccatgtgaaatgggacacataagtttttaagatgattctgaaagacagttccttatacaatcactcaggtgatgttccaaacacagggctgtggaggggatggtggctgccggtggttgctgtcagccacagggttggtttgtttcccacaggttccagaaatagtttctaataacaaatgtcatattttgtttagaattgatttattttttataatttattttctccctgtaggcagcactcagaagtatgttctcagaataattcctgatcctctgtgagttcctggtgcagctcctggaggcaaagcctgcatgggggagggagccctcctcacatgcagccctgaggctgccacgtcacttcacccaccgttgcccttcagtcacttcctgaacacttatgagttgatcttcctgaaacatgtggtatttggcagtgtctttcccaggtaagataatacttccattctgtttatccctgcaggcacctgtccctttctggaatataaattggtttcgattgtgtggtagtggataagtggggggaggaggtttgtgtgcatcttgtcatcttccagagtgcacccctcatggggttgacagtgacaagcatgcagatgggcttgctcagctggaagatgacaggcattttggtaacctgtgaccccagtgaggctctctcgctgcaagatcaatcaggctcaggcctctggctaaagtgcagccagcaaggggtccagtgcccaaccctgagagctccttccaggtaccaaaccactttctaagggaagcttttttcctgcctggatcccatgcatgtgtttgtattttcttcacaaaggcctttatccagaaacaccccccaagagcttatagtgttttgaattcaactgaagggcattattcatgaaagccctcatggccaaagtcttcacttctcattaaaggacattgattatgggattcaccagaagctgctggcctttcacaggcacagaccttcctctacaccagtggtccccaacatttttggcaccagggaacggtttcgtggcagacaatttttccatggatgatggcggtgagtgattatgggatgaacttactccacctgcattcatcaagcattagattctcatagggagcactcaaactaggtcctttgcatgcccagttcacaatagaatttggatcctaggagaatctagtgcacagctgatctgacaagaggcggagctcaggcagtgatgctcacccgccgctcacctgctgtgctgcctggtttctaacaggctgctgaccagttctggttcactgcctaggggttggggacctctgctgtaaatgcttggagaccttaccctctgggaaggggcatagaaaaacaagtcagatgagctccaaatcaatgtacattttatggattcttgaggaaagagtgcaaagaggaacgtccccacccactttccctctacctggcatcattcccagtaatccgcttgaggaacccggggtgtttcaagatagtttaggcttgttatactaggggacgccagaaaaggaaacaattaatgtgtccatgcgggtttgtcagttgcaagttattacttcagtgcagggtattgatcacggagaagtctgtgcgtatcttgggcaggaatacatgggaactctgtttcttctactcaaatttgctgtgatcctaaaagtgttttaaaataaatgtaatgtaaaaaaagtggcaaagacattttggaagaaatgttggccacttcttagaaattatgtttagtcttaccacgtgataaagcaatcctgctccaaatgatttatccattcgattttaaaatgttatgtccccacaaggcttccatgggagtgtttgcatcagcctgattgattgctgcctttcccactctgtgaattttacttacagggtgaaagttgaaaagactatttcctatataattagagtgtatacatctttctattgcttcttttcctcaattacttaacccattttctaaacacgtttaaacctcataaatcctgtcatcttctcacccccagcacagctgcctccttcctcaaggtttctgacactctcaggatgtgggttttcacactgcgtgtcttgcacattaatatacggctgtgtcctcagatctcaggctgctcagctccatgtaggctgtgtctgtagacgtgtcccaggtcgtggtgactctgccctggaattctgtgcatatattgtttcaccatcttcaggatcaacacgttccatccactcaagcccttttccaggggcctgtcgcccccagtgtatgtagtggaaggtgaaggtgtatctggaatcaccttcactgaggacccaggtttcctcacctcagccccagactgcaccgattggacctgggaatgggcacctgtggagaggacagagaagtggttgagactccacttaactggacccagtcccctcatcagccctggaacttaggattctcttccctgtggctgctgccaccaagaggaggatcctcccggtccagtccatggtgaggtgccgtgctctgggggcttctgtaggggagggatgtggttgttgtgtgatgctctctgggcaaggacagatctgtatgtacctcggtagacagcagtgcatttgcatattcacgaggcaggtatttcatagctcaaggcacctcaacctgaggaagaagataggtgacacacggaccacgccacagtgggatgcagagctccctgccctgaactttgtttaatgatatttgccctctgttatgctcagaagtccatgaagacagaactcgttttacagaaaaccagaatctcccaggacattgtcctcaatgtcatttcttgttcatatggcaccctgacaacctgaacttttcctgggccttgacctctgcacatctaaattctgggatgagtgtatcttccgacagtaacacccattgaattaataaaaccactcttcaattcctaactataaatacatttgaaaagactagacatttctccttttaaatgctgtttgcattcaattatttggttaggtataggctacatatataatagaatacttaaagacacatcagtacttactacattcttatttagattttaggttattattgctttgaaacaaagaacattcaattcctgagagaaaacccctccccagcctcctgtgaacctgctccagggctggatcctgtgctgggtgcgccctgagcgccccctgcagctcagctcctgccctgcaggaaagttcctgtctgggctcatagagaattctcctcccagcgtctcaagcacagtatgaagtggccttgccctgactcagaatgctctttcaatggcagcaattgcttctcccaccatctcttacagtagcaaataggccttagaacacccgacataatctaccgggagacctcagcacagcaacaaggaatcactaaagccaccagggagccccttccctggagttctaggtgcactgatagggtccggacacatggcaagtctaggaaccgatgggaactttggggcagcctctatttttttttaggattctgtggttgacgatcacatcagattgtaactttacacaaagaccctatgtctcaaagcaccccccccacacacacacatacactcacagtggcacatttgcacagtaacgagactcagatttgccctccttccaagtgtcttgtcaatgaaaagtgcttccaacactggccatagtcctgcttgtgtttgttgttgttattttttccagacagagctaaagcaagctcagtattactggagatttggaaagtaccttcatgttctctttgccagttctcacctgggaaccctgcagatgccccatgagaagtaaatctaaggccattgagggagaggctgtgaccttgttcctgaagctgttgttctcagaggctttgaatcacttcactgtccttgacttgttctctcccactgcctttggtttccctaagttgtagtgtttggacagagtctgtgcattatcacacttttctctttaatccagattaatcctattggtgaggaggggaggtgatgcagtggacaggggagcagtatatgttctggaaattgacttccaatgttttcttgctgtgttttctctaggctgcaccctttacaaggagtctccagtggtacagcggattttcctccatcctccacttcccctcctggctgcagcatccacagattattttcttgaatctgaccccagttgtttattaattataccccttttcatgacacgggaaggctaagatgaagctgtctgggatggaaaagaatcccttcctctcacatagaataaagatcttgaaaagtattttgtctctgtagcatctgttaggagaaagttctgggcatatttatcacagaatagttctcctgacgacagagctacgagtgattctgtttggactctcatcttgagaacccagaattttctggagggaaattccatgatagtgtggggtgtgtggccccccaggagttcttaccccatccctgtccacacctgtcctccagacatttatggaattaccatgtttccgccagcttgtgctgtcaactgaagaatcacccaatttattgatttagaaaggggactttatttctgagaaaggattgaagctgcaggacggccatcttaacaggctgggaagcaaagcctcccacagagacattgagcaggtacttcaagacagggaaagacgagaaatgaattcatgtgaatgcgttggccaagtatacacactcagcaggctataggagctgtggatattcacatggcaggcatgctctcaggtctaataatcagacagacacgctacatgcacttcatgtttgctttggggtgaggacttaagaactaactgaattacagttgggccctgcacatcaaaagggctttgtgcaggggcggaaaaaaaacacagtgcacagcctctggaaattggtgaggccaagtctatggtcagtggtctcttttcaggagaaagttactgaaatccatctcttgtccaatcaaagctctatttatggcttgtgaaacaaggtcacaattactccatgtctgaagttccatgaactgcaaatgttttaatattgcttatctcaggaccagtgcttgtttagctgttagagaaaaacaaaaagccctgtggcagtcacaacatagtctattttttaagtgtaggggtgagtgacttaatccctgcctggcatggccttaggtcttgtttataattgggtatcttattgccacagaaagtttgtcccgtcagtgttatgatctctattttaatgtctttctagtttttgggtcctggttttccctgcaatttcatttcttcaatagatccaagaaatcattgataatcaattttccagacttttattatggtaagaatgtgggtgatgattgacatgctctttacatattaaagcagaaatctgaagtagcttcagagatcacgagtgacgtgaaacaagtagaaggaatctcatctcattaagtgtaagtggcaccacgcagatatagctcaacatacagtgacacagaagaatcacagcacatgacacatatgtgaagtttttatgattctgagcctttgcccaggaagctgtaactcagatggtactacagggatggactcagttctctctcaggtgatactgttttggaagcttatttccactcttgcactggattcagtagctgcacctgggcccatacccctaaaacaaactctcattaattaaacacaagacccatcaataagaaagttgtcccagggaaggtgcacagcagggacctctgcttttgggaacctgtggctatgcaggcagggtcaggagtgtgacccattttcttctcctccccctgcctgctgcacagacaactgaaaccaggagctttccattgctaagtatataaaatacgtgatagttccagggaaatgtaatacacatatgaaggaatgaggaacctacataaaattaaaataaaatgaatatattaaatatacaacactgtaagagataatcacggaaaagacaacaaatataaaaaacctgtgtgtatacgtgtgacatagtgttcttgtaaattaaatcgtaatttgcttatgaagtccttcaagtaggtacagaatatttgccttttgattgccacaaagatgaagaatctggcaccaagactccagggccatgctagtgactttccctcctatctcctgaggacacggtgcttccaactctgaggatcaggatactgaaattgactgtgtgagaagagaaagtgggattttctgtgggaaaagactgttttgagcataattttcaagtaataaatatattctaccaggagacacactgccatcatgctgacggtgtatgttgcttttgacattaacattatgatcatcaatattattggggtgttccctagaaaatgaccaattatcacagaattaacgagtcattttcattttagttttttttcacacttccagctaaatccactgagtttactgagtttgagcatggaaatttcagggcatgggttacaaatgatggagtggaagttttcctgggagttagatatagtttcgctaaaggagaaccaaggattttgctagaagctcccctcctggtctatcccagcacctgctcctcagtgtgccccttcctgtctgactcctaagcatctctgtggtcctggacaatgcatgtctggggcatctgtttcctagatgtgcatccacagggcaggctgctgtccctaattgttgagagggagcttagcctggatccacccaggtggccccaccctgagcactgagcttcctcccagcaaggagacagggtcagctgagcgcctccacttcacagaaattctaggaggcaaattcagtcaaatctcaacatagttttggcatgcaatccagcacccatgctcctaggtatttatctatctgactttcaatgtatgaccacaaagaaaactacacatgaataatcacagtaagttcattcatatttgtcaaaactaggaacactcaagaagttctgtaggtgagtagataaacagtcggcggtaaattcatagaataatattcagcaattataaacaagagctatcaaaccataaaaatacataaatgaattttaaatgcatattgttaagtgaaagaaacaagtctgaaaaagctacataatatgttatttatttgatattctggagaagtccaaacacacaaagtgattctgtatttgcgagaaatttaaggagatgatgaaaatgggtaaaaaatagatttaaaagggtgatgaaagtattatgtataatattataatggtaaatatgtgatatgaatttgttgaaatcaacagaatatacagcataaagggttaattccaattcacaaaaatataaataaataggagattaggaattccaggatagaatgcagacaatatagaaaatatctaatgtcattacaaatgtatgaaatcagaagaggtgccaagtgacctcagaaatagtgtagtcaataaaagaataaagaaagtgcacgtcagaactgtaccccagctgatgatgttccacaaaagagcaaaacatacacaatctggttccactctacagaaatcctggaactggactacaaagggaatagacagggtgtggcaggagggggttcctcacggttggagtgcgaggttagggacaggaatagaaggtaggtaataaacattcatgtggtattaacttagggcagatgtgtcaatatatttgcaagtttagcataatataggtataaaaattaaataaaaatagtttagatgtgtgtgtatatatgggttaatacacaacacatacctcctagagtcattacctgagaggttctacaagaaaagacagcaaattaacaaaaaatacacccagaatcaagatttgagttttggttcctttcatagcagaatggtatgcaacatttcttggaaaaatggctaatcctagggcttggaaagagaatataggagtaaagtctacaatttctcatggtacccagaaaataagaaagggttccaaaatgaagaatcgctccttttgcaaaccttatggtaacaaatataatatttataaaaagtgaattaggtaatatgttaatggagaaataaacatcattatgaaatgctatcttaaacaaaaaataagagaaaatattagtttaaaaatagaacttatagtcgatttaaaaaagcaagaccaaactcttagctatgcacaagaaagttactttacacattcacaaatataaaaggatgagaaaacatggattatgaaaatatgaaccgaaataaagctatagtagctgtgcaaatttcagacaaaatagacatcagaaaagacttttaggacttaacagggatattacataggataaagttaccacttttttttaaagatgccaaaaaagacttaacaaatatataatagaagaagaataccccattcattgtgatttacagaacgtgacaaaagaaataaagatgtcagtgacaccatgcacggaagggtgtcctggggactgtgaggcttctttgtactcatggagggcaccaccaagaacttcctcttcaatttctccctgtagccgcccacaccagccctggtcttggaggctgctgaaccacgattatgctgcaatcagtgaaggaagctgaaattgtgaaagtgaaacaccatggctggtcatgtgccagatgatgttgtgttctgcaaagtatctccaatcctgggttggatccagtaggtgcacttgggcacccaaaccggaaacagggattcttgttccttaaacacaagacattccaatgagaaagctgctctcagatgagttgcagatcaggcaggaggagatggaggtgtccttggcttcccagaattgctgaaacttgaagaccaaggccacctctgagaggcagagacccacttgagtacatggcatcagctctgtcttcaggaatctttggctgtgtgggaggataaaggatgtgatttctttctttctctcacccaacgtgcttcagagacagtaaaatggaaaattaaataaatatgttttctttccatgttaggggagagaacatgtataattcatggcaatacaagtgctcacttcagagcctgcaggagcagcaagtgcacaattgacggtcgcaagtactctaccccaggaagcagatgccctgagatcatcccgagtcctgccctctggatgccatgcatctgtgggacatgggcttgtgcctgggatcttgtagctagtgtggagagctgagcacagctccattcctccacactgtgtgacctaggatgtggtctcttcctcagagctttattctaataaggtgttaatataaaatagcagcagtaactttacctgtaacgttttaggtaggagccagtgctgttcagaatcgttaaccaccgttgctgcctccacccttagaaaccggaaaaatacctgtgtgacctgtcatctcaggcctcagatgaccacattgcagagagcacacctgctttgtttctgtcactaacattgtattggatactggaaaacatgtgtacctggttatagaatgtatcttaattaggttatattggataaaattagaattagtaggtgacacttaaaacttagctgaggggatttctaagcaaagtgtggatggtgtgttttgatttctccttgcttaatataatgagaggagatagataaatcaaagaggaaactattgaacaatgtggaatgaggtattttataaggaaggaaggctctcacatcttctggaaaccccataaacttttaaaaaataaaggaactttaagacacatttctacattctagatacatgactaatataaacttggattttagtgcaaaaagaggttaattttcacagaagatgaaaattaattagatgaatattcatacacaatctacaattttgtctttacatatttttgaaatttaaataaattgcatcaatattatgtatccttctgcaacttgctttatgtttggtttgtggaaggggagtttacatcattcattttcagttccgaatatatccaactgtatgaatatatcttatttatctgttctcctgttctgtgttgtttccaacttttaattaatattaacaatgttatattgaacattgttcatacacatgagagtttctctatgtcaaggagagagttccttagtcatagagtgtaagtatctttatcctttttaaaaattgtaaattattcttcaatctgattgtaccagtatataattccaccagtggttggagagaatttccactgatgtacattctttgtcaaacacctgatactgtcaagttttaaaatttaccatcctgatgagcattaaatgcatgttttatttgcactttcttgattactactgaagttgagtatattacccatatgtttactgctaactcaagtttcctcttcagtgaatcatctgtttatattcttcatgatcctaacagatgttctttttctaatttatttgcacgattttgcatatgtttaggatacaaatccattgtatcctagataaactgcaaatatcttctttcactttgtgccttgtcttttcactttttatggtatcttttaaagtactttttattctaatggtcaaatttatctttttcctgtatgatttatgtgtacttattgttttagaaatccttccttaatccaaggtgataatactattatcctgcactttcgaagagttttaaattttgctttcacatttttactagctttactgaggtatactacacataccgcaaaattcacacactttgtaaatgaacaattgactttaaagaattacatagagtcatgccactatcattacaatagagttgtagatcatttttatcatcctaaaaagttccctgtgcccactggcagttaattcccactcccattgctagccccatttaaccacttatttgcattctggacatttaatataaacagaagcatacagtatacagtttttttgcatctggcttctttcacttagcattaatagttttaggactcattatgccatagtatgcatcggcagtttgtttccttttaattgcacaatagtattccatgtatggccataaaacatttggtttatccattcatcagctgattgacttttggattgtttctagtttggagctattattaataatagtactggctgggcacactggctcatgcctgtaatcccagcactgtgggaggctgaggtgggcggatcatctgaggtcaggagttcgagaccagcctgaccaacatagtgaaaccccgtctctactaaatacacaaaaaaattagctgagtgtggtggcgcacacctgtagtcccagctacatgggagactgaggcaggagaatcacttgaacattggaggcggaggtttcagtgagcggagattgtaccaccatactccagcctgggtaacagagtgagactccatctcaaaataataataataataataataataataataataataataataatagtactaagaatattcatgcaaagtctggctatgaacatgttatcacttcttttggatacattcctaagtattgtaatactttttaagaaattaggaaatccttttggaacatggctgcaggattttgcattccatcagcaatacataagcattcaataagtagtctgtgctgtggttttgtttccattcagttctaactaacgtctaatgttctttatttcttttttgactcaagaattagttatgttctttacctccaaataccttgcaatttctcaaacctctttcattcaaatttaattgtgtggtcaggtaatatactttgatttattagtttttaaatttactgagacttgttttatgttttatagcccaactcataatacattttggagaaagctgcatgtgcacttgaaaacaattttgctagctttaggtggagtgttttataaatgccaaaatattgcccaataggatgtcgaacaggggtggtgaaaccaggctttcattatttgttagttattcaaaggggatgcttctaacatttcattactaaactggactgtggaaagttttcagtagatgtatgttaccagatttaagaaattattttctatttgtggtttgctaaaaatttttatgatgaatgataccgaattttaaaaaattttttgcacacatcataattatatagccattctcctgttaataaatagatgaaatgttgtcctgatgttaaaccacctttacattctatcactaccctcaacttggttaagctgtatacttttaaaaagtaaccgatagactcatgttcataggggagattgaccataaatttcccttataattcccttgtaattggataatccatatccaattttggtgaataaaatttcatctaattttattaggtgaaacagtggctgattccttctttatctagctaggcatgggaaattataagtgaaaatacagatttttggccttgccgttactctgtttaatagtctcgctttgtgtttcattcccttctgcccttcattatttcttttgccttcttaggctgacaattaatgaggtaagcataactgagaacctagaaaaatgaaaatctaagtacctttctgctttcaatataaatgtttacaactatgaattttctctaatatcatttagacctaatctcacaagtgtaaatatacatattttttaacatttttactgcattttataatttgcataatgaataacttgttatagttatttagaagacacatatttctattttctaactttaatttttgtcattgatttcttgtttaattgcactgtttgcagagaaagtcatctgcatgacaatttatttaaatttattaagcctcctttatggcctcatttaaataatttctatagttctgtgtgcttaaaaagaatgtgtatgatactcaagccaatggatttttttttttcaaattatacttttgagattttttgtaactgatcttttaaggagaaaaatatgttaaaatgtgtaaaatactcttccaaatttagtcaataatagatttctataactcacctacactaagtgtatatgcatttgaaactgttttacgttcctagtgaattatacctttttcataatatggtgcccccttcatcctcattaatttttttgccttaaaatttttatatatttaaataatgcaataccagcttttaacatttaatttttagaataagtagtacatttacttagttaaaaatatatgatgacataaaaagatacacagagagattttacaactcatctgttacatttacacatcactcacagctcccccatacaagtgaacactttatgatttctcatttccataccactttccccttctcttttaaacgcacttcatttttagagcagttttaggttcacagtaaaactgagcagaaagcagggagtcccatatgtccctacccctacatacacacaggtttccccactgtcaacatccctcaccatagtagtatatttgttataactgcctattgactttttaaatgcaaataaaaatacatcatttgttccatttctttaacagacagcattttttttaagtatatcatcactctattcatcagacatggcacctttattagcactaaaatctgctaagtatttgggtcactctgtggactgcactttgctctgtttattcacaaatatgtactatattgtttttattaaatattatatttcttttaatattatacagctaacttccctttgttgttccccttgaccttgtgttctggagtttcactttgtgataagattccatgctaattttccctgattgattttacttccaaaatctgagaaatcagctctttcatcaattttgtaaaacttcagtaatttactttgaatattgcctcttcttcattctctcttcctcttttctgtaactcctattattcatatttcctttccttctttctccatctctctgaatttcatgtttgtaatcttgtttattggcattgaattctaggtaatttcttcagttctatttctcagttcaccaattctttctgaagctttgttgaatctgtttactgtttccatataggtgttcattgtaattattaccttttcatttccacaagttacttacgatttttaaattacatggtttattttaaaattaccttgtttttaaaatcttgtttcttttaatatgcttgattttcatttctggcatatgaaaatttcctttacttttgtgtgcacacctatatgtttaataggatttttgacatatttttatccaacatttgtaagtttttagtagttcaaagtgtttcaggatatctagtttttacacccatcagttttctcttctaagaactcttaatagtcacatgtgaagtctcttattttgtaaggctttatcttttctctcactctctatttttcacccatgctttgagatcttccagtccactcatcagggtgaactggttaaaaaatcatcagctaaaagagtagattattatctttcgtgctctatttgaatctcaaaagctctttgtataaatgaaatttaaatgttccacaatagcctctaccatagttctacttcattgggtacatagtttgatgattctctcatcctgcttctggctagtaggcccctttagatgagttgctatttttcactatccacagagtcaaggtcaaatctcatggctgtgaattttaaatgatgagatccccacaggtggtgtcaggcaaagcaccctctaaacttactgacttgtagtataaaacttagcaagctgtaagtcctgcaccatgagcccctgaagccagcatcgtagcactccaatcttcctacacaccgacccacaaaagtttaaggacaagaagatttatcccaccatttcagatacttcttggctttttgtggactgaaataggtcaattaaagtttgttttaaagttttaaactttaagtgactgtccgtttctcctgtaatttctattttatgaatgtttctattttatcattatgaagaattcttctttatctaacggttattgctttttggcttgtattctaatttgtccaatattaagatcatgattcctactttttgctttctttgtacttacataataaatctttactcatccttttactttcaacctttcaaaaccactttggtttttttgtatgtttcttgcatatagaactgggttttattactgtgatcaattgtgatatttttcttaacaggtgatttataaaagcttctacatttattttttatgacagcatgactggtcttaagatatgtcatattttatgttacgcttactgatctttacagattttttaaggttccattacatatattgttcttagttttatccatacagatctttaatattttggaagctctataattttatagaactgcttatctttttaactatgaaagaataagtaatcttccatcggcttaaaaagggtatttccttactatgagaaatgtaaatgtcagcatatttactcttaattttttcctttcatctacatcatcaaattttagtcaacaggcctacatttgtaatatttcatctttccgcttacatggaaattctgactctttgcacttgctctactttccttcttttctcaatcctctcccaattcattacagttgagtcatttctacattattagcatatataaaaagtaaattctggtctgtcacagtaatatgaacgtgtattttattcttcgtcttatggttaaatttattcagtgctcaccagctgtccttagcaatagtttctccagtcattcgtagttggttggacttcatccccagcaatttcctcaagatttagtcacagaaataatttgctgtatggctaaaaaatatttgatggcatttttttttacttaaaggatagtttggctcccactttcttcatttaagtatctgatgattgtggtagttttttgtactgaaggttattttagagtctaaagccagactcatttttctccttattttgtgcactgttatacaaagtattcttatatttaagtccagtaatacaccttgatgctagccactctaggtcaattttccctagcacacaatatgtcctctaaataagaatggcaaaatctaacatcaagacttcattaaattatagatttaaatatttgtctagttccattgttctgcttttatttgggaactccatttatgccattatttatttatttatttatttatttaattttgaaacagtctccctctgctgcccaggctctggaatgcagtggtgcagtctcagctcactgcaacctccgcctcctgggttcaagcaattcttttgcctcagcctcctgagtacctgggatgacaggcgctcgccaccatgcctggctaatttttgtatttttaagagacggggtttcaccatgttggccaggctggtctcaaactgctgacctcgtgatgtgcccgcctcagcctcccaaagtgctgggattacaggtgtgagccacctcacccagccgatttatgccattattgtaatttgtttttctctcatgtcactcattttctttctaatcctaaactcacattttcacctattcatatgatttgcttttttcagttttatcttctgtgtatttcactatgatactagccagggttttgcctttgagcaatctccaattttatttttttgtgtatagttcttttcctccaatacttgtccaatgttttattagctcataattaaatacttccatgctatctgttttagtctgttctcacgctggtatgaagaaatacccaagattggctaatttataaaggaaagaggtttaattgactcacagtcctgcattgctggggaggcctcaggaaacttacaatcatggtggaaggcaaggagaagcagccaccttcttcacagggtggcaagacggaataagggaaaggaggggaaatgccaaatgcttataaaaccatcagatctcatgcgactcactgttacaagaacagcagaaaagaaactgcccccatgatccaattatgttcccctggtccctcccttcacacgtggggattacaattcaagatgagattttaggtgggggaacacaaccaaaccatctcactatgttaacatttctaacaacttttttttttcagatgggggtgttgctacattgtccaggctggattcaaactcctgggctcaagcaaccttcctgcataagcctcctgagtagtaggattacttctccaaattatgtttagtggttctttctcagaagctacttatttatttttaacttatgacagtaaatttctaaatcaaaatgctatatattccatagcaatatttttatgctaagtgctattcatgtactggttaccttaactttttttttccgtgttttttatctgatacatgcactgatgatgtgccaattctttgatacagtctaatctgcctggcccatcagtctacaggatgcttccatgcatatgtgtaaaagggacaagggtaacctttttgctttcataatccaaaaactttctctttctctatagccacagagatagactgcttgccacaaatacagctcatctgtgtaattctttgtgatatcttctccttttctgaaaccaatctgattcaaaaaaactctgctatcaggcatgatatatgtgtatctattatttcaaagaaatgatctatttttttatttattattatactttaagttttagggtacatgtgcacaatgtgcaagttagttacatatgtatacatgtgccatgctggtgcgctgcccccactaactcgtcatctagcattaggtatatctcccaatgctatccctcccccctacccccaccccacaacagtccccagagtgtgatgttccccttcctgtgtccatgtgttctcattgttcaattcccacctatgagtgagaatatgcggtgtttggttttttgtccttgcgatagtttactgagaatgatgatttccaatttcatccatgtccctacaaaggatatgaactcatcattttttatggctgcatagtattccatggtgtatatgtgccgcattttcttaatccagtctatcattgttggacatttgggttggttccaagtctttgctattgtgaatagtgctgcaataaacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaactgtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgttttagaaatgatctatttttgaaatttaaggtgggcctctcatcttcagaaactgtactttcactgacagttcctatttgctataattgaactctctcaccatgctctttgtattttctcttctctttagccttaacagcttttacccaaccttagcaactttaagcagctgatacccatattctggagttcatacatttgcatctatcttgataagagagtacagttttttacttcttgttgtatcatttatacattctacaggaaaaggggaaaataggacatcttaaacaccatgtttacacaggaaattgcctgcatgtatttttaattttgtattaactgagttttcgttttttttgtacattttttaatgtgctttcttgatatttgaggaggttgcatcttgggctacaatcctttaactttctccaatcaatttattttaattaactgaagttaagtaagtgatctttatctcttaaaataaaaagggcatatgcttcttcactcccagtactctatcaccaagtgaacttatatatatccatatatatatatatatatatatatatatgtatatataaatgtatccttctctacaatcctggctttgtttgaactattccttatatccatagtatatctagtctcccttaatcattgtttggtaccaaaattttaaaaatatttaaacttctaggctatacagcttgttagacatgtcttgtctgaattttgtgcagttttcatgattattacaaataagcgcgttgcaaatttaagcaagcaccaaaaaaaagggcaacactgaggttttcaaaggaaccccatctagtaacatttaaattacagttgcactacttccttggcttcatttgtaaggaaatctactcttaaaactatattcatacactggatagtgtagtacgaactgcaatcactaagccagcagtagtttcttacacaaaaactgttcttagaaagtattcagattctgtattttgggaaagaaatgaagtattctagcatcttgaagtcacaaaattaattaataagccctactgttagaaactaataacaaaatactgactcagcatgtaagcataagatcaactctcagaaagacctcaacatatacatgatatttccttgtcaaggaagctttccttgaaatcatagtcatatgtgcatcattatatcttgacaaaatattttattacatctatagataatgctttcttttcaggaagcatatagaaataaaaccttgttacttaaattgtaatcttgttccataatctactattaataaattttataaaacactcttactacttctaccacataaagctattattttccagtgttagattattcaagtcaaatttcatgttacattacatataaaactcataaaaacataatctcaatagttatttctagaatgcattacaacaaatatcaatttacttctgacctaaatgcttcagaaagtatcccagaaccttcaaagcttgaacccaaatactttcacttttagaagccaataaattgtagatcaccctaaaaaatatataaataatgtttaaaaacttactaatattaaaaacaaaaatacactacatactttacaaataaattatacatatgtgaaatataaaacttctctgaagattttattctcaggattataattccttggaaaaattaaaaactggcatgctttaataatttttctttaaacatgtccttcaaccatatactcaaaagggcaatgtgactggtattcataagtactgcctcccaacatactaaacacgattttcagttttaagacacatgcttgtttaggccacatctcttctaagaattggccccaacatttaaacttgataaccctattttctttcttttttttaaattttttgttcttaattttaatatagaggtgaggttttgccatattgcccaggctagtctggaattcctgagttcaaacaatccaaccacctcggactcccaaagtgctggaattacaggcgtgcgccactgcaccctaaccctcttgtcttggtatgactgattagataataggtaggcacctgcctagttagtgctcttttttgagaatttggaatgaggtctaagaaacaatatctcctctttgctgggctcttggattcgaaaattgtttaaaacagaaactagaacagcaacgttttgtttctgctcagaaaggctagtcaacatacagaaggaaggattaaacagcttacagaaagcagcagagaaagcaaacttgtttcctaatagccctacaattcctggttcctactctaagattttttaaacaaacatattattcagtttttactttaaaagcttgagaagttttctgttacttggagcaaaatagcctccactaatatacaacctaacctatacaatcacttcaagtactacataaaagtagggcgatattcattataatattcgtaagtgtttagaaattttattccatattttttctatttaaaaaaattatttgtttccataaagtagaagggacaatgacaactatatacactggcaactaattctagaatataaggttctttaggggctataaaattatagtttgctttattttattaaatattgtttcttaaaaaataaaatgccatggtatattttgaggtaaagtactcagctgaagaagagaatctagtaaaagatgcaatataattttcataatttcagtgatacttacaagggggcacaaatagcttaaacataatgtcattatttttagttttaccaacagcttatactattaaaaaagaaaagatgttattggtactgtttctttttctctttttttcttttatgctttgcatttcatctattaaagaataaactacaagaaaagtgattatttcctttggaagatttttttttcaaatcccacattcataaatatgtataggtttacactgaaatccattttcaaaacttttaggaaccaagatcagtaatgaaaaaagacaagtttgagaatagcaaagtcagacatgtcaaaaaaatacattcaagaaatcataagaagcaacattaaacagcaaaaatagtcttgagaaccaaagtaaaactcacagtctgggccaggcatggtggctcacgcccgtaatcctaacactttaggaggccaaggtggcagactgcctgagtgcagaagttcaagagcagcctgggcaacagggtgaaaccccgtcgctgctagacacaaaaaaaattagtcgggtgtggtggcacatggctgtagtgccagctactggggacgctaaggcatgaaaattgcttgagcccaggaggtggaggctgccgtgagccgagatggtgccactgcactccagcctagacaacagagcaagactctgtctcaaaaaaaacaaagcaaagcaaaacaaaacaaaacacaacactcacagcctaaaaatgtggttacactcaaatatagaattggaagttctcacagagtttctactgcctaggaataactttgagtaggaggaaaaaagttattagactccaccctgggtcaagagaaattacgactaatgttgaaacatgaaaatgtctaaggccatcatacatgtatatatgtaaagatgtgatacagtatgaataagaaatttgttaatgaatgtttacttgtaatatacattgttactaattaataataatcctaattcatctgcttaagctcactatattcagccagcaaatgatctaagctatataagacaggtagttgtctattcttttctttaaacatttcaagatataaaaatatcacatttttagctgcttagttcagtgttatcacaagggcttccttaagctgaattagcataccatcagaactaaactcagttcattctttttgttcagatgttatactgaattccattgtatgaattagaacagaccagaattttcctcccaaaatacttcatatacaactgttagcctttaatggctattttctagaataaagacatataaatgctttagacactttcaatattttctatctaataagccttttttttcaccttttatactattctgaaccagctttctccccatttttgaagtagaaaagctgaagtgtcaaggaaaggccgttttttaatctttgtgattgtttttaacatagtggcaacaatctgaaatgttctgctcatggtcagccatgagcacaaagccttttaatctgttgtgcttaatcaattctttcataccatacatttaaaacagtatgtcaatcctaaagatcttaccaaatagcactctcatatgtaggatcgtatttccaatgtgtcaaaacaatagaattatatttctgcatttcatcatattagacaatctaagtttagtatcttccacaagggtaacggggatatcttcaactggttcactaaatttatcagataatataataaacaaagcaaaatctcaggacaaggacactaattattgaatctaaatataagttcagaagagtgagtgtaattgtactaccttattagatcaaaccatatgaaattgccattatttggtaaaatcagttaagtatcaacagtttcatatagttcaaactcaagagtaaaaaattataacagtttttaatcactaaatgtataatctttttcaaatagattggcaggcctttgaattataaactcaaaggtaatagtgatgtcacaagggagatatgcatacagagatagtgatcgcttctctaatttgaaaaggagttcttcaagtctagaaagttgttatccattgatataaatggccaagtaaaaaaagcacttaaaaaagcccttgacagtcactgatatattctttccaaactctttttcacaataaatctgtagaaattcactgagttatacatggcataaccttgatatcctgctcatcccactaattaaaactccagaaaaataaaaaggaagaattccttaagaagctaaattatagggttaagttcataaaaatactaactaagaaattatatttcacctgtctaccaagttacttttcaattgccacaacaaaagttggttttgaatttctttaggctttggcctcttaactccagaacatctttcatctctattatttccattgcactgctactgtctcaggtcatcatttttaatactgatgaataaaataatctacctacggatattgctacatcagtttgtccttcaactcatgtttcacactggtgattgtaaatctaacaaaatagcaatctgagcacatttcccctatttaaaattctttaattttcatcaccaactgaaaaaaaacgaaacactaaagttactaccatcctatgaaccttccaaaactggctgtaatctctgtctcaggcctaatatcataaaatttcattgtatcctcttttggtaaaacataccttgctttttcgtgtcttcttgaaaaaaaaattgctctattcacaatttgtaatgtccttactatagcaaaaacaatttactcttcttgattcctgagactactgtttatacacttcatcagtttcctgagtattggaggatcaacagcagcattctccatttatactctcttatgtgtaagatgctatatttattcaaatattcatagaataggaattattctaggaggaacaactgtgctccattgacgtctaatagtaatactaatattataatcataccttattccatttctttgattaaatactggtatcattgaggctgggtgttctgacattaaagccaccagtaactgtagcacatcatgaatattttcatcctgcataaatcaccaatattgatttaaattttactctaaagattggcttaaataattaaaataaaaggtccataacatgtcctacctcatgtattgtaagaaggtaatttaatatactctgaagttcatcttctttgaccctttgatcttaatttttaaaaaatattttattattttacatctaaaattaaaattttaatttaaaagacatcaaaataatcattttaaaagaaaataagagtaagtttaatgtagtgatatttgaattaaaatccccacacatttcacaatttatagactatattatttcaagttaattaagtaaatatttagaaaatcttatcaatttttaagtcattaatatttgattgacattcactataaaaagttagcctattttgaccatcgaagtattcttatgactattttctaatcattctttcttgaatacaagtgcaagactatacagtatcaatttttgtgtattacctcaaaatttatatttattttcactttgttttcatcttaacatttaaaaaatcctactacaataaaatacattatgtaagccttcttaaactggcacacagaccattttctagaataatggtcaattactataagaataagggctcaattcttattcatatgttccttgtccatttctgtcacatcccttaatagggaagatttcagagagcatttaaccagaagttagttaagttcaataaagttaatattaagatgtgcagaattttggaagcaattcattaattaaaggtagctattactaatttaacaataataattttaaaacatgccagaaattcctttctacctatatactgtaattctaaattatataaaattattttacttttagtatgagctgtttcagaaaaagtagcataaatgccctcagtgatataatttctttttgtgatggctggggaccatcaagaacaaaacagaaaaaaaagtaaaaataaaaaatacaagatattaaataagcttaatgcagttatgttgggatactatggcattcttgaataattatatttattaaaattacaatatttacattaatgctataaaattttaataatatatgggtatccaaaaattaactttcaaatttttggcaatttcaaattatttactcaatgtctgattttgtggaaaaaagaacttttaaaaaagttgtaatatattagtatccatttataaatgtataatccccaagtatttacattaatacttgaatacttttttctgtttttattacattaataggtttcccaatatgtcttccattctcaattaaacttgtcttcatttaaggactgtctccattttcaccccacacattatttaataaagctcagaaaaagtgacactgttttattttaattatttgttttgcagcctatttcttctatggcacttgtataaagaaaatacatattatggtgggcatttaataaatgctgtgtcaataagtgaaaatgagcataaaatattcaaatgtacatatcagttctatcataatgtacaaattttaaagtaatttcaaaatatctaattactaataaaatgaaaatataaaataatatataatatgcgtaatatacaataaagtatacttttaagaaatgtagctagattcataaaaatcctttaacattaagcctttcttgtagcaaccagtatttatctactgctttacaagttttaaaagcataatcccttcatgtataatctataccatctgcttattcacttaatatttacatgaagattattacatctgcaagcaagttattatccaaaaaatccatcctgcctattataataaaagaaatattttccctatttcccagactgctctccaccttttattgccccactcccactaagatgcacagagtactcttcccctcctactgacactgggtattacttaaaaaaaacttttcattgtaaaatattgcctatgtacagaaaacatacatgatcaacttaatgaattatcataaaatgaacacctgtataaacagttctttgaccaagaaattgaacactgacagtagcctgacagggaaacctgtcaactattggtgtgctggtaaaagaattatctgcagagtggagggatgaggtcctgattttgagcatttacgtatttctgatttctatcatattaataataatctgatttcaagttcaagttaccaatggtttaacaaccagctcataaaattcctgaatatctaacaactgattgtgtccccatcctgccctgcatgccaaagccctcaccatgctccagacctcagctctgtgccacattcctgttcctgatcacatccccactccatccaagaaaagacagattctgtcttagtaataatttccttaatcttactatttctgccaccacttaataaaattggacaagttttataacatctctgtacctaagatttgttttcttctttattgttagggtaagaataataatactgcttgtcataggatgtcttgtgaggattaaatggatcagcgtatgtaaagaaattagactagtaccaggcccattttaatcataatcactcaaatgttagcaataattacttttattgtatactgcacaatacaaacagcatgttgcaaagaaatatatatatttgtgtgctttgtgtatgatataaatccatttctgcaaaataaaatacaaaccgatttatctaacaaatatgaaactcaatgaaaaaacaaatcccaaaataatactatttatgtaaaatatagaagctaaacaataaattaataatacatacataaatagcaaaagagtaaagcatagtaaaaaataataagcacccaagtaaagaaaagaaataacgtaaaatttgggatggagtgatttctatgacggggaatagaaaagagatgtggccacgcatgagaatattcaggctcattggtaatgttctgtgtcttaggcttactgatgtttaaatagggttcattttacatttatattcatatttataacatgtttatatattacattgatatatgtaattataccactttgtgttcgtgatgtattcagaataaaactttgaaacacctatgtgtatgcatgagtaagttcatgtttgtatgagcagagaaaaagcagcagaaggatatgcaagactggtaacattggctacctaggagagtagtaactttttattcataaacctttgtattatttcacttgctaccatgaatatgtattacctgtcctataatatttttaatatatctcaatgtttttacagttaactatatataataataatttgagacaaaagcgttaagtaaaaaaaaaatcctacttctcaaggtgagtgcctacacatgaacagttctacgaaaactagtgtagtgcacattatctttagagtgtccttaaaagaaagcatttgtttaaaatggtattgaaaaatgctgtcatttagaaaatgatacacttcaagtcagaaccttacattctactatataacaaaattaatttcaaagtattaaaatgttaaagtaataatttaaatgataaagaaaaataagtgctcattccactttcctgtcactttcacttaaaatatatgtactactggttctcttcctttccctctctttgatgtagctagagccagtgaggcctcagggacacgggttctatggagggagcagaggccctggtgatacccaggatcttatagagccagaggcaagtgagtctggaaggactttcagggtgagggccaaggagacagtagaggtcaggaggatggccagtgccaaagaaacaactggggctgaagagacaacaaggaccattcagagtcaaatctgagggtatgattagagatgactagcaatgttaaagctgagaaggttatggcatgtgtatcaaaatattggttttgtaaagtagaataagaaaacatataaatatattaaagacaataggagcaagacttctcactattgaagaagaaagctacacatttaagaagtttgaggctaggtcgagccatgtgactggaattgaaggtactgctgtgaactcatggttttaatatagataaatcagttgagatgtacctatatacatagattcaaacatcatttcctagatctgtccactaagagaatgtagaagcaatgacattcaaaaaccaagaagcacacctcacatccagatcttggtttctaaaaaccatatccaccaagcaaaccagggcttcttggaaaaatggctaatttcagggctgggataaggaaagtgtaagaaaagtcaaaaacatcttgtttcagaaagtaagaaagtattataaacttatgggcatttgtcccataatccatgtgaagggtcctactggccaaatctcgagcatcaaaataatgatacaacccaggagacagataaaccacagccctaggactaaaccaatcaggccacttgtttttgtacgtttcactagaacaagccacacctattcatttacatacagtctgtggttatttctgcaatacaatgtcagagctgactatgtgcaacagagaccttatggctccgtaagcctaaaacactacctggccctttgcaaagaaagtatgccaactgttgatataacacattgaatacatgagtccatactgatataaaagatgatagacagatagatcaataaacagacagatcgatagatagatatagatagacagatagagtggagtagtaaaacaagttcttccttacagtagatatgccaacttaatcaatgtcttagaaaacatcatttgtcagtcatcataataaagataatttttagtaagaatcatcagcacactaaaacaggcaggtgaaactttgttgaggaacaggatatttatatagtttcaatgtatttctccatcaaatacttcttaactaccaaagagaaagaagtgatttttataatgaagaaacctggaagataataccttaatcaaatgtttaaagttgacatcacttgtaaaagcacaactcaacatcatgtgtctccttgacataatacaaggagacagacaatatgacttctgtgttatttcttgtaaaaatgaaaaacctgcatcatcatgaacaaatagaaaattcaaatttaagggtattcgaaaaaataactggtctgtattcttcaaaaatgtcaaggtcctgaaagacaaggaaatagtaaaaaactattctacattgaagaacattaaaagtaacaaggcaactaagcacaacatatggtcctcaacagacttaggacaaaagaatttttttcctagaaaggaccttattactgtaattagtgaaatttgagtgggggtctttgaattagatgatagtattgtattaatgctaacttcctgatattaatggatatcctctggttatttaacaaagtgcctttacctttcaggaaatacacaataaagtatttagaggtgagagggtatcatgtctacaatttattatcaattgattcagaaaaaaatatgggcatgtgtctgtaggtgtgtttatatatatataaaaagagcatgagagaatagtaaagcctaaagtggtaagatgtaaaatattgagaatctactgagggacatatgagaattctttgtgcaatgtttgcaactttgtaacttttctgtaaattagaaattaatattttaaggcagaaattattatgtgtgaatatatgatttgtttagactagagaaaactctatcatagagtagcatttaagaatgagatctctgagtcagatagatatgatccaaattttggtgctggttggtttgcaccaactttcagtttcctaatctttaaaatgaggatgatatcaaaaacaaagttacatatagatgcagtcttatgtatggatatgaatatgtctatttatctataattatattatgttttatatatatatatattactaaacaaattaacaggtagagtgcttggcagaaaaatccaatacattttaggcattaccaacttaaaagcaatggaagaagccatagaaggacaaaataacagatctgaatataaataacttctaaagccccattaataaaataaaaagagataaaagtaagcttgtataaatattaaaatagtaaaatgggaggccgagttgggcagatcacgaggtcaggagatcgagaccatcctggctaatatggtgaaacccctctactaaaaatacaaaaaattagccaggcgtggtggcaggggcctgtagtcccagctactcgggaggctgaggtagcagaatggcatgaacccgggaggcagagcttgcaatgagcccagatagcaccactgcactccagcccgggttacagagggagactccatttcaaaaaaaaaaaaaaaaaaaaattggaaaatgctatttttccttatcaaagggattattataaaactataatattcaatgttattgtgagcacgctaaaggaagtactctaacatactactggtaaaactaaaataatatgacattcctgaaaaaaatttaaaatatttgtcattagcccctttttcagtaattttaaacaaatcaaagatggaggtaaacacatatatatatgagagaatcctctaatatgtataaaatcaaaactttagaaacaatgtaaatggtacatcctcttacattactacattgagctgagaaaaggacaagatagaaaaattgagaaaatctcaatttataattaagaagtttaaatatttttatatatgtatgcaatgagaaacactggaagaaaacatgccaaaatcgtatcagtaattattcttggggtttgggccataaatatatatcttcttctgtattatttattttcttttttttgtataattagaaaaactggctatattttcaaaacaaaaaagatatcacagtgaagaattaaattagtttccactacagtcacaacaaaggataaatctggaataaaaatatgaaaacatgtaacaatctgaaaatgttgaaagcaactgatgtactagaacacacttaccaatatcatttaactgtttttaatattataaatgtgtcttcctgaatggaaaaaggcatacaggctaaaataaagactattgttgctttttacctgattttattccaaaataatttaatattgaaaagccctaaacttctttaccacaaacaattctcaatatgtcagtttgctacataagaaagaaaacatttcagtgatttcatagtcatgtacacggctcacactttaacagtactcagaatacagaatattcataggcaaatgtaaatacagtggaagtgttatacatacctaatcctttaggtgtaatgccactactgtcagcaggattaataacccagtagtaatattttaaggtgtgcattatctttaataactgttcctattctgcatatggtggtgtagatggtagcagttccaataaattcagcagacaaatatgtatatagggaaagttgaacctaatacagaatattaacagatcattaaaatgaacttaaaatgcctcaagtgcttatattataaatatgcattgttttaatttaaacgcaaattagtaaaggccaagaaatgatcatttattaagaggttaaaaataactttcttcttcaatattatttatattttaaaaatatatagccaggcgcggtggctcaggcctgtaatcccagcactttgggaggctgaagcgggtgcatcacctgaggtcgggagtttgaaagcagcctgaccaacatggagaaactccatctctactaaaaatacaaaaaaattagccaggcacggtggcacatacctgtaatcccagctactcgggaggctgacggaggagaatgggctgaaccagggaggcggagattgcggtgagccgagatcgcgccattgctctccagcctgggcaatgagagtgaaactccgtctcaaaaaaaaaaaaaaaaaaaaaaaaaaaaaaaaatatatatatatatatatatatatatataatctgcaattaacgttttctaataaacttattataataaggtagtctaacagctgtggcaattaaataattttaaaatgattaatttattgaaattaatctgataaaaagattaaaatattttaaaagtcaactaaagctcttaaagtatatttcagtagctttcagtgtataaatttcttcatagcaacagaacatcagtcagctaaagcctatctgaaaacctatacatttttgtcatatatcctaaaagttcatgcaatttcaaattctcctcccctgtggccataatatatatagtttgctttcacaatctgaccatgtgagcacagagatggcatgtcagacatcttgcttaaaagagttctcaaaattaagatttgggcttaggcaataataaataactcagggagatattattaaactgtaaaagatagctcaaaatcaaaatatccctcattattgatttccactaagactaaattctggtatacaaaataataagaattttctgttattatctggaaaaatatttatttcatgtatatatttatttttaagtgagtattatttacatgtaatgatataaattctgccttcaaaatgaaagcaattttccagcaaaatgattacagtcataatacaattagttatctgttctctttcctagtctttcaaaaattggtatagcaaattctcttcattggaaaagtatgtatcacatctaaagatgttagaatgcagtgttacacaaagattcttttttacctatagtttcatttattttactacttataaatattttgatctcctgatactgcctaacacaattgctgcagattaactataaaataagctaaaatgttcaaatgttttccactggatactttagatccagcaactataatgtataacattacactaaaacaaactgaataagtataaaactcatacctttgcaggtgtatgtatccagatggctgggttaataaacaaaatatgatcacaaagctgcttcagcaaaggtactccatgagataaaccatcaaggtattttgcaaaagataaaaattgctccaagacaggtctagttatatgaactcttgatgactaagaaagaaaacagaaattctagcttgaaatatccagaatattaaattgtataatttctgacttagcataagcacacatgaatttttcatatgctatcactaataaatatgaaatacatttatattatttgctattaaaatataattttattaagagatctaaaattttagctatttctttgagtgatagcttgttatttgaagcctaatctaagacaattacagataaataattcaagttaaataatgctactattagctaaagctaaagaaatgaaatgttataagaatggcttcatttcattttttgtagaaattgacatataagaagaaatcttagacataagaatagagattgtttaaaacatgtaaaaatattgcttaaaaatatgtaaaatattgcttaaaatattatttccttggtctgctcttcataaataccgtatccctggatgatatattatgctttcacagcttcatataacactatgtctatgctgagtactcacttcaagaattttcaactgctatcaccatatacctattaccaatggtatttaaacaacagactctccaaaattgaaaccaaaccttaaagctgcaccatctcatacagtagccagaagccctatgtggcaactgagctgctggaatgttgcaattgaaagtgagatgtgttgtgagtatgaaaacactgggtttttccagctcagaatatttttaaaaatcgtattttcttattgaatagatgttgaaataatattttgcatattatcaaaataaaatactagactaaagacattattaagattaatataacctgtaattttttactggaaaatattaaattgcacctgaggtttgaattgtattttaattggacaatgctatcctagaatacaatttcagataaaaatgctatattaaaaaatgctcttcacaaaagctgataattcaaactcaaacttcaaaaaatatatcttccgacacaaatcttttcttcctcatctagtgatacagttttgtagtatcactatcctttcagtcatagggtaaagaatcatgtaccactcaaccctaaagcacacatcacacaacacatctttccttcctattcttcactgactgaagtctgaatataagtttaagacgatcaaaatttaaaagggatgaaactgtcttaccaattttacctcccatatgatttagctatatttctcatgatcataaggacaactcaataaatttgacttaaacacatcatgaattttcacacttctacataaaaggtcacaaactaaaatgattgcaaataactaacaacaatgtgtaaaccagtgtaggagacaaaaaagagtggtgaggaacaaaactaaacctttttgttgagtcccacagaatattactgtgggccagtttcacccacaggacacattttcttcccctgctttctctgtcttgctcccccagtttgtaacacccttgcatacatttcctttaccttaaaggtagagctcaagacttttattttagtcatttagaaaatatacatgctgattgctcactgtcagtcaaatacgctccctggcactgtcaaaaaagcagctaacaaaattgaagtaaaaactctgtctcacagaacatattctaagagatgataaggcaggaacacagagtaaataaaataaaaaggtacaatatgtaacatgttagaggttactaagttcaatgaaagaaactatggagcagataaaacatttgtagaagaatggtgaacaggttttactaagaaggggcatttaattggttcaaattattataaggttacaaataatttagtattaatataatagaattctttgtctgacaaaattaccaatggtgcttacataagcaatagcctacaaaattcaaagcaaaccttagtacataattttcactgaaaattttatgaaagatggtggaaatcaatctaaataaatagctgagttaataaaggaggggaaccaaaacaaacatttgagtttaaaaagtaaagattgagtattcatatttaaaggagtatcagtgaaaataatatagtactttaaattaaaaatattttatttgtaaaggaataaaattaaaataagagatcaatagttatttaaaacttcagccagctccttcactaaatataatttcacatagcttatcttatacattctatttttattcagtagtaatgatttcaagaacatgatctgataacattctactctcacacttaaaactctaaaataaaatacagtcagatcctgtttatagataaacatactatgtgaccagactgtagctcataaaaattattcatcatgtccttataaagaacattaacctgtattataaaatcaggctgaccattataaacatatccacttgatgaattcataatatagaaacaagtttggaacttggaccatgatattaaaaggtatactaaaagcatcacaaggccttccacattacttaaaaaaaaatgggggggcctgctgttttcacataacaattaatgctgttgggtggcagattttcattctaaaattattctttagaaaatattttattgtctttttattgatctcctcaaaatcctactattctggattataaatagtgtataaatgtataaatgaatattctcttcaacagcatgttacctttacctcttagaagtacttattcctccttccttgtattattgttagtaaaaaaaaaaatctctctttcgtaatataagaaagaatattatcttattcatcttttgtcttcctgatccctaccctaatttctcagggaacatttaactgaaataatgtcaaattcaaaaatggagtaagaatagaataggtaggaaaaaacaaagcctgggaagagaagaaagaagattctaactctgcttttaaatgtatttcatttgattaacagtttcaaaatatttttatattttggtatttgttttcattttctcaagtaaaactactttaaaaacagatctacacttggataatttatagttataaatctgtaacctttagatggaacaatttaaatctcatagaaaatgtaagccctggaatttgatctatatattaattttatgtggtgacagaatacataatttttaagaagtactataatgtgacatggctaaccatatttggaaataatacctgagaagttataaaaatagttgcattatagcatccaatccagaattaactaaaccaaataggagcactggcggttacaaagagaaacttctgttcaataaagagagattgttccaacatttagattagcctataatggaacaggttatcagaaatgttcatttttattgtagaaagcattatacatacacacacatatacccataacatgtatgattatatattcaataaattgtgtaaaactattttaattgtagaggtacaccatagtctattatccattctgctcctcccaggactccaaggttgtgctccaaatagcctaatccaaccagattaatcatttgttgttgttttggtggagtgatggggagggtggcaggcaatgattagttcagagactcagtatcaaagtgtagcatagcaacaattgattcaaaagaaggccagccaagctctaagctaaccaatcaaattggagagaagaatcttgctcagtaattgacagaaaggagcttgctttcttcacctggatgtgaaggtctatagcactaattctctctggcagccttgtgacctcaaacagtatcagctttagcataaaatcaacactgtagctggtacagcagagatatagataaaacctgggtctctgatgacattattgagactcagataacccagccctgaaacacaacttatgtttgctgcttttccaaccttttgctgcctttccaacctccctgtcctgttttaatgcttgggacgctcccttgcctactggtttccagttgagtttgactaattgaagacattagcaagaaattaagggacagaaagaaaatgaagttgggtatacattttccagattttaccccttcagtacacttacactatactcctttcttgaagaccacagtcccatcaggcacccttcttctatagctacaataactttctctttgggttatgctaaacacttattcccctcatctcttcaaatcttcccaagctccctgctttcaactttttgaatacccttgcattaaactcttctcaaaaacctaggttgagtacaccatctgtttcctgccaagaatataactgatatgccatctaacactagactttgttacattagtatattttcttaatgtttaagatactttgaatcaaattttctactaaccacaatcaaaaatatcctattgaatatactggataacctctaagttttccacaagatcatattttggcaaaacaaaacaaaaacaccttaaaattttttcatggaacagtaaaattgttattaataaaaggcctcgcatatactatcttcctaagatatcttctatgacaaggagatataaaagctaagtggcattaaccagtaacctgttattaagttaagaaattaaaaaatcaaacttctattacctatactattaatactaacctggccactgattatttaaaaataacacaatatgagcattcctctgagaaaggtaaaaaagttactgtttcttaggtaatcagacaagcatgcaaggacatttcatatactcaattcaacaactatttactgagcccagcactgtgctaggtgctgaagatataacaataagaggagacaaaaaaatatatatacatacatatatatatacacatatatatatatatatatatatatatatatatattgcccctgctttcatgaagcctacattctagcaggaggaggcagaaaattggtaaaaaatataaaacacgccagaatggtgctgtaaaattagcagagtaggtaaacactgatggttatggaagggatactaatttatttagaatgatcggagaatatttctgtgataaggcatcatacaagcaaaatcctgaatgaagcatagaatcaaattctgtgagtatctgaagaaaaagtgatggaaacaatgggggaagtaaatgcaaaagtccttgggtaaattcttatcattttagttcttaagggaaaggcaaaaagacctttgcctaaaacagagaaagcaagagagtggggagagatgatgtgaggtgtaaggcttatgacttcattatgagaaggatgaagacttgaataagatttggcacattttaggacaactagtctaactgcaagtgaaaaacggactgtaggtaaccaatggtgaaggacgatcatgatttgaactaaaatggtatcaacggacatagtaaggagttgagaaataaagaggaagtagtaattgattctggatatgttttgagagtaaaacaacataatttcctgagagtttggatctagagtgcaacaaaagtagagtcaaaaacaattaactttttggtttcaactacttgttgaatggtaatgccactaaataagacaaacaactctgaaggatgaaaaatttgagagaaaaatcagtctggataatttagtcaagaagattactagaaatccaagtggaactaaaaataggagaaacaattgagggtaattagtatttacaggatcacgggagctgtagaagtggataatctcaattagagtaaggtactgtgtagatggaaaagtgaaatgctttccaggattaatcactgggaaagaagagtcatcagaatttataaagatgaaggagaactaatgagagagaataagtaagagaaaaacaaagcaaaccatggcaaaacacaatgcaagaaagcatttcaagaaggaaagactgttcaaccgaaatattcacaggtcgaataagataaggactgagaaataatcacaggacagactgtgaaggccactggtgacaaagacatgagccatctgaaaggacatggaagaatgaaagacaggttggaataggaatagatttaggagtaagtgagtgtccaggaatataaggaaggtttaaaatctgaaaaataatcaatgtaattcactaagaaaaatgagaaacatcatactcatctcaaatactgcagaaaagatgtttgataaaatcctgtttataataaagaaaactcttagaaaaatagaaatagataattccttaatttaactaaaaaatctacaaaaactaattattaaaaagatcatacttagtgtctaattattaacagcattgcccatgagatcaggaataagacagggatggccactatcacaacttttattcaacactgtactggcagtctttaggtggcataacaaggcaaggaaaaaaataaaaaaataaatattagaaaggaaaaaacaaaactatcattctccgatgttattattgtctacaaaattttttttgaaaaaaatctacaaatgactagatttaatagaggaatagaaagattggtatataaaagttcaacataaatatcaattataatactatgtaccagtaacaaattaaaaatcaaaacttttaattgcttcttggccttttgggtaagatcaagtgcaaagaattaaaattttaagggcatcaaataatatcaaatatctggaaataaatccatcaaaaagacagaaactgttctatacagaaaactacaaaagaaaatctaaattaataaaagaatataccaagtatatgacttgaaagattcaatataggaaagatgtcaatataatacaataaaaatcctcatgttttttggtggaagttgataagctgacatatatggaaatgcaaagactcagaaatggccaaggcaatcgtcaagaacaacagtaaagctagatgacatactcttaaatatcaggctgcactaaaaagctatacaaattaaaatactgttggaatattacttagcaataaaaaggaatgaaaaaaaatatgctataacatggatgcacactgaaaacattatgctaagcaaaatggaccaaatacaaaaagacaaatattgtatgatcccacttacatgaaatatttagaataagcaattcataaagccaaaaagtgaattatggattgactaggggtgggaatcatgaagagatatagggaaaattggtaaaggaaatgaataacaaagaagataaaatattcattttccataattatatatgaaaatgtctaatcttattcaaaatctaggaaaagtgcaaattaaaaccacaatgaaataatattttgcatccactaaattgacattataatatgaaatattaacatacatttttatttgaaggcttttacaaatatttctaattataagctaagttttaagtaaaagaatgtttaatttaggattttctgatacattctcaagtaaacaaatgaaagcacatttaaaggggtaagtcctcacagaaatcctgtcacacacagtaatcttacaaaggcatttcatatgttatcgaattcatgttaaatgtagcttatcatacatcttctaaacaattcttaatactctagatacagaaaaagagtattctcttattttaaaaaataaaccaaagagccttaagttcttaataatgttatggaaaaaatcatctcaataaagaaatgctaccaatgatcaatcttaacaatctaccactcttcaatgcttaatccttaaggaaaggtcagcactagtttcaaagacatattttttatatatataacatatatatgtataaagacatgtaatatataaaatatagcatattttagaacttgactctttttgtgactaaataatattcaattgcatgtatacactacattttgtttgtccattaatcaactgataacatttcaaatgtaaaacaattggaggtaaaattaaaactgcttcaaagtatgttctcaatttttttccagaggaaatgtatgtttatcccttagttgagatctcacttctattacttttcaaatagtctcattttcagagcagctgaatattatagagttaactaactgataagaggtttgagagtgctaataaagggcacaggtatttgtcattaaaaaaaaccacaacatgctggctggacgcagtggctcacgcctgtaatcccagcactttgggaggctgaggcgggcggatcacgaggtccggagatcgagactatcctggctaacacggtgaaaccctgtttctactaaaaacacaaaaaaattagctgggcgtggtggcaggcgcctgtagtcccagctactcgggaggctgaggcaggagaatggcgtgaacccggaaggcggaggttgcagtgagccgagatcgcgccactgcactccagcccaggcgacagcgagactctgtctcaaaaaaataaataaatactaaaaaaataaaaaataaaaaaacgcttattcatgaaatctcactaatttttaaaggaaatcacatgatacaactaaactcttgtgagatcataatcagaaattcagcactcataaaagcacagctgtgactaaagcaaaagaggtcataaaacaacataaatgacacaaaataggaaaatgtaaacccatctaatttttattgtttatactatgtatagatgaaaaaaactactttaaatagtcatatatattaagagtagggaaaaagagcacaaaataatgtttctattactacaaaataaaaattttgaccgcataattaaaaaataacacaaaacctaacaggtaaatccatgtatactaaatataaagatttttatcttaataaaaaagactttcaagaaacagtctaaggccaggcgcagtggttcatgcttgtaatcccagcactttgggaggccgaggtgggcagatcacttgagatcaggagttcaagaccagcctggccaacgtggggaaaaccctgtttctactaaaaatacaaaactttagctaggcatggtggtacgcacctgtgatcccagatactagggaggcttaggcaggagaattgcttgattgaactcgggaggtgggggttgcagtgagccaagatcgcaccactgcactctagtgtgggagacagagtgagacactgtctcaaaaaaaataaaaaataaaaaaaaaagtctaagtgaaaagatagcaaagaaacaactacagtactcacttcttatccggaggcgatgcttccaagacccctagtggatgatatatacgattttcagtctgagaactgagatagctactaaatgactaataggaagacagtgtatactgcatgaaaaagctgagcaaaaggaggattcatgtccggacttgatgaagagagacagtacgagatttcatcactctactcagaacagcacacaatttaaaagttataaattgtttattccatttaatatttttgaactgcagttgtccatgggtaagtgacaccttagaaagagagagtagaaataaaggggtactactatagaaaaacttaaatgatacttattgcttgaatagatatagatgaaatttttttctttagttttttaattcaaaatttaattatgcttccaatacccagttaattccatgtctacacttaaatctaagatgtttgtgagttagcaaatagtataatctctacacagtcaatggaaagtgaaattatagaaaaaatataattagtgattgtcagctgtccaactgtgaggctacacaataaaaccatcaacacatcacctaccgtttcaagtaattagccaataactaaaaagccttttccacccagcacctgttcttgcatggctactgaacttttaagtagttcaaccaggaatgccgaaagagtagcactgcatgtaaagtacagatatcattatgtaatcatcacgtttattctaaacacagtgctccatttcagtattttattatgccaagagataaccatattcaaatctaatctctattttattgacaatgactattatgccttatattatgaaagaatatatttcctgataagcatgagaaaactagtgttgtcctttacaaattaaatataataaactgaatcataactgtgtagtttttttacattccaaagtaaaacatcaaagtttatcgctacatatatttataggtctggcttcaagtaaacctaagaaacatacacatatcattttccataataaagactgtatcatactattcttttgaataacaagctattgtagagaattttaaatatagatgcaatattgctttgtaagaacaagccctatttttaaataaacttttcatttagaactattcttcaaaaacactttgttaaaaaaaatccagaggaatatgtaacatgtcacttatgtccaggtatgccctaagaaaagctcatgagagcaaagaaatgatttatgtaatattgaaatgaaaagtgacaattacacagtatataaacaaatacataaaggcagacaaagaggcgtcaaagatttagcacttggtatgtctttggaatgaatgaagaaacaaaatagaaagactgcattgaattaagctttgataatatattacttcatagttacatataatgattttaaccagcaacactgatatatgaatatagtattctgaataatggaaatacatattccttcactgtatatgcttaatgtagctcataataaattgttatataccagattttatcaacaattaaaagaatatcaatttacaatgttttataatataccctaaattacctatttatattcataagaaagggtaaaaccacaaatttctaaacatattttaaatgcagaagtactcattcttacaagtaattcagacaatttggtaataaggaaaacttgaaaattattaaagcccgaaaggaatctgaagttattctaatttttgaattattctagctcttccagtttcaatagggataatgtatttttctcataatgtggctacttttgttcaaatcagaaatgttctcataacaagaaccaacagcaaaattatcattgtcattattataaaaattgatagtttaatgaattacatatcagctagacaaaatatagtatccagaaataaagtacttcattataggaaattaaaattcaattatattaactgaccctatatccttaaaccacaaaaaatgtaaactatcacatatcaatgattttttttttactttgtccttaagccaaagatagacacttacaagaaaactacaactaccaatgagtctcttgggattttaaaaaacgtttctgtaaagaagcacagctattaagcaatctagtccattttaaatgaattgaatagtcaaggccacttcacaaataattgctaagtactatattacacataacacatctgcctagatgtgtaaaaagaataaagaaaaccatgcatagaggttacacaatttcctaatctgttcatagaattcttacatacaccaaagttagtgattgagggaaaatggattcctaaacatgagcactgccaaaaagaaagactagaaatgcctcacagtggtccttatgatccatgaaaaaaggcaaaaaagtattttacagtaaatcaccctactatatagaaccatatacaattgcaaggatgacacagattttctcattcttttatgtcagaataactactcattctcaaatatctaatgagttaactcagacctctaaacacagtggagccctattataaaaactgaaatattaatattattattccaaaatcttaacaagactctgctatccatgaagtattaatttcacttcaacattaactaggacaccaattgaaatgtcaaatgcattcactaacaaaggtagtttcaatttatacctaaaacccaatgcaatagcaataccacatctttgcaaaaaaaaaaaaaatctttacaataaggtataattgacatggtggacgtaatagtaaatagatggccatcttcgaagaggtacattttcaaacataattcaacaaacttaccaggaactaaaatgcatcggattgttgcagggctcacaataaacttgcaaaattctgtgtactgccatacaaaatttctctccattcttgcctatttccaacttccctagatacaaaggcaaatataaaagatacttcagcccattcctatatctcctacatacaacttcctgtctagaacgcatcagttcatctgcagaggatctaaatatatactccaggataaaccaaaaagcaagtactggtgtcagccaaaactaatacaacatagaacactctcttgaaaactatatcaatacctaggaaaagattttcagaggagtattttattttatagaccaaaagtatgctgattattatgtcatgatatgtaattgctcaacttttcaacagacagtactataacacatgttctataagtagcaattctacttcaggaatggatgagagtttgtaatcctgtatctttttaaggaaaatgatgctaataatctagtgggtgttttttcttaaaaataattaccatcttgtaattcttaataagcttaatttgttagaaaataatgtttatttcaagtatcagatcgtaaagggttagaccatgggaaaaaaatgaaagaaatagcataataatacctcttgtaaattagcatatttattatttctccagagctttttggcctttattgataaagaatgccacaacagtcttggcccacaaatacctgagaatatttattaactatgtataaaaacataactaacctgtttataatatacatatatttatatgccattaaaatttaaatatagattttgacttattttactataactttatccatttcaatttgtatttaattttttaaaataactaatgtagatataactcatgtaatgtgatccatgaagttttattatttttgaggtacttttattatttagaattcaatatatcataaagatacacctaattcataactaaaatgattaagagtgaatatataaacctaagttctgttcaaaggtagctctctgaagacataaactggctattcaatttggtttttactgaaaaagcaaagtaccacagctagattggctttttaaataaagatctttttattaagaagactggaaataacttacgtaaaaagtaaagattccccccctaaaatccaatacctcctccacttttaaaagaatgttgcaaagtaatcaagtagattaagtttcaaatcggatttacggttatcagtaagggggaaaaatcttttgacattttcaaaacgtttcatctcttaagcctaatttaggactgaattacagtgaaatattttaaaagatgattaaaattacgtaaaatatttaatatcacagtttctatagtatttctctcactacaaaactcttcctaaataagtgatcatagcagaaattgacttcactgtacattaatcaattcaattccacacccaaaacaattttgcatccaagataattttcagtgacacaaaaaaactcacagtaagttctaagagttaatttccttcacagttcaacattagaaagggctaaaccatatgctacaatagacctcatgtgatatttccaacatgtgggttatcttagagttggtctatgatgattttctcttcccttgagaataagtcacattttcctgaccatttttagaataagtacttttggattatatgctaaatagtgtgactattactctgtacaatactgtagagaaactttctggccagaaagtttcctataaaagcaaaaaatggggatatcagtccatgcagactgactgttccatattttgactaccctcgcctgcttttattcaatcttcacaatcctcagatagatgttatctatattatgtgcagagtttacaaatggttatttttgagaagatcagtttgttaggagctcacccctctatacaagtatcagaaatcctctgaagtgatttttaatttgaggttgtgttatactttttctcttatcagttagaacttctttatgatatagcaaattataaaaactattatactatcatattcataaatgaaggagagaactcaaagctaaattttcaaatatctggccatgaagactaactgcttgccacacgggattaacagaacaatgagaaaatgtctagtaataattataaaatataaaaactttgttaaaatctgatttgcaagcttatgtcaaagggccacctcatacacaatcttgaagacattaaataaccccaaatagccactgtaaacttatctggcagtaaattttactatactagacaaatctacagtgagattttctgttattttaaatattttctgtatttctgtattttccaaaatgaacggtttatttagttaataagtgataccctaacttatttactgtttccagaaaataaccaagtacagaatatatactgataagctgcaatgctcaaaaccaaatatcaacagaaaaaaatttacctagcactacagtgaccaacaagtcaaaatcatttgtgacaggctccattgaatatatagtttgatggcattatttgaaggtagaattaacttattttattaattttgaagcccatatgttgacatgctatctacactaagctcagaatcataaatattgtctgaccattacaatgaaagttccatataactgaaggcaataaatataaatactaagttattatacaacactaagtaacttaaactccattttgtgatttatccaaatgtccattagttaattatattctctacaccttaaaagttccgctgtagccctctaccccccttcactcacagagagtgactttagcaagataattttgactatgtgtgaactactcagcttttcttctgtcaaaacacaatctgatcatttgcattcctccttctctatgttctctgaatttctaaaaaaaaaaaaaggtttttaatataaaaaatttttgctgatgcctgtcatggtgcaattgtacttatactatttacaaattgaggaaatgcatgtacctgtggctttatcaacccccactaacaacaaggggtgcagtaagctgagaactttcaaaacttaaaaaaatactctctgatgtaatgcccaaatttacaggtatctctcttaaaagttctgactttaggtactctacactgtgtgttaggatattaaggatacactacgtcacatgagctgtgcacgtatgatgaccgggttactgctcattatcactgttgttaaaaagaatgacgagaaagacgtgtgaaaagaatactacaaactacagagattgcaaagctgttcaggacaaagtttgcttctctgtgaatagaagaattacaaaattgcttatattcagcccttttccttgatgttgccaggaagctcccatcaattctgaaatttcacattagcaatcatattggatttgtattttcttgatactctacctttttatatttcatttgtttgcttgtcactctatttaatatcattctattagagcttaaaaagatactgcaagcattttatgaaacaactcaaagaagtagaaaagaaaagcaggcagcatattaataaaaaatgtgaattacaaaaatgttcctatgcaagatcagcaatggcagaaccaggatgcaaattcgacaaaaagacccatgaaagaaaaagtagctggacaagcacaaattcatttctagagctagtaggacaaaaacaaaaatgatatggaaaatatatgatagcaagtattgttaccttgacataaaaataatagcattattatccttcaatattatcatggttattaaagtcactgagaaaaaaagatcttttaatatgggtaaattcaaactttcctccctcgctctatatatatatatccgtgtgtgtgtgtgtgtgtgtgtgtgtgtgtgtgtgtatatatatgtatatatatatatgacaaaaataaaaacagaaataccaatgcaaaaatacagaggccaaagagggaatttttttatgtttttcctttccattacacaatcttcacattaattaaattgagttcaataaaaaaaccacacttccgtacaagacaagtactccttcagaattataaacactttgactataatgtgtaattctctttcagctctaagtagtttgagacttcacaattcccagtgtgatttaaacagaacccttatatgttcccctagccaggtgtaccgcacatttaaaactaactcatatacgtgcatgctgttatcttacctagtctttgttcttaaagtttaaaaaacagaaagaatgataaattacattaattagttttgctaaattagtttactcactactgtacctacttcctcactgcaattaaagcaaaaatataaactaaaattaaataatttcaggcccatgaaatatattatcttagattccttctaaatctttaactcttctttccaagttaccagtaatattaacaagttctttattatgttcattatgtaatatatatttcaaatttttgtattttaaatactacattaagcaaaacagttttataagattatttcagaattgttaaaaggcatgctatcaatattagaaaatattctgaagaataaaaaagtttataaagagaaaagagttgagaaaaaagcacctttgaaccgaaaagaaacatataataaaaactgactacattccaaaaaatagaaatgactcttaaactgtattaaagaaagattttcactaaaagttatattacatcacattttacatctaaaacgctctctagaatttataaaattacagttattactaccttatatctaggtcctaactgatgaattgcaaatatctgtgctgggttgagtgcttcactgaacggcaacaagttgagcacagaatacgctatttgcatcagcagtttctgatgaaccacgaaagcacttgtcatagctctatttttaaaagtcattaaaaatgcattatttttaatgatgaaaaggtttaaatccttaaatcggcctttaggaatattttaaaatataacaataataatagaagaaagcatcaattaagactttattatttaaataataaatgccagtcaagttttttgggaaaaatgaccaattacatgttttacacttacatttaagcaaacaaaacaatagccacctactcagtcttccgacttacttttcaaatattatagttaaaggcaaaatagcttatatttatttatttacaaacgttaaaataatttaaaactgtcatgatgtataatgatccatatatagagattgatctgaatcaagggaatgactattccaaaatgtaatcatgaaaacatagggtctaattttttaaattcaactttatttttgaaattatgaatctattcctctactcctccatatttagtaaaacacacaaagaaaataaatccccgctcgtgtgtgagtaggaactacacagaacgaaacacacaataagactataatctgctgcttaaagcagatggtacagtgctctccacattgaggaattcagcactgaagaagtcaaaagcttaagatctttccagcctctacatcttacaccccacccacccaaaccagggaaagcagtcatggctcagttcccttcccctatcctcaaaggctatttcacaccttagaatgaataagcaagaatcatatatgtaagaagtacttttggtccttcaataaagtaacaaaaagaattgtgaatgcatacaaaggcaaaaagaactgtcatcattaaatacccaatctttaattagaagtataggaacttaaactttaactgcataaagtatgtgtcattatctagaattctccacttcttagggcactattacaaataaccaaaaaacgaagtcttttctttccaagatactgtcttctcattgaatgagtcaagacgaccactgggatttcttccactctataataaaaagactctgcagagatctcctctggagagaagataaaaagcagaatttcatctgtctattctaattctgaaaacaacattctattaaatattaattggttgtggcacaaccatgagtttctacggcagggaaaagcaactttttctataaagggacagacagaaaatattttaaactttgcttgccacacctggtttctgtcccattcttctttgattttgtttgtgtctcaagaaacaaacaaacaaaaaacctttaaaaattaaaagccaagattcttaggccccagcttacacaaaaccagaaacagggggagggtcagatttggctcatagggtgtagtctgccaagccccgatctaggggacaaactgtggaccatacacacagtgctagttaaacgaatacaagacacgataagcaaatccctgccctttgggaaattaaagcctagagagagatgcaaacaaaactgagaaatgaattgtgtttaagaggtaagttcttataaaaccaggtatgcttgaagggttgtatattattgagcttggaagtactttcagcattaaaacaaaccttttactttgactctgacaggccagaatgtagacaatggaaagccccaagtagagaaaccgtaaggacccttgaggttttaattcaagttgttctctacctagaatccaactgtgtcacttcttccactgctaacatactggtagaaactcatataatctctttattttattgcaataagccatttaagtgatcttcctgcttctgtaatttcccttcaaaatattctcaatactgcaggcagactgatgtttttaaaatataagcacacatcacttgtctgctgaaaaccttccaaggatttttaagctgagtaagatgcgaaagcccaggccttacgtttgcttatgaaggccaaaatgatttctgcctaacctcatctcttattattctgcctctacctccctctgctccagacaaactgccttttccttgaactttcctattccgcctcaaagcctttgcactcactgttcccactgaatagaagaagttccccacatacctcgcttgctcaactcttcctactaaaatcatctctggaccatccggctcctcccttccctacaactacactttctgtatccccaatttattttctccatagcatttatcacgatgtaattaataatagtgactatatgttatccttctgtttagggtcttctttctgtatctaaataaggggtaaaccacattttttagtgcttgatgctggaataaatagaatacaggattcacggtttttttaatctaaaaaacttaaaactttggccaaatgttcctgtttttgtatcactaatcatgtcttttaacaattttcttatactaaatttaacaatgaaagattcgtttaataaaaaaaaactttcaaagttttaagtttctaccaaactattttattattcaattcatattgtaatgatagctcatactctcaaattaaaccacagacagaaaaatagacttacatcatttgtgttaacatgccaagccatatcaccataagataccagttgtccattaacgtaacactgaatttcattgttcctccatcgattgtaaatgtggacaatgctgatcatgtaccacttacataaaaaattatatcaatatgtaatgtttggttattacggtctaaaatgcaattataacattcataaaaccctagaagaatatgctgacagaactattaatgatcatctaataccacttcctcaagctccccctcccatccctcatttcacagatggtagaagcggcacataaagaatattcatggagaagacaagaactacagccccttgacctccagagtgatattctttccactataccaagattcaaaattgtggaaatacaatttatttatgttcattcatttaaaatttacattgtgccaggcactgcagatacccaaggctgactagttctcctagaaattatgagctataaaagaaatacatatgacacaattaaacaagtgtagaattataaatcatggtgattacagggaggagaaagaaaacaaaaacaggagaagaaacaagaatacaaacatgaaatagaagcagtagcaaaagaaaatgaagaggaacaagaaaatgagaagaaaacacacagcggaagaaaggaaaaagaacaggtatgggaattagaaggcctataatacctcttatccccttctcgattcataaaatttgagtaactcaaagactatcacaacaaaaaacaagcaaaaggatacacaaatagtcatcccctaaattttgttaagaatgagacaatgctgccactcacgcctagctcaggcaccagcaggagggcaccctccagagattgcaggagaaagggggagaactcttctttgccctaggtatatcaccaccactgccaccgaagcctgtgttacagcacccacaggttcctccccaccccagagtgggatgggccctgcagtgctcctattcccccttcccggcccccagacttcctactgctaccaccactagcgccaatgccaatacaaccactgtcgccctcaatgtaccagcccaccctaccagctcctaccacctggcccccgtgggtgccctcctcccgctccggtcgatctgtggtctccatcgccaccaccaaccgcatgaggcaagctgcagaaccacgtcatctgcaggctcgaccctaccacaggcgactcctcgccttctcctccttcagcctggcttggagtagctgggcaggcaaagccagaaaagcccaaatcaggattcagacagtggaaccgttagagcctcaccttgtcacgctggtgactgggtggcaggcatcagtttcattgaaggcactcacatccaccttccaaagtccagcctctccttctggcaaaagctggccaggaactggggtctggggtgggagtgaatgccttcactgaaaccggcccctggccaactccagctgaccaggaattgctgggcccaccagggctgccctcctcagggagcccgagtaggagaaactcagaaccagccagccctccccacccaagggctggttcccattcctgacgcctccacccacagtgccctgtcccctgcttcccccgtgggtgcctattactccctgcctggtagtcccaggtggtctccgcaacacagagcatgagggcgtgccgggaaaccacagtgggtgtgggagccctgccgtgcaatctagcacgagcaggagaagatcgccttctagagtctggagtccgggaatagaagaacgatcccttacctggagaccaccagaaggaaagaggcggccactactgtcgctgccgctgccgccacctcagctcgccaacaccgctggcagtgtagcccccacagcacccctaatctgacccctgccactagcagtgtagcccccggatagcacatccaacacaccctagtttcaggcaatgtaaccccaatacctcccccaaagcactccccccacactgcagggagtgtaccacccaacagtgccccaaatctgacccagccacgggagttgctgcactagataccatcccaaacccacctcctcccaccccgccacggacagttcagctcttgatggcgcaccaccccgagtcagcacccaacaacgccccaggcagtgcagcatccaacaacgtccctaaaccacccccgactgccagcattgtagccctggataactccacccaacccaccccctgccgctggcagtgcagcagaagatagcgcccctaatccttccccagccaccggcagtatacgctagtgtacacaatctgctttccccgaccacccctgccaccgcaggcagtatagccccagatagccagccaacctgccccaccaccagcaatgccaccccggagagtgcccccaaccagaccactgccacaggcagggtagcctctagcagtgagccccagtaggacacccaacccttgcccccagaggcgtgcagggcagccccgggaaactcacctaccccatcacatttctaccactgtgaccgagctgcagtctccgacgtcaccaccaaccacagcgaggcgaaccaaccagagccaggccagccacggtggcacaggttccagcctccagcatgtggcagtgcctcttccttctcctagtcctccagcccagcaggagaagctcccgctgccgggcgctctcctactgctctgtcgccaccaccaaccacagcgaaacagtgtcccacgctccagggctccagactccatccatcctccagcttcaagcaggagaaaggttgcggcctcttccagttctctaagccggtcacggggtagctcttcctctagacacagaagagcttgaaatgacctgatacgacctcagcatgctttatataccgaggttatgcaaatgcgtttcctggactacatgttctgattggatgagagaaaaaacctctaggcctactctgattggactttgttttcatgctgtgattggttgtgttaagacttactctcaaccaatcagaacatgataataaagtccaatcagagtaagcctggaggttttttctcatccaatcaaaacatgcagtccaggaacctccgtgggcataaccgcagtatataaatgatgctgaagacaggtcaggtttattcaggttcctgtattttcctgtcgagttgctagctgcccgtcgtagaggactaaaaaaaattaatgaaaattgctaaatcaatgacgctttcagaagttccctgtttttgacatcagagtcatattataatgctctattttctgtttcctcacctaaatagaattttgcttgaggtaattttttatctgaacttctgtttgtagaaaccagggacatttattgaattgtttctggctggctatttgatcttaacaaagcatttaaatgatactgatgccctggcttgagcaacggagcatcccagactttcagttagttgcacatagcacacatacaactcatttgagttacagctaaatgcaattacaggcctcagagctaatatatagatcacttcttatttaaggcaattcacctttgaattggttaacctttaattgttgataaaataataagatgggaaacaaagttgctacccaatatgttagtttccccaaataaacacttatttaaaggttcatttgttaatcaagtatctggaagttgaaatacatttttatgaaaggaaataaattttaggtgatgattaggtttttatcaagagctgaagtttttaataacgaacagggagagatactatggcaaaacagtaattgaataaaacataaattcaataaaatgatatgaaaaatcaatgacatttatcctgagtcaaatataaagagaattaaattgaggatgataaaatgtttctaatcattgttccaccagtatttgaccttgagcaaactgcctgggggccatatttggtagacagatgaggatgtacactttcttttaaatacttgagaattagcttaagtgctatcatttgataacttgctcggtatttcataaatgccaggaaattaactcaaatcctttgatgagctgcattttctgtattcaatttgtgtaagttcaacaaatatttattgagggtcttccatatgctgggtatgtgtcttcgcaaaataaagtacattatgaaagatgtgatgctcaatagtatatcatcagtgaattgcaaattaaaatctaaatgagatatcactatatatccactggattgtctaatattttaaagttgtcagtattaaatattgggaaaaatgtggagcagctggaacactcatacattgccagtgggagattaaaatggtgcagcactttgtaaagctaaacatatatttaccatactacccaataataccactaagtatttaccaagagaaaacaattgtctacacaaagacttgtacatgaatgttcaccgtagccttattcatcatagctaaaaactggaaacaactcaaaaacagaaaagtaaattgatgagcaaattgtggtatatcaatttaatgggataccatccaacaatgaaataaataatgaacgataacactgattgacatcaataatctcaaaatcattatcctatgttaatgaagccagacacaaataagtattttgtatattattttatttgcataaaaatttataacaggaaaatctaatctataatggcaaaaagtagattcatggttgtctgagctaaggggtagaggaagattgatggactgcaaaatgcaaaagggaactccttgagggtgatggaaatagtctatatcctgattagcaaggtggttacatgcatgtatacctttctcaaaactcatagaacatacacttaaaatgtgcagtgctggctgggtgcagtgatatggctcataccaataatgaacagggagagatactatggcaaaacagtaattgaataaaacataaattcaataaaatgatatgaaaaatcaatgtttgacatttatcctgagtcaaatataaagagaattaaattgaggatgataaaatgtttctaattattgttccaccagtatgtgaccttgagcaaactgcctgggggccatatttggtagacagatgaggatgtacacagtggtatggctcataccactgcacccagccagcactgcacaataaatgtcaaacattgatttttcatatcattttattgaatttatgttttattcaattactgttttgccatagtatctctccctgttcgttattaaaaacttcagctcttgataaaaacctaatcatcacctaaaatttatttcctttcataaaaatgtatttcaacttccagatacttgattaacaaatgaacctttaaataagtgtttatttggggaaactaacatattgggtagcaactttgtttcccatcttattattttatgaacaattaaaggttaaccaattcaaaggtgaattgccttaaataagaagtgatctatatattagctctgaggcctgtaattgcatttagctgtaactcaaatgagttgtatgtgtgctgtgtgcaactaactgaaagtctgggatgctccgttgctcaagccagggcatcagtatcatttaaatgctttgttacgatcaaatagccagccagaaacaattcaataaatgtccctggtttctacaaacagaagttgagataaaaaattgcctgaagcaaaattctgtttaggtgaggaaacaggaaatagagcattataatatgactctgatgtcaaaaacagggaacttctgaaagcgtcattgatttagcaattttcattaattcttttaaccaaaaaaactgctcttttgtagtcctttttaaaagagaaaaaaagggaaaaatgccttacttagcccttggcacacattttattattcatttctaacatggcatgtcacattgacaactcgttttaagtttgaatttttcttactaagtaatcattttgtatatgctattttttcattgaattacagtgtatgagaagcagtctctcaaatcaccacatagaatatgtgacaatcagtttagtttgtagtcaatgttcattattcctctatgtttctttattttggtagtttagtcatagttcttaacaactgccttgaaatttagagataaaaataatgtctaattttagtatctttagtcacaaaaatagctgtggaacaaactatagactaggaagacagaaggatgagtcttcagatatcctatttcatattagttgaagaagatttcttaaaacattcctgtttctccctacatttattcaggaattggttgagggaaaaggagagtagagagaaattcaacagatacttaatttctggttggtgctttgcctatatattaccgtgctgttgcattactgacacttatcacagtgtgggttgctagttattaaatgtaatggaataacctgatttattgtttataacacgcataatttagaaatgttgaagataaagctcttcagtttaaattgataaattatccaagattatatattaatatgtgcttgattaagtcggtgaactcagatttgggcaattctgaggttcatgctctgtccaataccatagtaaaaatttacaaaatatttcatgaaaggagacatgtgacaattgggaaagccacaagaatttatgagttaatacttatgaagacctctgaaaatccataagtataatagatttttatttagtatgtgtttttcagaagaaataattttcaggtatttgcttagtttttgaatagttaaaattaggctcttaaaatttatttggaacctggacaacatagtgagattttgtccttacttaaaaaaaaaaattatctgggtgtggtggtgtgtatctgtgatctcagctgcctgggaggctgagatgggaggagagtttgagcccaggaggtcaatgctgcagtgagctgtgtttgcactactgcttaccacctctgatgacacagaccttgtctcaatttttttttttaaatttggcttaagtcagtcaccttttatatttaattataatgcaaagtcagtgatgttttgatattttagattacatatcatggaagattaaaatcatcacattattttgaatttttttctactagttggtgaaaaagatatttttttatgcatgctctaaatctaaaatatgtataatcaagtcataatccttaatttacagaaacttgagtattttatttggggtatatactattattttaatatctagaatgggaaactcattgtggcagaaactcaaacaagagcttcctctaaatttgatcttcctctttctccgaacgtgttactatgctttctaagcattatgaggttccagagaagagattttcactttagtttgtatcaaattcatgagtgaataaattctacagtgtgcttaaaacactctgagaagtaggttagggaaaaactctataatcctcttatgggttttttttaatgtgttaataaaataataatatgccatctacttaaaatcctttttgcaacaaggtgcagggataaataaatagtccaagtaacatgatattttcaattttaggcaaaagctctgacaagactttgatccttcttcaaggcctggtaggtctgaaataatcttatccgcacatgaaaaacattcaaagcatttaaaggacctggctataattgcacagttcatggtggcaactcatagaataaagttcaactaattcattccttagtcacatgtcatccattagtttagcaatcttggattccttaagattaaagtataatgaatagtctctcttcatttgactaacaaaggggactaatgccttccgcaaaacagaactttttctttccctttcatgatactgtatttatgtgttctcataacaaatctttcctctttcagtcgctcagaacagataaagataaatgaagaataatctatcgatattagcataattctgtgaagaactatagcaatgtcttgtttacaaaagccaattatacaaatgttatgcataatgcactcaggaattcatttaaaccaggggttttgagttacatgttataagtactagacaacagctgtttccctggtgtatgatggagccaacaccagtcagaggtatattattacatctgattatcagtcaggataaggtaggcaattctctggtaacaaaccatcctcaaatctcagtgcttatataggcactatttcttgctccactagatggttcatacttgctcacactacccatcatgggtcgttaggagatctctgcttatggtcactcaggaattcatctgacaaaggagccaccaccttgaatatcatgggtcactgtgctggaagcaaaagagagaaatgtggtgggtttaccatcaacatttaagtactctggcccagaagtggattgtcacttctactcatcacttacgggtgacaagtgctagaactggtcacctaaccccaccacaaggggaccagcatgtacaatcttaccatatggatgtaaggagacagaacaggaaatatctgtgaaacagtggtattgtcaaaaccaatgtgtaagattaacttctgcttaaacaagtatatgtattattgcagcagtgctggtcaaaaataactgctggatggagtagtaggttacagaaattatgtagactgggtacaacttgctgcaagtaagagatgagctgcatagtgctaaataaagatggcatactttctggaacatatgagaaatttgtccttttaagtataaagaaatgaggtcaagacaataatcattttcactgaagcagttagttacatggagctgatgagttgttatggatgcttttcagacactctgggacagaattttacggtggaagtatgcactgtaatgattcaggacttgactggcgatattttgggtatcttaacctcctccttaaataggctaccaaaaatttgaaaccaaaagggctgagaatcactgctttaaaaagtgagttatgattggagggaatagggtccatcctctaataaacagtaaagaaatcagaagtcctggctggacgcagcggctcacacctataatcccagcactttgtaaggcccaggtggatggatggcttgagcccaggagttcgagactagattcggcaacctggcaaaaccctgtctctacacaaaatacaaaaattaaccaggttgggtggcgcacctgtggtcccagctacttggaggccgaaatgagaggatcacttgagctccagaggtcaaggctgcagtgagccaagatggcgccagtgcactccagcatgggctgcagaaagagacgctgtctcaaaataattaaataaataaataaaataaataaataagtcctgttgtcaagaagtcagtagacaatttttcctaacacaatgatcttaaggactttatttttcccatttttatttcattttatttacaccaaatttcttactgggttttcaatgcagcttaatgcaatatgcaatgattttatgtttttatccactgagatttgtggatggtttgttaccagagtattgcctaccctatctcaaaaaaataaataaatagctatataagagtttatataagcaatttacttattgcttatataagaacacttataaaagcattgaggctggagtgcagtggcatgaccatggctcactgcagcctcgacctctcaggctcaagcgaccctcccacctcagcctcctgtgtagctgggactacagcttaccatgccaagctaatttttaaattttctgtagcgacaggtttcactatgttatcagggctggtctcaaatccctggggtcaagtgatcctcctgtcttggcctcccaaagtactgggattacaggcatgaaccaccgcacctggtttgatcttaaacacaacttttcttgaaaaaaagttaccatgacaagtgctaatttttttctcctactatttgttttgaaaaattttaaacttacaggttaaaataatagtacaataaatatctatatatctttttacttagagtcaccatttgtttacatttttccatattttcctctattttagtctgtctacaaacatatacataaacatactaaatgtatatgtatacacgtatgtgtgtatatacattcatatactcacacatacacatcaatattacttttcttttgtgaggctattagagaataaatttagacacagcatttttgtcctaaatacttcagtatgtatcttataagtacatggatattcttccacataagcgtgacataattatcacactcaaaatttaacaacaataaaattaaatatttaatgtacagctcatttaaaaattgtccttgtggtccaagtaataaccttcatagccacctgcccttcccccatccttaatccaatcatgaatgaagccttctgtttagttacagccgagactgctgtgggaacctagatctgcttctttcatagggaataacctcaggcagccaggacctgctctgcctgtggggctcacagattgcatgaagtgcaaggatgagctgaaagtgtggctctgaagcagcaactgatgggacaactctgaggtcatctacttaccctcgagggactgaggcagctctctctgtgagattgctgatatgcaactgggcttggcctctttattcttcttggaccgacttgacttctcactttcctgtttctcctgggaacactcgtaaggaatggctcagtgaatttccttctcaaggtcggctttggggatatatatttacatatatgtatacatgtaacaaaacaaagaccattccttttacagattattctcaatttggatttttctgattgtttcatcatgattagatttagacaaaatattgttgacaagaatactacatactacataagtgatgtgtcttcctaatacaggtttttgaaattttaaattctgataactgcttttcttccaagaaatgccattatcttttggccagcactcaaatgaaatacagacattcttttaaaatcgaatgtattctattttattatgttttgcatttcccctcttgagtttctcctagtttactaacctctctacagagtaataaaactatattatatttttattcataagaaaaagaaaaaaaacctcatgcaactgaaattgccttaaattattcatctctcacactattcttactttgatgtttaatattattattttatctgcttaatcccataacatatattctgacataaatctgcaaattgttgaaaacaatttacttaacatttcaactacttaaaattttattttatttcagacacctagaaaaatagttctaaattctacaaaaccaagaaaaaaaaaaaagggggggatttttcttggactctgttcgaagtttcaagcctaccatcagatctgtcccagacataacttctcagaaagctctaatgggattttgccctgtatagtttcactgaaacaaaaaagtgacagctgcttccccttccttcccttcctcttccctctcccccaccctcctcctccttctcctcttccttcttcttcttccttcttgcacatgtctgatctctttttcctggcctctaatttagcagccagtgattgggtgatgaatgactaatctgagggtcggagcttctttcctgaagcttcctgaaaaaaatcccccagtaattataggttgcaaaaaacctcttctacttatttagccatttgctcttttaggttcttttcatttatttcaaattaaatgatactttcttttctcccaaaattcaaactggagtttctttgacttccttcaggtgctgctacattaattcaatgcatgttgcatttttaatgaataattttaggtagtgaatttcaagttctgtatcaatttcattaattctacttaagttgggttcccaccgtaatgaacttttaaacatgtgtattattgtttggccaaaagcaccaaatgggtgttcagcttacattctaatgacttcccttccttccttcctcgctccctctctccctcttttccttccttctttccttccttcctcctttccagcatcagctttagcaaggagccctagcagaagacaccagaaggtttccagctgacttgtctcttttgttcctaaaccactactaacagcaatattagtcatcacttcccccactgcccactgtgctatttaaatctccctctttgggtatattttttcctaagtttcctttttcactccatagtcagggatgtgggggaaacactccaggcaacacctcccacacacggccacataaatatttattagctttttatttgtatcaatctgttctgtacaacctgtacagcttttcattgctgacatcctttttattatttcaaataatagtttagtatgagagttaaaagaaacatatctttgttcttgttctgaatcatagaaaatttaaaccgtcacaggccagtgagaatgtatgattcccttttgaaacatttaagaggcataattttgacagtctttgtttaacaaagactttgctttgttttgacagtctttgctcagtaactcttatatgactggaaattttctaaagctaccttagatcagttgataggctatgttttctctttcaatctgtatgaattcaataaatgttttaatgagagttttctaagcaccagatgctgtatcaggtactagggatgactatgaaatgactcagctcccaagaactttataatagggcttaagcagtgtcataactaatacaatcctaataaaagcatgctgtgtgttcagacctaaaagcttgctgtgtgtgtgcatttaggtaaacagtttcatctctctggaccctagctcctctctgtaaaatgaaggagttgaattcaatgatatattctattatataacaccataaaaacactttaccatatggtgtgctggtcctggacctgtttgcactcagatccatccttctgctctgccttgttctggggtgaagaagttgatcctcggcagggtgactttttcaggctctagagaatttctgaaaggactgagtcaacgggcagcaggaatatatcaaccatggaaaattagagagcagggtgaggagcggtttttgggggagggagctatcaagacactccctcctgttttcagcctaaggtggcctctccagtggctttatcttctctgtgactccagcccccattgtatcgaggccaccagagatccagtctcccagagtggtcctcttggtgccagtaattccatgttttccttttgtctctccagcccaagaatgataaagacttcctgctatcgtcaatctcccaggattattttagagccctctgtttaattctcagcctctccactcttcatggacccaccactgctttccattccttctgctgtgaacatttgagatgatttctgctttcttggttaatctatggctaaccacagtgttcacctctactttattttataattgaggaaggaaaatatgagcatagatacattaaaggagcagacccaaactagctccttgtatccaaacaaaatgaaagaaggttgtatccaaaccttcttttgatgctggtatctattttttggtgcttagataccagcatcaaaggaaggtttgttttatgcttattctcatggcccaataatgagatgcagatgaactggatagaagggagtttatttatataactaggtacagagagaaggctgggaaatattgccagaccaactcaaaattataaagttttccagagcttatacaccttctaagctatatgtctatgtgtaagtatgtaagtgtgcattcatctaaagacataagtaataaactttttttttttttttcttgagacggagttttgctcttgttgcccaggctggagtgcaatggcgcgatctcggctcactgcaacctctgcctcctgggttcaagtgattctcttgcctcagccttccaagtagctgggattacaggtgtgcaccaccatgccaggctaattttgtatttttagtagagatggggtttctccatgttggtcaggctggtctcaaactcccgacctcaggtgatccacctgcctcggccttccaaagtgttgggattataggcgtgagccaccccatccggccaagtaatcaacttctaacctataactaaaatctgagtactgaagaccttcctctggagccttagtaaattttcttaatctaaatgggtccaggtgccagggtgattacccttatcttgtctcctgctaaatcatggaggttcctttagtccccagtaaagcttgtttgtggaggtctagggagttcctttagacccccaataaaacttgtttaatcctaaatgggtcctgttaggaattccttcgttatcttgtcatacttcaaggcccagggaagacctaggcaaaactcttggtgggttttgttacattccagcctttgtatgaggacattggccccatcagtttttaatatttatcttaaccactcagtcagtgctgaaacagttgtcatggaggcctgcctattcagctgttagtgagacctggcctgccacactttcagtcaactattgaaggacacacaagattctcttttattattattattattattattattattattattattattaaagctgccatgttgaatctcttgaaagttaaggcccatgtaaatcgaggtgggggaaacctttagtgaactacatcactctgtgtgcttcctggttcttaggacagatgactttattacagcctctgaatctatcaaatgtgtccatttttcaccaggaatgttaattaaaaataaaattatagtgataaatgtattagcaacctaaagtttggtaagagaaagatatgtaaaaaacctcttttttaaagacgaggcttaggcatcctgcttcttctccaactcttttatctccatttcctttaggttggtaagatactttctttatttctagcaatttcaccagagaggtcaacaatcaaacttacggtggttttactttaaaatgataggtaggcaaacttgtggagatactcttttatttaatttattcattaaaaaaagaggtgggatgaaaatccacccattcccactaccccttactttgggtatgggtgcgagagaggagaagttcatggtgattgggtgacaaggaaagtgatagtaccattgctgatacagggagagtcccagagagagaaactagctggaggttagagtattactttcctgtggtaggtggcttaaaacagacatttagtggataaaacaacacacatttatttactcacagttccagaggccagagtctgaaatcaacatcactggcttaaaatcaaggtgacagcagggctgtctcccctctggaggttccgggggagaatctgttcctgacttccggtgtctggtggctgccagcattccttgccttgtgaccacatcgcttcaatctctgcttctatggtcacactgattttttcctgttctttgatgaagtttccttctcaatccctcttataaagagacttgaaattgcatttagggcccacctggataatccccaggaaaatctccctgtctcaagattcttagtcacatctgcatagtcccttttgctatgtaaagtaacattcacaggttccagggcttagaatggggacatctttggaggcctttattcagcctactacagtcagataaagcacacagaaaagctggtgtgggttttatttgtatgttgtctctgagtgttttcaaggttaagatctttcaaggactaaagaatattggttaattcctaacatcctgggctatacaattagtgtagaaagaatacgcccttttggggtggatgagtcaaaatactcacactttattaaaaccattttagtgaattttactgtttgttctgtggatgttacagaaaaaggcatattctctgtatagtgtaaagcttagtcatgcctattaaagatattttgtcattccggaaattctgttttatctcctagatgtatgttacagttatgttaaagttttatgtaaagtttcctttccttcctaacagtttttattttatgtatttcctcagtgtatggattgtttgtgatgcttatgtttgcactgtgcattgtaacttttacaggtgtataataatcattttatccatttcatattttttgccatgatacatgatgctgtgtctgattctaatatttctacctgtctattcctctaacttttctatgttccttttgaccagggaaacttttgaatccctttattttcaacatttctttgtcaatttgtttatacatgtgcttcttataattagtaaatttagatttttaccttttgatataatctgattttatttgccttttattgttatcttttaagccatttatattcactatgccaagtcaggtatagtcttattttgccattttattttattctttgtgatttatacttattgttttcttcttccctatacattatatgtcattgtagctcctctttcttcctattagttattttttctacaaattttattctatattcccatttgtagaatgcacatttttgttctacagttatatatatattcacatatgcacattatatgtatataaaaatatacatatacacagagattagcatatatatgtaattttcaaccaattataagaatggaagactattactggttctcctatataagagacttatcacacttttactttcctcttctctactcctgctcaacatgtattaattaattagttttttaggtcaaattcctggtattaaaaatattattttttattttgtttattttctttcccaagaaatatatttgatacaagaattatgtaacatattgatgttaaaaactagtaattatttattaatgtgaattttaatggatgcagtacacataatcaatttttaatatcatattacctcttgagatgtaacagttttatttattcttttagtcagctgtggtattttctcaagtatcaaagaattatttcccccatgaatggtaaatggatacttgcattttctgatttcctctcacttgactaaaagtttggttgcctgcagaattttttaatctgaattcgctgatggatacctgggttgcttctactttttaactattctgaataatgctgctgtgacagtcatttaaaaatataaaaaaaattaagcatttttttggggactgagatatgcttaagataaattaaccatcataggagaacataaaacataaatatctaagggtgaactagaacccaaaggcctagtctgggtcataggatattatggaatgaaagaataacccatactgatgaaaatgtcacttaccaagatgatgatcttacagtgtaggaacagcaattgtttagctacaaaatgtgtggtaatcatgacttgcagaaataagactggtaaagtctccaagaaactttcaggattcctaaaaccagtcctttgtccaaaagtcatcttcatagtagtggccatatcctgaatgaagttactcagttcttaagagcatactgtctaggtctgaagaagaatacggagagtgaaggcagattcatggaccaaggaagatattcacaaatagaacatacaatgggggaagaaatgattttaaggagaaatgacaatgacaatgacagtggtatgtagtatgtaggggggccattgctttcaatcttggaagatgagttcaagttttgattgcatcaaaatggagtcacactgaagttctcaggtagaattagccatacatcctttgcttctgggtttctgagatattggtgacaaaactgaaactaagaacagatctattgtcaactatgattgtcttgcctcctttttttctctgatcttgtttactgcctgagtttcccttcacattttaccaccacaactaagcagggaccttatttattaagggtacattcttgcatatttctgctttaacatagcattagttagttcagtatcgtatgagtgaatttgggggagaagtaaccagtgtctgtatctgctacagacaatgagaagattgtcttactgcaatattttaggcatctgccttgacttcgaatgaacgttcctgtccataccctaaaggagaaaagagttgcactcatattattaaataccctctagattttagcgaatatatggactactttttttaagcaaatctgtaagggcagttgtcattgtggagaactgtgggtttagttagtctcccttaataatacaaatggagaaaatttagttgagaacattgttgaatttttagtggtccagcgatatctctttgtggagagagcatttgctttattaaatctccattagataaactcacatttttataggagtgttaagagaaaatctctccaagtgtttaagcctgggaaaatgagagagaggaaatacagaacgaggtcatgtgaaccgtcaattgtgaataagaggaaaagtcagaaccaaagaaaagcccttagtgtgcagaagaggtagagattgaaaatgagctgtcaaaaagaaatgcgggggataagctagaataaaacacctaaagaataaatttcaaggaaaaagaggaacattaatagggctaaatttgattaaacttgactgagataaagggagagagaaaggtggtttgatttggggattaggttattagtgacaatcttcataagcaggtttcaaacgacttgtagtagtagaaactgggatgaagggaactgtagtaatttaggaaggacaggtagagtatcagtatctttgaaaagtttgcaggtgatgagatcaatgagaataaatgataacttaatggggtgtcacaaaatcaccttaagttggctggtgaagacttgggcagtttttaggaacagattatattaatattaaaaataggaaaaaagagcaaagaaatatattaggacttctagctacatggtaaacaataaactctggttttactaaatatatttgacacatattatagaattttccttgcaaatgttgttacaaattatatgatatttcctcttttccaattttcctcttacaaggtaaattcacctaatttttattatgatatatttgtaaggggaattgaattataagctttctcaggttaaaataaggacaaaacaaaaattttctgataaaattttcttgcagtatgccaccatttgccaaaggaagtcagccattgtagccttttctgtaatcttaagttttttggacagatatctattgtgcaaactaaaatttagttctaattccattcatattagatatatttatttaatacagtattccgcttaatacagactttataaatagaatcacattttatttttaaatgtcatatcctagaggaatgtttgtacaaatcatttaaaaatgaatagtttacaaataacttagctttagtctttaagtatttacatacatttatttatgatttgtcacacataaaaggacattcttcttcttaattatatcttgctgatacttaattttaaagtttttttttgttttaattacacaactggtggtgacaatataaccctagatggctatggtatatttgttcaggtgccttgagaaataccaaaatttttgacaatgttttttttcctttgggtcagatcttttttattacaatgaaagataaatttcagtaaactaagagacagagactctacacagagtttcagtttccccttagctcctataaaatggaatgtcatgctactgagatatctcatgcactgctcttgccttctgtctgaagatgggattcatgaattacctgaatcatctggatccctagaattggattagtggctcagacaactccatcttttgggacagatgatagaaggtatctatttcctacagctaggtttttgcagtaagattacataactcttatttgatctttctcattatttttttcaggacataaattgtgttccaattctgatatccaatgatcttacctcatttggggtaggttaaagtagatactcattaggactctaaggagcatatttttctacttagtgcaaacgtcagaaagtaagtaatcatgtttaaactgacaagagctttaaccaggaagttgcctacatcacaagatctccttcctgtggtagtgtgcatggagtcttccacaaagagacagacagatgcctgcaataaccggcttaagaaaagataaccatcaataccactggttgatttcatctgctcctatgagaaggacagattgtacatggtgctgtcagatgatctcagaacataaagagatttcctgagagatcgttataatattgggataaaactttactgcaaaaatctcatagagtgaatgaatgatagaggtaaacaaaagtttattctattaaaacttacattttgcagcttattacaacatatgttatgatttgaatgtgtcccctccaaagttcaatcattgccaatatgatggtattaagaagtgattaagataggtattaagatggtctttaagaggtgattaggccttacagtctcttcctggctaatggagttaaaaagcccttacaaaagagacgtcccgcaatgcttggctagttgcccttccaccttatgccatgtgaggatgcagcaagaaggccctcactagatcaaatgcctagagccttgaccttgtattttccagccactgaaactgtgagaaagtaatttttttttctttataaaatagtctgtggtattttgttataggagcacgaatggactaagacaacatgcatgtaattaacaaatgggtcttgggtataggcatgaaggagatagctttccagtttgctaagagatgtctaaactggacatccttaacagctgcccctccacccataaccattgcaccggtttctatataaaaggtcagaactctgccttttacttcgagaacttcttttctgggaaggtctaacagcttactatccaacccattataactagctataatattctgtcaaattccttcaaattgatttctctgtctcagaccaccataacccatcacaattctgaaagctgaaataggatgagcaccctcttctctacagatagccctatatggaacccttggcttctgctgagataagatttgagataggagaaagagaaaagctagtttgccaaccagagggaggatgatgtgttcagtttgcaaatggtaagatttagatgttctgtagacaactaggagtattggaatccaggcttggatgagaggtttggtttggtacatcaattgagtagtcattagtataaaaattacaactgggccgggcgcggtggctcatgcttgtaatcctagcactttgggaggccaaggcaggtggatcacctgaggtcaggagttcgagaccagcctggccaacatgatgaaaccccatctctactaaaaatacaaaaaattagctgggcttggtggtgggtgcctgtaatcccagctaatcgggggaatgaggcaggagaattgcttgaacccggggggtggagtttgcagtgagctgagatcgcaccacttcacttcagcctgggcaaaagagtgaaacaccatctcaaaaaaaaaaaaaaaaaaaagacaactggagctagaaggcaggatttgtaggcaaaggggaagtaagtggagagagatggggattgaggacccagtcttgcagcaagaagaggaagagagttactgaaggagatgtgaaagccaggtagagaggtaagagaaacctattacaacggccccatcacagggggccttcacagtcacacaggcttcacatttggatctctaaatgagatcatgtctctatattttgtgaatatgtattaaacgtttaatttagaagcaataaatatttaaaacatactgaaatgttgggacactgtaaaagaaatgggctgtgtgtagtggtcacacctgtaatcccagtgctttgggaggctgaggtgggaggactgattgagcccaggagtttgagaccagcctaggcaacatattaagaccctgcctttacaaaaaaaaaaaaaaagttgggtatggtggtgcatacccatagtcccagctacttgggaggctgagatgggaggattgctggagctcagggatttgaggctgcagtgagtcatgatcacaccactgcactgcagcctgagcaacagagcaagactctgcctcaaaaaataaataaatgaatgaaagaaatgaaagttgcttggattcttactaacttgtgattagtcttgggaggaaaattagaagactgttccaggaacaggcaattgaggttgtcagaaaagtgagatgttggcaagatgtcaaagagaataagaactgagagaagaccatgatgttcagcaagggggccactagaactccataagagagaggcctgggtattgtggtcagaggaagtcaaggaattagtaaatgctaaagaaagtgggacaggtctcaagcatcctttagagaagtttggcaattagaagtgtgtgtgtgtgtgtgtgtgtgtgcgcgcgcgcgtgcgcgcgcacgccagtgttcatttttacctctcatctcctatctcgtccaatacctaatattctctagggaaatggaatcctggctgaaaggcaggcttgtccttcagctgtcacagtgcccaagaagcgcacagcagggagtctttttttttttttttttaaatttacgctgtggtgctgggagccagagacagagacaaaaaaagctgtcctggagtctgttgcattgtgactgaatcaagttatctataaaaggactcaaaataggagtctgggttcacagcttaaaggaatgaggctaaacagcagaaaggctcaagcaaccactggtggaggggaacaagtaagaacttgtctggagaagtctggcgccaagtataaatacccactgctgacattcacacattcccagcttgcttgtccaagggcaagcaggagtcatttacagcctgaacctaataggcatctaatattgttatgtgttgtcatatctcaaccaccaccatcaccaccactcccagctagcactcacagagcacctgacctgggatcagtgcctgaatcagaaacagaaacttctagactgatgtggttcagtggtgcttacataggctattgtttactacatctgcacccacctttcaggaagcatttggcttgtacatttagctctgtggcccactgaagagaatttcctgtgggcagtggggtgaggaaccctgccttaatctgtttctcaggtattcttctcccctgcttttatgtgtcagaacctgtataatcattgtagggcctatccaggagtaggcagagccagagtgcccattcctgatgtccacaaagtacagtaatgcacccaggcttgatttggagccactcttgccttcctgactgttttcaaagatatgtcgcatggcctctgagccagtgcaacaagccttgcaggcattggtatttgcacaacaaatagtatttttttttttttttttttgcttaaataagggaaatagggaatatttatcacagctatacatttattcatcatttaattcccatttatttattcattaatttattcaaacacttcttaagcatgcaccatgtgtcatgcccatcttagaggccacaaaggttctaaaactattacttgtggacagaaaaagagacccatatacatgtagcattatgtcttattggaattcagagcaggaagagaacacatctggctgggggcaggatgaggaaggacctgataaattttctattgaacaattactctaaataagtgtgctttctttagatggtaaggattagaccaggattcaagattactggattttgagtcaaagtttgagctccttgggggaaaatctgcatatatgcagagtcatggtggtaattacagtattaagccccattttggaacactttgatctgatctgattcaaaattttatttcctgaaaggtttactcatgtcatattaaggtactcttgtctttttatttgcaaactcatttaaaatctaaatactgctgctctctgctttggacttggctgcttttcaataacaggaaggaacaatactgttttcatcagttttgtacatgggccacgagaaggcagcattttacttcttttaagatttaatgctggtctacaaaatgctgagctgtgcctggagggctttgtggtgtggaaaatcttcagaaatgttcagtgaaacccagcatcctctgattcatctttaaagaggagaaaaaattattctatgtgactctattaccaatctttgggcagagaaccaaataattcggccaggctctcagtcttcatggttgaaaagttatcaggaaatttaaaatttaaattcatagttacagagccactagtgaaaatttgctttttaatgaaaaatttttttttggtctacattttcaccctctgcggtgggggctcttttaaatgcccctgtttaaccatactgcatccagaaatgtatacatatcacaaacctgttggtaatgacaccaaggcaagctccgtttcctttcccatcatcggtggaccacacctacaccagcgcttccttctgcgcatcctatggcacccgtctactttctgctttgggaatccccacagaggctagcacagtgctgaacttgtaaaacgtacacaataaacgttctatttcttgaacgacattggatgataatgcaatctctctcttgtaagagagaggagaaagagagagagagaagtgagaggagagagagacagaagagaaaggtgaggggggaggggagagagacacagagacagagtcagagacagagagagaccaaaagggaacagctggcagcagcagggaggcaggcttgaggagttggtgtctgatttacgtgggggccacagattggtttgatcaggtgtgaagtttacagggcgctgggaaggctggttgccccaccctaatcttatgcaaatgggctttccacttgctcagcgccatctcatctactctttactgtacacgtggctggcaaagagaagggaagatagagctctcgttttgaacatgtaattccaggtagtattttcctattggcacaacttcacgcatttgcctgtgcaggcttccacttcgcttgcctatgtctgcaacttcattttacagtctgctctttgttaggaaaataaatgatttgagggctgcttttaattaaaaggtaaaacttaccaaggactcctgtaccctcactatctgcctaactaatttcttcttaactcctatatcaacaaaaccccacgataatttttttcctatgaaaaaatattttatttgaagaaattaacgtaagctgtgtgtggtggctcacacctgtaatcccagtgctttgggaggccaagatgggaggacccctcgaggcgagaagtttgagaccagcctgggcaacataggaagaccctgtctctataaaaagttagaaaattagccgggcatggtagtgtgcacctgtagtcccaactccttgggaggctgagatgggaggatcatttttggccccaggagtttgaggttacagtgagctgtgattgtaccactgcactccagactgggtgacaaaacaagaccctgtctccaaaaaaaaaaaaattaatataaaatgtggaacttttcgctagtggagatgaatgaatatactgtgcagatttatggaagtatgacatctaaaaagaccagaatagttcctaagtgaaaagcggaaggatatgccctagaagagggcataactgaatgtgtggggaaggttttcaaactttactccttctaatgcaaacctctgtgaccccttacaaccccttcctctggatgggtatcattccatatcattacaggcagtactgagagggagattacaaattgtaaacattttcagaggtgggaggagaaaagatggaaaccataaagacacagctatataaaaggttaattgcatatatatttggttatggtaatttctgtatatatgcttcatatcttttacagtcagtgtgttagtggcaaataaatacgtagaacttacttcaaaatattttgttgtttcttaaagtgcctaattgtaccatagtccaacacgaagcccttttataagagagatggaagagcatgcagaatctaatcattagattcaataagtaaatatgtattgagtactgatgaagtaccaactaaacattatgattcattttgataaaacaagccagtcacattagtaagaaacagctcactctggctggagaacttgttccctactttcacaaggttgacttcttaatctgatcaaatgaaaatgtcatgttcaccagaaaggccatttctgatcatctaatttatagactgaacacccctcaccctgtcattctactttacagcaccttgttctgttcacaatttataattgtattatcacttttttacttgattaatgtctgtctcactcatagatcgtgaactccatgaaagcaagaatcaaatctgttttgaagcactcccagcatttagggaaatacctgaagtagaaggcattcagtaaatacttgtggagtgaatgtatatattcttgctctatatgtgaaaacaccatttattcatacagttaaactatgatgtcagtattatgtcagattattataatgtcatattcattaacaacgagacccatagtaaaaacaaaaatgtatttgacaaactgttcattagtaggaaattgagtttagtatagatgaaattttcaggtaagatattcttatctttttgaagatatgacagcatatttaagctttgggcaaggcagacttttttttttttttttgagacagattttcactcgttgcccaggctggagggcaacggtacgatctcggctttccgcaacctccgcctcccgggatcaagcaattcttctgactcagcctcccgagtagctgggattacaggcatgcggcaccacgcccggctaattttgtatttttagtagagatggggtttctccatgttggtcaggctggtctcagactcccaatctcaggtgatctgcccgccttggacttccaaagtactgggatgacaggcgtgagccactgcgcccggcctgggctatttttgtttcccacagatgtttacaccagaatggctgttgcccggtttgattgcgccagtgtctgacagctgtgtggtgcctgtatcataacagttgttaaataatttgaatatataatgtttaaatatgtagcttgtctttgatcttttgacaacagagatagcttcatttacctaaaggggtactgattttaaaaattaattcatttgaatttaaacacagcatatgctagacaaaactcttagggaaagaatatgtatatacgtgcatgtaaaccacacagactgaaagagaagcattcagtacataaattattaggctcaagtaggaggttactatagagttagctgctacttattttcagaatttgattttatattttgaattggaagaatgccgatctgggagtcaaaaactcttaattttgagccatggatgcataaccttgggtattttaatattgggcttagtttactggtttgcaaaagagatgagtggacaagatatctttaaagtctattctaggcatgaattttcatgattctgcagtatatgttccttttaagaagtgagacattaccaggataaatataggaaaaactagtagtatccccttaccccctcaccctcctgagtaaccaatttaatatgcacagaacatccttctatcatcctttttggtacacacaaacatatataaacaaaaataaatgtatgtaagctttcttgcctgaaaaaagtaaaataaaatatacattattcagatgtgtttccctgctaatagacatctgaaagtcttcagtttttatttttgtcactataaataatatttcagtaaacaccattgtagaagtatcactatatgctgatgcttttgttttttttctgtcagatacatttttgaaaataggatttttgggtcaaaggtatatgcagttttcattttaatagataattgctaatttatttctaaaatatttgtggtgatttagaatggtaacagtgccaattgccagcactgagttaatattttgttttctattgctgctcacctgaaggctaaaaatgatgccattttagtttaatttgaattatctagattttgttggaacaagaaaaaagaattctacttgcatctcttcaaatgatgggtctgcataccgtctactatgaattggcaattcgtagcctttgcatatgtccattttaatatgatcaacttttagatattatatatactgtaaatattttttccagtctttagtttgtctttctgctatggtttacatagcgagatatacttgttttttataaaataggtggtttgttttctgtcgttcttaagtgagaagatcttcaccaagggcttccttctggaatttttataggtttatttaaaaatattggccgggcgcagtagctcacgcctgtaatcccaacactttgggaggccgaggcgggcgaatcacgaggtcaggagatcgacaccgtcctggctaacacggtgaaaacccatctctactaaaaatacaaaaaattagccaggcgtggtggcgggcgcctgtagtcctagcttctcgagaggctgaggcaggagaatggcgtgaaccccagagatggaggttgcagtgagccgagatcgtgccactgcactccagcctgggcaacagagtgagactctgtctcaaaaaacaaaacaaaacaaaaatatttaattcacctgaactttaaaaaatatataaatagtctaaatttgtatttttacatggggtttttaatggagatgtactgaattaaaagctcattttgtcatatataaggctcttatgtgtacttggatgtaattctagattccgtgctctattctctagatttgcttattcatgtgccagtgctatactattctattttttttaaaggtttaaaacatttatcactaaagatactagaatgttctttgaaaacctattaagacatttaactattcttttatgctattctgatcaaaagaaagaataaaagtttaggaaagggaaaaatgcacatttcttaaaaaagtttatttctagccctgaaagaacaaaattattgaacaaagtcataaaatacagcagttaatgtcaatgtataacaattaaataattgaatgggattaaattaaaaataaaagacattataaaatttgaagacaacagaaaagacaaactataattttacttaattccatttctatcacaacaagaaaaaaaagccaatgcgttccaaccaaagatgctgaattccaaacataattgtttctcttaataaagaatagaagtgtgcttgacagaattatcatccatttctttctgcctctgtcttggcagcattctagagaagtgaatgggaaagacttccgttctttcaaggccaggccagtgcttgcttcttctttctaactccaacctcgtctaccacagcatctttgccagagtgttcaatcagtgtgttgactgagaaaaaagaatgtgtgtatatattttttcttatatacacacactatcaaaaaactgatttcaccagtttcaatacctactgtgggagcagcagagacaggaagacaatctgcttcttgtattactatgaagttccactataaaaaaccccaaatgagtattaatctggattttagctataatctataatattttgacactgacatttcactagatgtggatctcagtatatttaaaaagatttagactcaaaaatggatgcaaattctttaagcatctattttgtttttttctaattttagctactacctgatcagatctaaaattattctggctagaatacagtatatacaaacgtatttaagtgagccctataaagaaatactcataggtagtttaaaatttcttgttaaaggcacaggctcgtttacagttggtggttactagactctaagcagcttaacatttatatgttaaagggaagagaattagtactatgtgccaggcactcgacacatgaagacagagttgtattagcctcggtgtcttacgcttcacaattactcatttactattctaggtaggataaaatgttccatgtttcatagtttcccagttttaactgtccctaaaagcagcagaagaaaaaagaaaaagtctaaaatataataaataagtactatagtaacactgtcctaataacacaagaggactattaaagtaacttttagatttaaatgggaattttcattctaaagtgatgacaaaaagggtaaatataaaaggcaattatttaaaaaacatgaggccaggtgtagtggctcgtgcctgtaattgtagcactttgggaggccaaggtgggcagattgcctgagctcaggagttggagacaagcctgggcaacatggtgagactctgtctctactaaaaatacaaaaaattagctgggtgtggtggcacgcacctgtggtctcagctactcaggaggctgaggcatgagaattgcttgaacccaggaagcggaggttgcagtgagctgagatcatgccactgcgctccagcctaagtgacagagtgagactctgtatcaaaaaaaataaataaataaaaaaaaataaaaaacatgaatcttgattcagatataatttttctttcaacaagttctcaatgttttaatttaaaattaataaatcacaattctgtattgcttttaagattttgtttaaaaatgacacatctcaaaattaaccaaactatatttctgctagaggttagtttatccatgtaacttaagaataaaccacagtgtagctcccttaaccaaagagccaggttttaatgactgaagtcagctgccagcaatggacatgcaggtaactatcgaagaagttgtagctacaaatcccaaactgcttctatcaatggaaaagccctttgttgagtcacaagcctgaagtgaggccttggcacatagtcagtgagaatggtctttgacttagaagggaagtgcctctgagtgcatgaggatcacagtcttctcatctcgttggttttctatttcattggtagcatcttctttatcataatccatccgtttacaaagaatgttaaaatttggaactcaggtggcactgcagctttctgacagaaataaaccagtttctgtaattcagtaatagctgtagaaggccaatatattccagagaaaaatgaaatcaagaattatattgaaaacagagaccactaagtgctctaaatatgtttcattaattattttactcatttttctgaaaatcttgccttatcaataaaaaacagtcacttctctccttataattgtatcttatcatagatatagtgggaataaaataatggaaataaaaccctgctagtttccccaatgtatactacaacagcaaaattattttttattcatgatttatactactgcaggatggcaagcaggggggaagttaatgggggaaggggatggtgggaacaaaatgccagaaccaaaccaaatacttgaacaacctattccaaagcaaaacaatgaataaaggagaaggagaggagatgaaagaagagaagagaaagggaggggaggggagaagggagggcactcaaataattaatgctacaggtctcagatctttcagaatctttaaaagaaacaaattattgctctcaacacgcacatttcattttcctttcttgtttttttacattaatagtctctacctatttgaaaacaaaacaaaagtaactcaacatctcaaatgatctataaattcatcaagaaatactctgtcgctcaagttctcatagataataccacactgatgatgacctggagcaatgccgccgcctccaagtctctacagttgatttcctatcggctgcttctctgtaacactaacattctctttcatgagtataatctcttctcactatatcagagatcaccaaggttcacgtctctcactctgcgcctgctagtcccaaatattgttctcctttaagtggaaaaaagctaattttaaattcccgaaaattcactggttattatattatttgccatgggaggggggtatctgtgaggtgagagaggattaatgaaaaacaaaaagaacaaaaataaacctaaaattgcaacatatacagaaatttatttccaaattgaagggggaaaggagggaagaaggtagtggcactaaccaaagtcacaaagcccaggttggaacaagaacaaatcactttggttcctagagccaagcctgaaggggaaacaggcagaagggaagacgaaatgggaagaaatacacggtcaatgggaatctttttctatctcaatgatttagttataaatagagattattagtcttctctctatacatgtaacaaatgccaaacttactaccacaaaatttctaaaactgactttttcacatttgttaaaaaaggtaaaaatcaaatacttttcttcccttccttcaggtcaagttctgaactaaaatattacatgtaacaacagctggtcctaacttttataaaaagtgaaactatatagagctcctttgccaacataaggagctacataatttctattacacttacctaggcatgagaaactcaaaagcaactcaaaaggagcaagtccaggaaaaggaaagctatgaaggagagaaagactagcagatgaaacaaatactctgaaaaactccaatctgccattcaagtattggaaataccccaaaggggacaatgaatgggatctattacaacaaagtcagcaaagtaaaatgcaaatctcacatatgataaatggccctgataggcggtttgctgaaagacctaaggctagtgattcagtccacaattccttttggaccctaaagaaggggttcatataaaagtcatacttttctttttgcaattttctcttggttgtcttcagagaatagtcatttgcttctttcattcaggttatgcagaccatttctttaaacccccaaaagagtaataattttcatatactaaaaggcttcttgtagaaaatggaaaaaagaatatgaggccacagcagtgatgttaacggttactcttcattgcttctttagctgccatgatcagtggtgtcaagctagataacagtttggctagtttcaggaaaagatgctgtaataattctttggctgaaccccttttttccacatctgtttccaaacatcgatttaagaaatcccgaaatattggggaaagtgtctctggattctgaagttctgggattccattagttgctattaggcacaaggccctcaagggattttcattgaggtatggaggctctccttctaccatctcagtagccatgatacccagagaccatacattgactttagggccataagccttccgtgtaaccacttctggtgccatccagtatggcgttctgaccacggtactgcgtttgctctgctcaggggtgatctgggcacagaaaccaaagtcagtgagcttaaccgatccttccattcccaaaagtacactgtcacttttgatgtctctgtggatcacttgattagcatgtaaaaactccaatgcctgtaaactctctctgcatacagcggcaatctgtgcttcatccatgcaggtttctgttaccacatcagtgagtgaccccctagcaaggtattccacgaccacaaacaattcatctcctaccaggtaactgtccaagaagttaactatgttgggattttttaattctttcattaccagaatctcattaatgatcaattccttctttggctgtttctgtaaattaatttgtttgatagcaaccttctgtcccagtgcaacgtcagtagcagtgaaaactgtaccagaagccccttgtccaattttttcatatcttgtatatttttttcttagggtcacctatgctcacaatagttcttagtttctccataatctcttcatctgtcatcttagtcttctttttctgtttgtctaaagacttggcaccaccatcaacatttgaatcaccaactggtgcaggaacagggtcaattacagaccgtgtgtaaattgatttcatatgatccggtggtggggcaataatgggaggggcagtctcttcatcatcgtcctcctcctctgtcactactgcaggtgcttctgttccctcggcattcagtgctggtgttccagaagggaagccatctttctcaggaggagtaaaactcagatacttctgcttcactgtgttggagtcgtagacatccagcacagcctgaggattcttcttttgctctagtttggtgatatttgaggtctgtagtaatcgagcccagtgttctggcatgccagtgaattctccagtaacagcatcaaagccaacatggatggtgtgttcaaaatcagatggaggagaaatttctggccgttccttttctttctttttacttcctttctctgtgcctgagaatatggagatgattttatgcctgggctttttctcctctggaacagaaggcaaaggtttcaaactgtgattggctgacaaagggtctttgcccccagtgctaaagatggtcctgctcattcgcacgggaggtgctggaggcttgtcttccagttctctgttatcacacatgattcagaaatatgaaatggccccaggtgaggcaagttccccaccccagtgaggcaccttggtcagagctcctgggaggttgcggaggcgcctggtaccaaaacagagatatagaccaatggaacagaacagagccctcagaaataataccacacatctataaccatctgatctttgacaaacctgacaaaaacaagaaatgaggaaaggattcccgatttaataaatggtgctgggaaaactggctagccatatgtagaaagctgaaactggaccccttccttacaccttatacaaaaattaattcaagatggattaaagacttacatgttagacctaaaaccataaaaaccctagaagaaaacctaggcaataccattcaggacataggcatgggcaagggctgcatgtctaaaacaccaaaagcaatggcaacaaaagccaaaattgacaaatgggatctaattaaactaaagagcttctgcacagcaaaagaaactaccatcagagtgaacaggcaacatacagaatgagaaaaatttttgcaatctactcatctgacaaagggctaatacccagaatctataatgaactcaaacaaatttacaagaaaaaaacaaccccatcaaaaagtgggtgaaggacatgaacagacacttctcaaaagaagacatttatgcagccaaaagacacatgaaaaaatgctcatcatcactggccatcagagaaatgcaaatcaaaaccgcaatgagataccatctcacaccagttagaatggtgatcattaaaaagtcaggaaacaacaagtgctagagaggatgtggagaaataggaacacttttacactgttggtgggactgtaaactagttcaaccattgtggaagtcagtgtggcgattcctcagggatctagaactagaaataccatttgactcagccatcccattgctgggtatgtacccaaaggattataaatcatgctgctataaagacacatgcacacgtatgtttattgcggcactattcacagtagcaaagacttggaactaacccaaatgtccaacaatgataaactggattaagaaaatgtggcacatatacaccatggaatactatgcagccatagaaaatgatgagttcatgtcccttgcagggacatggatgaagctggaaaccatcattctcagcaaactatcgaaaggacaaaaaaccaaacaccgcatgttctcactcataggtgggaactgaacaatgagaacacatggacacaggaaggggaacatcacacactggggcctgttgtggggtggggggaggggggagggatagcattaggagatatgcctaatgttaaatgatgagttaatgggtggagcacaccaacatggcacatgtatacacatgtaacaaacctgcacgttgtgcacatgtaccctaaaacttaaagtataataaaaaataaaaacatacaaccaaacaaaaaaaagaatgctggaaaagcacaaatgtaacgttttatgtggtgggacagccctttcaaaagtgttttccactgcttatactgatgaaggtagaaaaaaatttcacttattttaactcttcctttaaaaacttcttcttggtggctcatgtcatgcatactccacaagtcctggaagttaaatgctcttaaatatttgatggtctggtcttagcaaaacggcaggtttttacttttacatttttagctatgttttaaattatttgtaatccagacactgaagttttattttgttgtgaattgaatctgggcagagtgtacaagggatctctctgtattatttttacaactacatgtgaatctataattatctcatcaaaaattcactgaaaaaggtatcacggagcccatgtttgctgttaccgtctttgctcctcccaggttacaatgccccgtgcctctcagtgcacagtgaaaatgcagcagacgtttttgatgtgagctccacggaatggatccagactgtccccttcaacaaggtaatttgaccttaagattatgcaactaatgagttaatgactgaaacgcggaaacagaaataatccattgtacatttactgtaatgggtacttgctagtttggaggcttaacaaagagtataaaaaacaaaaccctacaaaacattatattgattaattgcattactagtactagagccatttgtgacatctagttccattatataaagtagtattgttatagataaatatattatttatttataccatacagcacagcagttatttcccatattcagtttaaagttactttatcagtaatttttacttaccagtataatttgttccttttatacttaccagtataaaaaggaacactttacagggtaaaaggaacatttttacagggtaaaaaaagaaaaaagcatataaccaaggctgtgtttcagattctcagtaggatctcacaatggtgatgttttgcaaaacaaggacattgacagtaactccatctacttaccttaggcagattttcctagttttactttcactgtgtgtgtattaatgtctgtataattctaccacctgtgtgaattcatgtatccaccactagtcaatatactgaatggctccagcaccacagtgggtccctcaagagcccttttataatcactccccctccctcccacctccttccgctttcctaacccctggcaatcagtaacctccatttctaaaattttatcatttcaaaaatgtctaacaaatggcgttatatagtattcatgatttttatctgctaagtccaaatttatttttctaaaaaaaacaaactttggattagaaacccaggagaatcccattacaatattcttatcatatagcagctacatcaaaaaatttttggaatatatacagttcaaataaatagacaaaaacaagtgatgcccatcagtcagatgatagagtaacttcaattcatatggtccaagtctgacaaaaatgcattctaacacctgcatctaacaccagctttattgaataatttcatcacgtttcaaaatctgtgtctcctagaccagttgagctcacaacaaaaagcaattgtagagagttagaaaaatatatgaaattagtgaacaaaacagtgaaaccttccaaccaggaatgtttttggaactttctttgttagtaatagttccttatggttcctaaatattcaacctcccagcatgaatgtgtctcccatcaaaagagccacagaataaacacaacctcttttttcaacatccctcttcctatgctcacgtctcccatctttttcccttgtcttacagccaaattcctgaaattgttattgatattccttgccctccacttcccacccctattcacacctccatcacagggcaatctgacttacaccttaatcactccattaaagctgctctcatacaagttatcagccatcagttgtgaaaaccatctgacctgtttgtctcttcttggctgcccagcgacacctgacccttctttcttcagtccccacgctgctgctccctcgattttccccacttccctgaattctccttccctgttttctctgctcctcttcctctggtcgaagccctcttcctttctcgctctgcttactcagcatgtccaaagagtcaggctgacactaccagaagcgagtcatcgattttagcgtgacaagtgggatggctagagattgtgtgccatgcacagtactgttcatgaagtgttcctacaaccaggctttagagctccttccccattataggaaattcagggcatagaagtgaagcagtatcatgagggagaacaaagacaggtgcagattgtgggacattatgaaggacaacaaatcagtggcagggaggactgctcaggatgagaggacctttgtgagaaagtggtgtgcagggtggaccttgtcaggattctgattccaatagacagactgcaaaaagagaaatacttgtgataatcaagtatgtatgactgtggactatgtatgggatgataatcagaatcattgagtacatcttcaggagcgatcacagcaatgtgattatgggagaaagtgtccctacttttagtgatacatgttcaaatgtgtagagatggaacaacatgatgtcagggatttgacttgaaatattccaacaacacaacaacaaagaaaatacttcaatggtcacatctcttcctccatacccgcctagatctgctccaccttgtgttttatgacctcagagtctatcagtggcctccgcccctttgctcaagttggaaacctgagaatcattgctgattctcttacatgtcagcttccacttccaaccaagtgtgaagcttttgcaattttatctcctcaatattcctcatatcctctcctctccatccccaccgctactatcatacataattttaattcacaatttctcccgtaaccccctaactggtctcttagcctccagtaagtagtaattgaattcccttaattactagtggtgtggagcattcatttgtgcgcttatttgccacatgtatcttctttgttgaggaacctgttcaaatactccgcccattttaaaaatttgggttgagttggggagcggtggctcacacctgttatttcaccacttgggaggccaaggtgggtggatcacctgaggtcagttcaagaccagcctggccaacatggtgaaacctcgtctctacaaaaatacaaaaattagccaggcatgatggcgggtgcctgtaatcccagctactcgcaggggtgggagtgggggattgggaggctgaggggggagaatcgcttgaatctgggaagctgaggtcacagtgagctgagattgtgccattccacaccagcctaggcagcagagcaagactccatctgaaaaaaataaaatttgggttatttattttcttattattgagtttttaaaattcttcatacattctggatacaaggtttttttgtcatatctgatttgcaaatattttctccaaatctgtgacttgtttacttctcttagcagtaaatttcaaagaacagaaatttttaattttatcaattttttatttttatttttattttgagacagagtctcactctgtcgccaggctggagtgcagtggtgcgatctcggctcactgcaacctccgcctcccaggttcgagggattctcctgcctcagcctcccgagtagctgggactacaggtcccagctcgtatagccagcacgcccagctaattttagtatttttagtagagaaggggtttcaccatgttggtcaggatggtctcaatctcttgaccttgtgatccacctgcttctgccttccaaagtgtggggattacaggcatgaatcaacgtggctggccccaaacttttatcacatttttaaaagttttatacattgtgctttgatgttgtatcaaagaattgtttgccttatccaaaatcagaaagattttcttcattgtttacttttaggcacttcctagttttaggtttacatttagttacatgacctattttgaattaactctcatatatgctaagaaatatagataaaagttgatttttttgcatatggttatctgaggttctagcacaatttgttgacagcttttgcagcttgttggaaatactgtatatattaaagcaacagaatagaggatcctgcaatatatatcagcaaatgtataaacagacacatagatatagagatggatatacacaaaatatttttgtatctgtatatacagttctgaatttcatatcatatatattatagttttattgttgaaatcaggtaaagttaatttatcaaatttgttcttttttcagttattttggctcttctagatcgtttgcattttcttatgaatttcagaatcagcttgtcaatatctaccaaaaaatattaaaatcctgctagaattttgactaggattgtgttgaaactatctatcaatttggggaacatttatgttctaaatattggtttccagggcatgaagacagtgtatctctccatgtatttgggttatctttaatgtttctcagtattccacagttttcagtgtacaggtcatgcacatcttttgtcagatttattcctaagagtttaatatattttgatgctactttaaatggcattgcttttaaaattccaatttctggttatttgttgctagtataaaatgcaattggtttttgtatattgttcatgtatcctgcaaccttgctaaactcatttattagttctaatagctttttttgtattttatattgaattttctacatagatgttcattttgtctgtgtgcagttttgcttctttctttctatcctggacgtattctatctcagcttcttggctggctaggatttccacaacaatgttaaatgtaagcgtggtgagagcaaacatcccatcttgttcctgataagacaaacaagaaagcattgagtgtttcgttactaacaatgatgttagctgtaggatttttcacagatgccttttatcaggatgaggaagctcccttctaaatgttccaaatgtaaatatatgacttcatcaaatgtatttactgcatctattgacatgatcatttattaatatggtgcaatacattgattgatttgaggatgttcaaccaaccaacttttctgagatacattatatttgtccacggtacaatataatttttatgtattgttggaactgatttgctaacattttgtaaagaacttttatatctaaattcaaaaagaatatttgtttatagtttttttgtaatatcttagtctagctttggtatcaaggtgatactagccttataaaataagttggtaaccagttcctactcttcaattttctgaaagagtttaagtataattggtaatatttcttccttagaggtttgaacaaaaaacttcagagaagcaatctggggttagagtttcctttgtaggatgagcatttaattaaaattcaattacttcaataaatatagagttattcaattatctgattcttcttgagtgagctatagcaatttgtatctttcaaaaaaaattctcatttcatctcagttacaaaatttattaggtaatgctgtacacagtattcccttactccatttttaatttttacaaaatctgtgctgatatagtttctttcatacctgatattaggaatttgtctcttttttgttttgatgatcagcctgctggaagtttataaatatttggtttcatagatttttctctattttttttttgttttattgatgttcactctgatctctagtatttccaaaattgttttttgtgtttaatttgctcttgtttttccaattattaaggcagaagctggggtagttaattaatctaaaatctattctcttttctactatagtgtttaatcccataattttacacataaatattgccttatcagcattccacacattttgaaatattgttttcactctcacttagctgaaaatgcattggtttctcttttgaaatcttctttagcccttgcaatatgtagacatgtgtaatttatcatcttaatacttgacgtttttccagaaaagttattattattaacttctaatttatttccaatgtggtccaagaacatacttcataggacttaaatcactccaaatattctgagacttgctttctggcacagaatgtattctatcttgataaatattctgtgtttgcttgagaagagtttatattatgtgactgtcaggtggactgatttataaatatcaataaaatcaagttatttgatagttttatttttttaagtctgctgtatcttcactgattttttttctacttgttctactaattattgatagtgagtattgtaatccccaactataactgtggagaaatagacaactatttctcttttgagttctattggtgtttgtttcgtttgtgttgaagctctgtgatgacatacgtagtgcttgttattcttagaattatcacgtcctcctgagaagcggaccctgttctccttataaaacgacattcttcatccctgatattctcttatctgatgtctactttatctgatatgaatatagccactccagctttcatttgattcatggtaactctttttcaatcttttacttttaatatgtttgtatctttacatttaaaatgtctttctcacaggcagcatgtacttgggtcttcatttttttcatcaaagctgacaatctctccttttaattgggatgcttagaacatttaacaagatttttgaaatggttatgttacacctgtgatcttgttattcatcttttactcaatccatctgttctttgctcccctttcctgtttagtgccctgttttggattttgttgttgttgttgttattccatctcatcttctttgttggcttatatgataacaaaactttttgttttgttatttcagtggttgctttacaactctaagttactgcagcctactttcacatgttatcttacttcatgtgtggtgtaagaaccttccagtaacatgctttcatttttcctttcctggcctttcgctattgttgtcctgcatttcacttacacataaattacaaactacacaaaacactgttgttatttctgtataaaattcaattattatttcaagattttttaatggaggggtcttatacatcttcctatacagttactttccagagctcttcatcctttattacagatcaatatttccatctgatatcatctttcttctgcctgaggagttcctattttatttcctgtgcagcaggtctgttggtgatacgttcttacagtttttttctgcctggatatatctttatttccccttcattttggaaagttatttacactggttacagaattcagagttaacagtatgtcctcttttagaatttaaaatattttttctatatcctcccagattctggtatctgtgatgagaactctggcagcatcctttgttaatctttatgtatggtgtgtcccatccctctatgtctgtatcactagggttcaatactttgattactatgaacctttgtggagttcttcatatttcttataggtgggctttactgagtttcttggataagagatttatagtttatatcaaatttgaaaacattttggccatttttttgtattattttttctgtccctcctcttttcagtccttctaggactcaaattacatgtattattggctgcttgaaggtgttctacagtttagtttcttaaaatccttttactctatttccttttggatagtttttattgctatgtcttgtatttggcaatgtttaatctgctattaatcatgttccgtgtatttttcatctcaaatttataagagtttttgggtgggcatggtggctcacacctgtaatcccagccttttgggagactgaagtgggctgatcatttgagctcaggagtttgagaccagcctgggcaacaagataaaaccccatgtttacaaaaattagccaggtgtggtggcacatgcctgtagtcccacctactcaggaggctgaagttgaggatagcttaagcccagaaggcagaggttacagtgagccgagatcacgccactgcactccagcctggacgacatagccagaccctgtcaaaaaaaaaacaaaaactttcataaccaattatataaccattctactacttagaggaacaaaaaagtcaataattcacgatttaaaagctactaaaaacataaaatataaaactatgcactaaggagttttatatataaatttacccattaaataaatatgtgtatgtacttctttaatttaaaaaattctaatgacttacagtttataccacaagattatttatacaaacagattattctcattccagagtgggctttttgggggatgaagtttactaagcaatttacaatgttctgtgaaaatcatcagctttttcaggttctgtagtaaagttataaaagttctaggcaccatatctttttaaaccataagaaaatacgagggcacatgtgtgtatgtatgtatgcatgaatgcttttatggcagttttattcgtaattaccaaaaactggaaacaacccaaatgaactggggaatgaatacagaacctgttgtacatccatacaacgcaatgctactaagcaacagaaagtaattactgatacataaaaacatggatgaatctcaaaatacattaggttaaataaaagacgtccgtctcaagaagccacatactgagtcaagcagggggatcccttgagaccaggagcttgaggccagcataggcaatataacaaggcctcccatttctattaaacaaacaaaaattaaaacaaaaaggctaaatactgcgtgattttgtttacacggaattctgaaaagaaaaaaaaaaaagacaagacagaggaaaaaacagatcagtggtggccagagactagaggtaaggaaatgggctgactatggaaaggggcatgaggaaattttttgagaaactaactctatatcttgatcatcatggtggttgcacaactagatgtgtttcccagtcttacagaaccatattcaaatacaccttaataaagataattttcaaccatacatatgatagaatcataattattactcttatactaagaccaaatagatgctgcttaaaccactgaggcaagaacactaaaccttggtctgatctgcctccaagtttgaaaactcccttccattaacattttgcctaaaaattaaacaatatttgtaaattagtcacaaaatcctttaagattaaaatatacatatattcttaaagaaaactacctagtgcttgcaaccaagtcattttaggagaaaattagctttgttaagaagggaataaagcccaagtaataaatattaacatccatcttttccagaatcatgatggtcaaaacaatgagactcttctcctaattttggttcaaaataccaaaatttttacttcaaaaactctctaacagattattataaaatcttaacatttgcctaaaagtctttaagtattttcacataactaggcagtataacaaaaaaagagcacaggcttaggctggatgcagtggctcacacctgtaatcctagcattttgggaggccaaggcagatcgcttgagtccagcagtttgagaccagtctgggaaatgtggcaaaaccccgtctctataaaatacattaaaacgtggcccatacctgtagtcccagctacttcaggggatgaggcaggaggatggcttgagccttagagacagaggctgcagtgagccaagatcacgccactcactccactctgggtgatagagtgggaccctttctcaaaaaaaaaattttttttaaagcacaggctcaagaactcaacccacctaggcaagttatttaacctaattttccatcgattgtatcatcagtaaaattgggataattttacctacctctaggaataatcctagactattacatgagttaacacatgtattataataaatcacagggtaatgcctggcatagttaactaagtctcaataccaacctaacataaatgaatgacaccaataatcaccagctgtgtagtctttgcataccacaattctgccctgtaaggtaagtggcctaaattcaatggcctaaataaagacctatctagtaatactactctatattcctattattttacctgaattgcacctacctaattcagtttgcaaaagaaaggttaagtattatacctcttatatataaaaaagtgaactataaataagttaaatgacttatccaaagaaacagtaacttgaaggcagagccaagatgaggatttggtattgagactccttaaaactttgtcctctccaaaatttttagccctccatgaattccttccctcctaacaaagatacgggtataatgcaccccccaaaacctccaatttaataatttaaaaatttcattaagctatacatttgatttgtgcactcttctgtatgttttatatcataatagaaaggttaagtggcttattacctaatacactagtattcacttgtattcacatatgaatacatacacttgtattcacatatgaagagaagtagtggaaaagttacattaaaagctaaaaggtgacaaactaagcagattatgttctttaaaattttgtgagaggcaaaagtttttaactgaggtatataatacatgtacaaagaagtgcacacttcctaagtctactattcaatgattctcataaactgaacacaaccatgaaatcatgacccagatcaagacagagaacattaccagcacacctacaatctcccttgtcctcatcaccaaagataaccattattctgattccattcccatctgttagttttgtctgttttttaagctttacagaaatggagtgctcgcttcggcagcaaatatactaaaattggaacaatacagagaacattagcgtggtccctgcacaaggatgacatgcaaattggtgaggctttccatctttttattattacagtagtctgtattatttcatatccaaaaaaatgatcaatatgaagaatgggatgaactaattaatactgtgattgaagacaatagcattatttgcctgggaaactaaagacaaaacaactggaaaactactaaaactgttaaaggagtcaatttgctacttatggaataaacatatactgtattcacagtaacatatattatggaattaaaatcacatttctggctgggcacagtggctcacatctataaccccagcactctgggaggccaaggtgggaggatcactggagctcaggagttcaagaccagtgtgggcaacatagtgaaacttccaaagaataggactaactccacgtgtagcatctacatgtggacaagcaggagtgtttcctgattaaataacctaagtgtcatctccatgaatgcatgtatacaactttgttggattgaaggctcctcatctcaaccccactggaggtaaatgctataaaagtaagtaattcaagaaagtttcatccaaattaactcatgtaaaacaaaaacaaaacaagaaaaatttgccacatcaaggtaatgttataaaatgtgtaatgtaactactgtctttatttgtgtctcacttacaaagtagatctgaactatggattactactacttactttgattaaaaaaacactgatgtgagatatttttgtaaattttctttacccaaaggttcactgcagccataaaaaagaacaaaatcatatcctttgcagcaacatgatgcagctggagatcatcatcctaagctaaacattgggtaaacatggacataaacatgggaacaatagatacagggaactaacagagaggagaggatgggaaggggcgaaagctcaaaactgcctactggcagctgggtacagtagctcacgcctataatcccagcactttgggaggccaaggtgggtggattgcttgagtccaggagttcgagaccagcctgggtaacagggcgaaacccagtctctacaaaaaaatacaaaaaatagcagggtatggtggcccaccactgtagtcccagctaccccggaggctgagctgggaggatcggctgagcccaagaggtcaaaactgcagtgaccagtgattgcaatattgcaatccagcctgggggacagagacctaccttgtctcaaaaaacttaaacaaaactacgtgctgggtgctatgcttactacctgggtgatgggatcaattgtaccccaaacctcatgcaatatacccatgtaacaaacctgcacactattattattgcgagaaacagagctaatttagaacaatatatatagcttgacccaatttgaggaaaaattttacatttgtatatttgttgaaaacaactatcaataaagaactaaaattgcatactattcattcatatgaccgaatactacacagctattaaaattaatgaagtaaggcaggtgcagtggctcacacttgtaatcccagctactcgggaggctgaggctcgagaatcacttgaaactgggagatggaggttgccgtgagccaagattgtgccactgctctacaacctgggtgacagagtaggactctgtttcaaaataatcataataataatactactaataatacacatatatcagcataaataaatgtaactttccaattacagaatgtatgtaccaaaatatcacataaatttgaaacacaatagtactacatgttaaatatatgtagatatttgtaggaagaatataagtgcatgagctaaaaagataaataacttctgcataagaaaataggatctaagaggatgacaaaagggactccaaccgtatgcatattttatttttaaaaacaaatataggccaggcacagtggctcacccctgtaatcccagtattttagggggccaagacgggcagatcacttgaggtcggttggagaccagcctggacaacatagtgaaaccccgtctctactaaaaatacaaaaattagccgggagtagtgacaagctcctataatcccagctactcaaaaggccaaggcacgagaattgcttgaacttgggaggtggcggttgcagtgagcagggattttaccactatacaccaggctaggcaacagagtgagaccccatttcaaaaataataaataaaaacatatataaatacacttttgaagcaaatctgataagatgtcagcatctatgaaatctactgaatgggctgggtgcggtggctcacgcctgtaataccaacactttgggaggccaaggtgggcagatcacgaagtgaagagataagagaccatcctggccaacatggtgaaacccagtctctactaaaaatacaaaaattagctgggtgtggtggcgtgtgcctgtaatcccagctactcaggaggctgagacaggagaatcacttgaacccaggaggcagaggttgcagtgagctgaaattgcaccagtgcactccagcctgagcgacagagcgagactccatctcaaaaaaaaaaaaaaaaaaggaaaggaaaaaagaaaaaaaatctactgaattagtacctggtgtttgttaaattattctccatatttttctaaatttttgaaatatttaaactttgctctaaaaaagtcgagattttggaattcagagacaggctttgtagattcagtacaggatgtgtgtgtgtgtgtgtgtgtgtgtgtgtgtgtgtgataaacctgttattctgtactataaaatttctaactaaaaaaaaattatattaggttggtgcaaatgtagttgcagttttcgtattgttgaaacttgctatttgatactggaatacattcttaaatatatgtggttatttatataccattttaatgcacatttctcaccttttttgctaataacatattatttgctgttttattcttttagacagtggaaattatattataaaaaaaagcaaattcaagcgattttcttgagttcaaaatgggtcgcaaagcagtggagacaactcgcaacatcaactacacacttggcccaggaactgtgcaatggtggttcaagaagtgttgcaaaggagacgagagccttgaagatgaggagtgtagtagccggccagaagaagttggcactgaccaattgagagcaatcatcgaagctgatcctcttacaactacacgagaaattgccgaagaactcaatgtcaaccattctacgcttgtttggcaatttaagcaagttggaaaggtgcaaaagctttttttttttttttttttttttttgagatggagtctcactctatcacctaggctggaatgcagtggcaccatctgggctcactgtaacctctacttcccaggttaaagtgattctcgtgcctcagcctccctagttgctgggattacaggcacccaccaccacacccgattactttttgtatttttagtagagctggggtttcaccatgttggccaggctggtcgtgaactcctggcctcaagtgatctgcccgcctcagcctccgaaagtactgggattacaggcgtgagccaccacgccctgccaaaaggtgaaaaagcttgataagtgggtgcctcatgagctgaccaaaaattttaaaaatcgtcgttttgaagtgttgtcttctcttattctacataacgacgacgaaccatttcttagttggattgtgacgtttgacaaaaagtgtattttatacaacaacagtgatgaccagctcagtggttggaccgagaagatgctccaaagcacttcctgaagccaaactttcatcaaaaagaggtcagggtcactgtttggtggtctgctcctggtctgatccgctacagctttctgaatcatagtaaaaccaatacatctgagaagtatgctcagcaaatcgatgagatgcaccgaaaactgcgaggcctgcagctggcactggtccacagaaagggtccagttcttctccacgacaacacccgacaacatgttgcacaaccaacatttcaaaagttgaatgaattgggctacaaagttttgcctcattcaccatattgaactgacctctcaccaaccgactaccacttttccaagcatctagaaaattttttgcagggaaaatgcttccacaaccatcaggatgcagaaaatgctttccaagagttcatcgaatcccgaagcatggatttttacgctacaggaataaacaaacttatttctcattggcaaaaaatgtgttgattgtaatgtttcctattttgataaagatgtgtttgggcctagttataataatttaaaattcgtaatccaaaaccaccattaattttgtaccaacctaacagtacctacatttattacctcaactgctcttcaactttctttttttgagacagagtatccctctgtcacccaggctggagggcagtggcacaaatctcggctcactgcaacctccacctccaggggtcaagtgattctcctgcctcagcctcctgagtagctgggattacagacgtccaccaccacgcccggctaatttttgtatttttaatagagacggggttttgccatgttggccacgctggtctcaaactcctgatctcatctgtccaccttggcctcccaaagtgctgggattatagacatgagccacggcgttcagcctaatcttactctttaaaagaataaagtaagggcagacaataacgaatgtcttaacccagaaatctcacctttttgaatgatgttctccattcacagaagcatttaaaacactacaagtgtgcagtaaacagcaaaagccaacaagctctaatcacttaaactctagagaatatatgacacagctcttcctaaaatatcaccagatgggtatataaacgtagaacggcttaactcccagctgtatattaacaccaaatctccaataagcctatactgtcataataaaaatcatttgcctaaatctcttccaattcatattagatgtattaatataaaccatatcctacctgagttgctacaactccacttgatatttaaaacacaccacaacacacaagcacacaaacacacatacacggatacagaacttgggagttcaggctgagttctgcatttacagagttcatagaaaccaatttttcttaaggtatctttcataattctcaatcagcttattaaaaagagaaaaactagatggctcagtcctcttgtgtttaactgtgatcaaatcccacaatgtcttcagtcatagtagagttcacaatgataaagttcaaataagcttacctgccccattcctcccatactacttcctacagctgccactcgtcttaggaactggagccagttaaccacccactttctcaatggtgactgtgacctaaaccttcacaagacatccagtgaaaaataaagactttaaaatagcagtttttggctgagcgtggtggctcagacctgtaatcccagcactttggaaggccatgggcagatcacctgaggtcaggagttcaagaccagcctggccaacatggtgaaatcccatctctactaaaaaatacaaaaattagctggctgtggccagcttgtgcctgtagtctcatctgcttgggaggtcgagacatgagaatcgcttgaacttgggaggcagaggttatagtgagctgagatcgcaccatttcactccagcctgggtgacagagtgagactctgtcttaaaaaataaaaataaaatagcaatttttcctacttataaaagtaatacatgctcattgtagaaaaatgggaaactatagaagaataagaagcaaaaaagccacattatcccaccgagacagaaattaatcactactaatatttccattcatggcaatccagggtctcttctgtatatcaaagtgtattagttcatttaccaaacaggattttaagtactgcagaacaagggggaagtagcatactaattctttggaagactaattttcttcagtgtaaagaagttacacttactgctgagtaagtcaaccatatgtacaggaaactggagagaatgacaaaggtgagggaaatcatgcctgctttttcttcattcactcacagcaaaccatggagtccatgttttgggaaccattatgtatgcaaagaccaactaatgagtatgtttcctttacaaatagcagcctactaaataaacaaatacatacatacatatatacaaatatacagtcttgccacaggagttacacacacagtgaaaggaatgacattaagagtatttttaaaattattatactttaagttttagggtacatgtacacaacgtgcaggttagttacatatgtatacatgtgccatgttggtgtgctgcacccattaactcgtcatttaacattaggtatatctcctaatactatccctccccgctccccccaccccacaacaggccctggtgtgtgtgatgttctccttcctgtgtccatgtgttctctttgttcaattcccacctatgagtgagaacatgcggtgtttgtttttgtccttgccatagtttgctgagaatgatggtttccggcctcatccatgtccatacaaaggacgtgaactcatcattttttatggctgcatagtattccatggtgtatatgtgccacattttcttaatccagtctatcattgttggacatttggattggttccaagtctttgctattgtgaatagtgccgcaataaacatacgtgtgcatgtgtctttatagcagcatgatttataatcctttgggtatatacccagtaatgggattgctgggtcaaataaatgggatctaattaaactaaagagcttctgcacagcaaaagaaactaccatcagagtgaacaggcaacatacagaatgggagaaaatttttgcaatctactcatctgacaaagggctaatatccagaatctacaatgaactcaaacagatttacaagaaaaagacaaacaaccccatcaaaaagtgggcgaaggatatggacagacacttctcagaagaagacatttatgcagccaaaagacacatgaaaaaatgctcatcatcactggccatcagagaaatgcaaatcaaaaccgcaataagataccatctcacaccagttagaatggcgatcattaaaaagtcaggaaacaacaggtgctggagaggatgtggagaaataggaacacttttacactggtggtgggactgtaaactagttcaaccattgtggaagtcagtgtggtaattcctcagggatctagaacaagagtatgttttttgtcaccatgaaagtatcttaagagacagtaaagggatatgtgaaaggttgatctaaaattcatgacctcttccacaaaaatagtttctgtgcacataagatgaaggaacaatctaactacggaaaacgtaactgttgattttataatgctataacttatttacacgtataaataaatatgcaggagtttaaacagttagtccacaaatatggatagcttactctgtaccaggcaatgtattaactgctagggagtaagggagagaacagccaccagtccctatttctgcagaactttcaatctgtctcttgaagtatgatgtcaaacactaggcatgtggcctcaagcaagtcacaacagtcctgattaaatgatgatctcaaatccttgtgatgatctaagaagatatatgtgaaagtagcttataaatcatgttacctaaagtaaaaagagatatgtagccatttgtgcaaagcactgtttatagcaatcatcttcaatagaaattatctttatttatttgtttattttttgagatggagactcgctctgtcacccaggctggagtgcagtggcgtgatctcggctcactgccacctctgcctctggggtttaggccattctcctgcctcagcctcctaagtagctgggactacaggcacccaccaccacgactggctaattttttgtatttttagtagagatggggtttcaactgtgttagccaggatggtctcgatctcctgaccttgtgatccgcccaccttggcctcccaaagtgctgggatggcaggtgtgagccaccgcgcccggcctctcatttcttttaactggcaaaaaataatcactcaagttgcttaatataatctcttttgacagtctctaagattttgatattatctttctctgccaatgacccatatgaagtaactgaaattaattttcccatgatgggggagaaaagattcacttttttctaatacaaaaagctttatttcctgatttcataatttataggggttagggggcaggcagccacagatcaaaagcaacttattcaaactcaagaaaaaaattatcttttaatctaagaatcaccatggaaagtttgttataggctcaggctaatccaaatagttagtgacaggttaattgtggtactttgaaagcaaaggagagcaagtagcaattattcttcccttcactcagtctctaacacctaacctcttaaaaaacagggagatatatattatagccaaattgctttccaaaaaacataatttttaaaaatatgctctacacagtatcaactgtttgtatctaaaagaaatagactatttacattgctttttatcctacgatttatccttttcaaattcagccacctcaacgatgcaaaaaagtatcaaactgatgctttaaatttatttttgcccttattgcagatacgactctaaagagcatggggagttttttttttttttttttttttgagatggagtctcgctctgtcacagacgttggagtgccgtggtgcaatctcggctcactgcaacctccacctcctgggttcaagagattatcctgcctcagcctcccgcgtagctggaactacaggcgtgtgccaccacgcccagctagctttttgtagttttgtagagatggggtttcaccgtgttagccaggatggtctcaatctcctgacttcatgatccacccgcctcggtctcccaaagtgctgggattactggcgtgagccaccatgcccggcctagcatgggacattttaaaggcattcataatccaactaaacaggaccacctgcaaaactagtgaaatgcccaaaaacaaacatctataaatgcccaatattaaacctcaagggtctaaagcagtagtatccaaagcaagtataacatacctccaggagatcgggcatggtggctcacacctggaatcccagcactttgggaggctgaggctggcggatcacttgagcccaggagttcaagaccagcctgaccaacatggtgaaaacccatctctaccagagaatacaaaaattaaccaggcatggtggcagacacctgtaatcccaactgctcaagtggctgaggcacaagaatcacttgaacccaggaggcggaggttgtagtgagccaagattacaccactgcacaccagtctgggtaacagagcaagactcttgtctcaaaaatatgtatatagatcatatattattatatatacatatatattatacatatacacacacacatacatatacacatgcgtgcacacacacacacctccaggagtacccaagaagccccagggtaaaaaaggaaaatatttgaactttatttttaattatcatccttgttaattttttgtttgtattttaaagtccacaataatcagttactatatgtttattacttgtaaattaaatatctaaggattaagaactgatgctcaatatttttctttttctcttttttcaaagcaacaacatgaagttgtatcaatttttttttctgacttcattcttcccatcccatcagttttttgttttttttttaaagagacagggtctcactatgttgcccaggctggagtacagtggctgtattcataagcacaatcacagtgaactttagccttgaactcctgacctcaaatatcctcctgcctaagccaactacgtagctgggaccacaggaccaggtaccacacctgcttaatgctcaaaagtttttggtgatggggtaagcaaccaaagtttggagaccactggtctacacgactcattgtcactgaactttcatttttatcagctccctcccaagagttaatctatggaagtaagtcctgatgctgaaaaagaaacagaagaaaaactgtttcaaactattttgaactcccaacaagctaaagatgacaaatcactagcaagaatatatggaattgaatactaatatgctgctgacgggaatttcaaatagacatcctatctaaagggcatcttgagtatatccacatttaaaacacacataccttttgacctaataagccctttttttttttttttttttttttttttttagaatgagtctcactctgtcgcccaggctggagtgcagtagcttaatctcggctcactgcagcctccgcctcccgggttcaagtgattctctgtgcgtcagccttccaagtagctggaattatagaccctcgccaccacaccagactaatttttgtattttagtagagatggggtttcaccattttggccaggctggtcttgaactgctgacctcaggtgatccacccacccgccttggcctcccaaagtgctgggattacaggcatgagccaccatgcctggctaataaatccgcttttaagaatttatcctgggccaggcgcggtggctcaggcctgtaattctagcactttgggaggccaagacggccggatcacgaggtcaggagatcgagaccagcctggccaacatggtaaaaccccatctctactgaaaatgcaaaaaattagctgggcgtggcggtgcacggctgtactcccagctactcaggaggctgaggcaggagaatcacttgaacctgggaggcagaggctgcagtgagccaagatcataccactgcactccagcctgggtgacagagtgactctgtctcaaaaaaaaaaaaattatcctaaggaaataataggacaattcaatgcccaaacaagttcatcacagtactactttaagagaaaaattggcaatatccattaacaacacagaactgctataaactatgatgcatccatattatagaacactaaatactcatttactcattaaggggatatcaattttacatggaaagttgttcttttttaaggtatttcaataggtatgcataagaaaaaaaatgaaaacaccaaacatcacatccagatgggattacaggttatctctactttttttaaaaaagaaaaacattaaaactgttctgggccagatgcattggctcacgcctgtaatcctagcactttaggaggccaaggcaggtgaatcacctgaggtcaggagttagaaaccagcctggccaacatggtgaaaccctgtctctactaaaaatacaaaaattagccaggtatggtggcgggtacctgtaatcccagctactcgggaggctgaggcagcagaattgctggaacccaggaggcagaggttgcagtgagctgagaaaacgccactgcactccagcctgggtgacacaatgagactccatctaaaaaaaagttctgtagctttcataatcagaaataatttcactttgaaatttaaaatgagattaagttaaaactccaaattattgtcctgtatcacttctaaaactctttgtaaacactctgtcttcccatgtcatttgtggatcagtccaaatacttaatctaatatttggtttatctcatggaaaaatgataggcatataataaacaacaaccctgtttcaagttaaccatcttgtctttataccaattcttgccagttatgtcatgatttatcaatatacttataacttccttatattctgccagattataaatctatgaataattctgaaaattattcagaaatttctatctctcttctgcaactaagttacaaaagtattaactacttcgggaggctgaggcagggagaatcacttgaacctgggaggcggaggttgcagtgaggcgagatcatgccattgcactccagtctgggtgacagagcaagactctgtctcaaaaaatatatatatatatgtattaactactaaagaaattagatttagaccccagataagtgaaatcagaaaagcttgctaccatctgtcacaacagaatcattctgaatatctatagttatcagatcaagacaatacctgtgtggttaacaagtactccacactccatcttaagggaaaagagtacttaagaagattattatagcataagtttatgtgctttgttcattaattcaacaatttagaacaaagctatgaggtatttcaccgctaacagaatagctttaaggtaacccatcttcacaattttctctttgttttcatttgtttcatgccttactattttatagacagtcattctatcggcattgcacaagtactatgtccctaaacaactacgaccaagttttatcacgacccaaaagaaaaaataactttctaggccaggtgcagtggctcatgtctataatcccagcactttgggagaccaaggcaggactactcaagcccaggagttcaagaccagcctgggcaatgtagcaaaaccctgtctctacaaaaaatgaaaataataatttttaaaaagaaaaaatacattttacacggcaaccaagtatacatacataaacatatcttttaaaaagaaaggtttcccaaatcaatatttacttttactttacacaatgtactgatatattcttttttaaaatgctttttaaaataagtacattgatttcattaccctatgacactgccacctgctacttaaaaatgtagccttaaaactttatgcagagtgtgctaaactccttgctcctaccaccttctcccacgactccaacataagaaaatgggtaaaatctagcaagtctattctaagtacagaccttggcataaatgtgagacaccccaggttcctctgaagtccctgcaacattgtgattattccaactggcagacaggatacatttgctgaaaggtttctccagccagactacagaagcagaaaccttttctgttgccttatcagtgatattgctaaattctgcacttgacaatgtggaccaggtttactactgctccacaagccaattcttccaagaaataaaacaggattccaatataataggattctaataccagacccttacattttttgaatacttttcatacacattattccgttgcattctccccctggcagtctgttagaaaagtagagaagctgctcttcttcctttcactaatgaaggaattggagctcagaggggttacgtggcttgccagaaacaacacggctaatgaagaatacaacgcaggcttgaacccaagatttactcatctatccacttttatgctacaattttcatttttaatatctgatacaagtatgaacttaaaaagtatattgtttctagatacaaaagcaaaggtgaaagcatgatatcaatattgatgataccaaaaaattaagattaaaaatagcaatgacatgttaataattttggaggcctctaaagttactggcagtcctagttcaatccaatatgaatctgatatcatcttatatcttcaatcaatgttacatgattataaatttatgtatatattcaccatagaaaattacagaattgggtggtaagaaacaactagctatataaattgcacatactcccccaaaccattctcaagtcttgtggcttcacactaaattatgaagttcccaatgtaaaacctgatttgatttcatcactaagcgaattacaacagcataagcatgttcttactacataatacttgcaacatacattcaatttccgaagcacttttggacaatgtctaaaatccataagctaaaagcagaacccaacacagaatcttgtttcttttaaatggcaaaggttagtctacctatatgagatgaataccaaataacataattagaacttattaaaaatttacagaatcaggctagagaaactacttgaggtcaaagactataggcccttaattgtatagatgagaaaattgatgcccagagaagttaagtgacattcccaacagcaattaatgacacagatggaatcagaatatatgtctatctgtcaatccagaacttcccattattctatattacctctgcatttaatgtgctcttaaaaaagtcactaacatctaaaacacttaagacacattaagactcaaaaaccaggggacacaacaatgttcacgacagtcttcagaaaacaatttcttaaaggaatctcaaaaattccaaacaacaagcactgaaagctggctctttattttttttattttctttcctatccagagccctacttgatcaaaaactggctctttaatccattgcaaattatcaagtagcttttaataactaacacggctataaaccaccataactgttcttttttccatatcaatactattcacttactaaaaaaaaaatctgagggtatagaatatgctgataactgtgctgggtattggcgacaccagggaacaaaacagacgaggcctctggctcttctaatggacagctgggtgcaactctctaaaaatactacttcatgatttgacaggatatttgccaaagtccttcactactctacacaactataacaacattttcttccacctcttccaaacttataataaccttcaccacaccccctctaaaacgtgaatacgtcctttggtaactcagcattctacttcactaaagaaggtgtgaacgtgttaactagaactacagcagatttttaaactgactttaccactcctcacggcctgcggcaaatttcaagaacttttcacaatctgtagtaacccttcctggttcacaaccctgatatcaaatgactgctaacacacccatcctaccctccactagaaatctgagtcagatggtttaggagcaaccatgttagggagcatcttcagtggacccctttatgagccagaagctgacttacttcctctccttctctgtttatttcctctggattcttgtgtatctctggatacaatgtatctccaattaatcagcatctaattttatcaagtgtgttcctgataacttgtgcacaaattaacttttggcaacaaatctgtttcacctacacaaatccattatattttaagagatgctcaatttgcatcctttaagtttctcatgcttccccttctccacttcttaaattcttaaaaagctataaactgcataagttcgaggaacttaggtcgtccataatattgctaatgaccagccttaaactagacaaccactgaagaacctggcctatgagctgagaaacttgggttcttttatggctggccattaacgacaagtggggctgtaccactgtgctggtcacttgaagttctctgagtcacctgaaaatgagggagtaattggagccaaaagaggtctgtcgtcataggcagccaatctagaattctagaatcctccaaatttagtttaatatcacatactatactgggttactcaaaacagtgtcattctggctgggggtggtggctcacgcctgtaatcccaacactttggaaggccgaggcaggtggatcacttgaggtcaggagttccagaccagcctagccaacacggagaaatccctgtctctactgaaaatacaaaaattagccagccgtggtggcgcacacttgtaatcccaactacttgggaggctaaggtgggagtattgctagaatccgagaggcggaggttgcagtgagcagacatcacactactgcactccggcctgggcggcagagcgagataacgtctcaaaaaaaaaaaaaaaaaaagtgtcattctgtaagctcttctagcctgcccaagtcataggccctataaagggaagactttctgcatgccatcaatgtctcctgtcctactgaacagccctgaatttgaaaggggatggtcccccaccacctctccacggacaaatcataaacatttaacatttaaaaaaaatcatctcctgtaattcaacccaggcctctcatggcattaccattcacataagagaaagttgaacctcaactggaaaagtatatggtttggggatgttgttttgtttgtttgggttgtggaaaaacagatgtcagaaaacaaagtggatatcaagatactagaacagtaagaatttaggcctcggtctgcaaacgacatttgaacatcaatatgtaatagtagttcatgtccaaaactcacaagtgagattatcaaactccaggggagtctattaatgtggccataaaatctaccccataattttgacataacttttccagcccaaaatacgactgacatcatcttatgggtccggaaataccatacatcaaggaaaatttctaccggagaaataacactgtaatcgtttggggagcagtctgaccagtgttccctgagttacgccaaccgcccccaaccatccttcccacctaattattaccaggtcaggaggatgtcctgctgcacgctcaggcggtcgctcctcctttccacaagacccaggcccgcaccgttcgccccggggctcccatggcccccgacctccagtctccagcaacgatggatccccacagaccaggcagggggcgaagggcgcacacccacctcccgggagtcagtgggaataaccccgggcgctcccaggatacgtcccacacccggagccgcacgggcccatccccgccaggtctgggcaggcagccggagcccgggaccccgcctcccccgcacctagggtcccggccgagctcgaccgctgaggtcccgttcccactcccactcccagcgcctccccctggcggcggcggccgcccgggacgcccctcccctggcgctgcctcctcagagggtgacagccgcctggccggggccgtacagaggccggcccctcctccagctcctcctcaccccgggaggagacaggggacggggatggggttcttaccaggcagcaggacatggcaaggcccgccacggcacagcctcctcctccaccatctcaccaggctccctgccaggcccggcgcagggcagcgactgagctactagggcgtctggtccggctgctactccgccgccgccgccgccttctcacaaccacaacaacactgcagcagcggccacacagagtgcactcccgacgccgagccgggcgacgagcggagacgcgcgcgcacgctcgggcgctgaagccggtgtccgggaaagggggcgggtctccgggaaagggggcgggtctccgcctgttggacgggggcggggcctggacaggtggtcacgccccaggagataggcggggctgcagcccagacgaataccagcggctggggagaggctcgcgaaaaagaccagcggaggcagaagggctagacagatgggaattgggcgcaggaaaagcgatgacaaaaaaaaatctggaagataaccaaaggtggtcctacaaatttttaggaggcgtctttccctgggcaagacatggctcactctacttaccagaaaaatagaacaacagtggttatctttcacctgcaattgtggtcaggataaaaccagtttaatatagtgcaagtaaatgtagtgttttagaagatgtattcaggatacaatttctttttttcgtttctttttttttttctgtcgcccaggctggaatgcagtgacatctcagctcactgcaaactccgcctcccgggctcaagtgatcctcccacctcagcctcctgagtagctgggactacaggcgcagaacatcatgccccgccaatttttgtattttttgtagacacggagtttctgccattttgtccaggctggtctcgaactcctgggctcaagcaatccacccacctcggcctcccaaagcgctgggattaaaggcatggaccgccgcacccggtccagaatacaatttcaagctgattcaacttcagctcctaatcaaaagcttagcgggaagaagtgaattttcaaacaaaataaacccctccccccaaaattgtaacctacccacattagcctgcagaattccacaaaccaggattgcattaccgcaggccctaacagattcacctcctctgagttgccttttaacattctacccttgacttttctggaaactgtctgggagagctagtcaaatgaaatctattcctgcgtctgttgtaaagtttttccacagcactttctgaaatttattttcaatgtttattgttttttcactccacttagaaggtaaaagctacttgaagataaggatcttgtttgtcttgttcatcactatttccccagcacctagaactgtgcaggctaagtagtaggcagtcgaatttcttgatagctggctgggcgcggtggctcacggctgtaatcccagcactttgagaggctgaggcgggtggaacacctgaggtcaggtgttcgagaccagcctggccagcatggtgaaaacgcggatctactaaaaatgcaaaaattagccgtgcatggtggcgggtgcctgtaatcgcagctaattgggaggctgaggcaggagaatagcttgaacctgggaggcagaggttgccatgagccaagattgcgtcactgcactccagcctgggtgacagagcgagactccatctcaaaaaaaaaaaaaaaaaaaaaaaatggctaacatttattcatacaactcatctaattgaatcttcacaactttaataggtagacgccgttatctccatgttacagatgaagaaagtgaagcacagaataaattgcatgtattaaaacaaaattcaaacccaaacccagcagacaacaaacaaacaaacacacaaacacacaaaaaaccactgtactctcacccaccaggctgtactgcccagtgcatgacacaatagcctgaaataaaatctcaagtaagaaattactttaggccgggcacagtgtctcatgccggaaatcccagcactttaggaggccaaggcaggtggattgcttgagctcaggagttccagaccagcctaggcaacatggtgaaatcccacctttacaaaaaataccaaaaaactggccaggcatggtggtgcgtgcctgtagtcccagctatttgagaggctgaggtaggaggatggcttgagcctgggaggcagacgttgtagtgagccctgattgtgccactgcactccaactgggtgtcagagcgagaaaaaagaaagaatgaaagaaattactttagaggtaaattcttggaaagcccttgctttactaccagaaaaaccagtgcgcttcctgctttttgataactcttatgcagctggttgtgtctctcttttcactctggcttccagaaagcccagggctaaatgtgaagctcagcaatgacccttgcttggcccctaaggtccactcttgcctcgactttgcacctttatttatatgtggctgtcctgattttccctttgtgttatatgactgtaggctttatggaatgggagaagaaatagtaaacacataaaattgatgaatgacttaaagacttttattttatttttgagacagagtttcgctcttgttgcccaggctggagtgcaatggcaggaacttggctcactgcaacgcctgcctcctgggttcaagtgactctcctgcctcagcctcctgagtagctgggattacaggcatgagccacaacagccggttaattttttgtatttttagtagagacagcgtttctccatgttggtcaggctagtctcgaactcccgaccacatgtgatccgcccgtcttggtttcccaaagtgctgggattacagctgtgagccgccattcccggcttatttttatttttatattttattttattttcacacaaggtctcactcttgcccaggctggagtggagtggctcacagccaccaggtgatttgggcccacaagtcacccttgctaagaggcagagtccagagcagaaactgggtagatgccaaaggcagcactccctactccacacatgggtttctgtcaagtaaatcaccagccaggtgaggtgcatacagcatctagggagatgggacaccgtgttgtcccctccttcagccaggaggccccacactgagcgccactgcctccactgtctgatgctacaggagaaacgtttcctgctggttaaggaagtagaaactgcagatcacttttcatcttattggaaatcactctttgacactcttgcctcatcttcactcagtacacattgactctaccagcaatagcgtaaaaataaacacagattaaggaaataggaatcctttattcctgggacttaaaagcttgactttctccagtaagtcaattaccagtgcccacggcaggaagagctctgatgccagggttgacagcacgctggaaaaccggaggagtgtttgcatttctggggcctcaagtaatgagaagttcttccaagaacactgacaggggtattattgccctattttagaattattactctgaagatcagggaatttcaggcggttgaactcatgccacagcacctgtgcttttctggtaggggagggatggagtccagctcaggagtcccccgtcatgggagaaagcactgtgaggggatgtctgtgggggaattagaaccctatagcagatgggatagggtggggagtctacatatttttatttggatgttttgatggagtaaagttccaaaccaagcaagtatcaggcagggggcagtccaggctgtggtgctgtgctgtgaggctgggagtccaggcaggtcctgtgttcactggtcacttccacagcctgaagcccctcgaaaggacatctgcacagaggcccgctagtgacttcaggatgctgatgatgccctcaaggtgagagccagagaaaatcccgtcaactctgtcaaccaagggcatcaatggccacgtgtgtggttttctcctgcaaagaacaagccagtttgcaaaccatgcttttgaggctagaaaaatggctgtattccttcagtgtctcctgaaggctgggtcccctgagagttgattcaaatactgtattctcgtaaaatatggtaacatttagacctgaaaaatggcctgggggataatcttatcaaacctctgatgtggttattttgtaactgagtatattgaaggctggggaacaaagccatctggtgccagcatcctagctgctctctctcctccaggggcttgccttggttgggggcctttccagcaaaattaggctgaagaaatgagattttagttaaacaaggcccactgttgctttaagacaaaatgtcaaagttttaaaaaatgtattaacttgttcttttggccaagaaatcaatagatgcacttcctttccactgtgcaggcactgagctgacagaggagtaagagcttgaaccatctacgtggtctgagtgaccacatccttcacttggagccctgttctacagcagataattctgagtcaccccagctaatggctgtgcacagcatcctgatgctctgattaggctgaggggcttgtggcgtggtggctaggctgtctcagagagcacctcaggctgggtggaccaggctgacccagaagagggcaatgggcctttgacagggactagctggctactatctgcctcttctgcagtttgggacacttagggtcatgggtgaaagtgtttttccacatatagtggcccgaaaggaaaggaaactcatgccagtgttcagaaagcgtgcgggtttctcaggtaacgttactgcagccactgatgtctaatccaaagagctctgaatgcttgccatagagatttgtagttttaatactgaagccccgaatattctgatttcctcattaagaccgacctaacacgagctatgcagtcagctaaggtatcaacgggaggaaattgccagtgtttccctcttattttcctctgaggtcatctgaaaacaaccgcagtgaggacggagttcgtgcggccctgatggctgtgtgttcccagctccaagcatgcactaaatatttaattcatttgaatataaataagttaatgaatatgaatacattaataaattaattggcatcgttttagtcctgttgcagtttcaaactcaccgatttatccaacttctttgcactgagttcttattcaagtgaagtattccggtcttgtgacttgtacttctgacatagtaatagaacaactaatatttatttagaactttagtttaccaagcactctacattttattttattatttatttgtttattttttttagtagagacagggtttcaccgagttagccaggatggtctcgatctcctgacctcgtgatccacgctcctcggcctcctaaagtgctgggattacaggcttgagccaccgcgcccagcctacattttatttttacattttgtctttacaaacccccacggggcaggcattctccttacacgcagtgttaattggtgacacagaggctcaggggtttaaatggtttcactgtaaacaatgtaatctagtaggatgttgctttcctatttttcctaatactaccatgtttagatgcaggcggctaagtgagagtatatgatttcctgtgtatgtatagatgtaacccacactcataggcggaaagttctgcaggctgagaagtgaagccctttgctgaacaaccaccaccaacattctaggacccccacacccttggttctgcaggctacacccctcccatctgcttagaagcagaaagaaaactctgcggttacttttccctttgacaataagccgcggttctcttcaacgttctcctggggacttgggtcaatgttcccccatgcaaatgttagccaggcccagggttattgtttcccctacccctgaggattgatcatggcatgcaactgccccatattgtattttggtcacccccatcggcatcccatctgctgctagtgcctctggccagcttctcgcatggtcctgacacggtgctgtcactctcacattatttgcacacattgtttacctatagctggacacattgttcataggagcccagctggtaaagtaaaaatattccaagactgtgctgataagctacttcttccctgcatcctgggctggtgagaagctaaagaggaatgaatgctctgcctgtgaagaggccgcactgcagagaagaggaggcagagatgcagtcgtcacggccctaagaccctgcctggacccggttttgcaagtcgagggaagagttttgcacaaattctcactgggagcattgtcagggctgcagccacatcacttttttttgatctgagtccttttaacattagctatgatgtcaaaaaagatgaaattgaagttgtcaacatctggtggaaggcaaaaaccagtgaatttctacccagggagagttcctctgcagggtccccgcttctggtggcctggagttggggaggcctctggagcaagtcaggggattaaattctgggttttcttccattttattattttcctattttgacatctttgaaaaatggctcagcctcatagtgtatgggtcttctgattgcttttgtcttgattttattctgactgaggggcaatggccactgtgggctcctcatccaggatgaagagggcccctctgtggcctgggtgcatccatgctcttcacggtggcctcatggatcgtcatacaaaggatgatctcagtgatgagcttgagcctacccaaaattaaattatatgggtttataagattcctcctcaggatcagtatcatcaggcctgtccctgctggtagcaaggccatctttataatgtgctgtcatggtggtaaaggcatcactcacttgatggagatcccgaagaccagctctactcgagagagatttaagctaagttgcctgggagtccttggtgctttttcgaggttctactgaagacaatgccatcatccaagtatctctgaatgccaacgtagctcttgcctcaggagctctgagacccatgttatctatttttgaactggccaaggccccccacagcaaggaaagggatgctcttcccatccttgtcagccctcgtgtcttgtattccaccccacagcctcctagcaagcatctcagtgtctgcaggtgagcatggctgagttcagtcttgcttactgcaactgtagacatgaggtctgtggaagtaagaatcctctcatttgctgactggcattttgtttaagtcccatgtcactaatctctggcgagacaatcctctttgtgtttcctggtgatggacttgagtgatttcaatgtaaacagtggctccacctgggagtgtatccccttcccacggggagggggtgcatagcccctgccaggtttctgctgtcctctcatcctcccactgggcttttcccctgcagatggcctggtgcccacactgcctgcaaatggtcactcttgcttgtcccaacaccacctccactgcagcttccaagagccctagaagggccgggccctggctgagcactattcctaggccctggatggcgggtgtggaactatgttctcatcaaggtcatttcctcttctattttcatcatgttaagtaaatccctctctcatcatgaaatgccctggagagaacagatgcatagctgtggagtcttgttctgggatatgtcaggtacgggctcaggtgtgtggaggctacagggggtggacatgagtggtctttctctcgctgtgaatcacatgttttgtgccagcccaagggttctgtgaaggagaatcagccgtttacctggctgagtctaaccctgggatggcgacagccgaaaccccagctccattccctgaccttccctaggctgccgcatgggttccctggcactgtcactgggctaatgccttctgtctcctcctggggtgaggccagcctttactcatagtttctgcccattccacatcattctgcctcccacccttggctttttcaaaaatctgagccaagcgtgtgcaaggggttagaaacatgctgtccacagggaactaaaatacactgagatgagaaaccagcagcacctgctttggagctgtcacacctgggaactgagaagcaaactctcagagatgcctggaaaccttgggagcacatgagttctctgcatatatttcggttgcagatgagtttctagtcaaagtaaaaaacacatgaagggcattcatgtttccaggaacagaagcatcctgtctgatttttcagaggtgaagggagcagtctgaaggggccgtggcataagtatgtctacaatcaaagctcacagccaaggccctgggggaggttcaggtgtaccccagggggtgcgccccatccagcactccactgacaggggcctcgtctttattaaattctaggccttttcctgggcactagttacaaaaggtgggttcaatgaaccctaggttctgtggctgccacccatctcagggtcgcacaggtaatgattgccaccccctccaccttctgctgagggtcctggtgaccccctggtggtgtaacccaggccctcacccctaaggggtcctgagccttgctcaccacagagtccttggtctagggctcccgcacttgtccacatgccatcaaatgctgtgtaccgggaggtacttgcgtggagcccctccttccccaggcagcacagccctgcttctgctaacaccacggtccaggtggtacccatttttctgcctgcaggtcccatggaggagtagcctgaggacaaagcagcacccggagcttgttttttcagagaacctggcccagccctggctagaagccccacaactgtggaaaccagggcctcctgcttttcagagcctagatatgcaggatatagatgcccctcagaggtcctggctgtgaggtggaaggttgggggacactgggcttcctactgctgtgctcccattgccacatcttctacctggtgggacaaggcagctagcaaaggtgacagattcacccagacactgtgtcctcccacatcctgacctggcacctgagccaccactgctgggtctgaagctcccaggagtgtgtgtgtgctgtgaccagcagacctatggcatgtgccctcttcctccctctgtggtgtgaaatcagttcctctgatggtgtcatgtgaggtctttgtcctgatgggtagaactttctataaaccatcccatggccccggggaaaggcaagctcatcccttcaggtttagctgtttctgttaaatgcaaccctgtccttcccagggcatcagggccccgtgcagttgtcccagcctggcaggaagtccccttgaggattgtgtggagggcgcagcctgggcctgactcgtgaccctggcaaagagcaggtgagccctggggctgaccacctgcacttcctgtttggtggtgggagatgtggggcaatatttcttgcatttcctttagagagcatctcccagcctgcccagacaaccagacccctaaacatgtgacttgtaggcagggcctggctctctgtggtgcttttctgtctcctccaagcacctgtgactcccaggcttccagccctgccagcttcccccatctgagctcctgatgcagggtgaggactgtattgtggcagacagcatgccggtttacacagttctgggacgaaactgtaggtatacattattttatgtcccgagtaaatgaatcctatttatggatactttttttgacacagagggaagaaaggcattggtgagatccacgggccagagctcagcctgtgctcaggctctggcagcagctgtgcagctctggagctgttgcagagtggggaggtgctgtgtctttgctccctgtgttaaaggcttcatttgtgtctttgttcagtttgttttctttgacccctgttcagcaatactgaaaatcaagcattcctaagaggtggagactttgctttggagcaggggcgggggcattgggtggaaatggggaatagcttgatagtgggaatttcattttctggagctcacgtgcagcctcttgatggcctcgtcacaagttcacctgatgacctgagtggccactgtccttctcctgagtgagttatgtgcttgccaggcacatgagcagtgcatgctcacatttttcaaatgaaggaactgagaagggtttgtcagcagattgtaagcctgaagctgccagtgtttggtccacagtaaaccacatgtggagagcttaaaaaaattgccctcaaatctggcaagaaaatgacagtaataaattaaattattactgtgatacacatgtttctttcattacaattagatatattacacatatcccaattttgcagaagtttatcatctatcagtatttatttatttttttttgcataagtttccaaggaatcctaatgatggggactgtctcttttaaaattaaattgtgtaaataactcccagagccatgctggtaagaaacaaaacaaaacaaaaagaactagaaacatgaacaaacattggatttctgctgtaaagaggatgcaaagcaggcctgcctgctgcacctccccagagctaatccttgagccaaaagagcttcctggtgaagcctcgcactctctgtaacagggcgtggggggaccaagacatgcgggctccagattagaccatctttacctagttatgggatttcagtcatgtcttttaaattctttgagctgcagttttcacatatgtaaagtgaaagtatttttaaaattttaatttgtgttatgaccttgtataaagttaaaatagtacatttgaaagcattgtagctgaagtcaaacgttcacgtgtgtgcatgcaatggcttcttaattattttagggcttaacctggttttactggtactgttactagcactgctacttctccatgtctctgaagactatgaaatacttagaacttaagcaacaagaagcacctgtcaaagcgttctatggccgatgacagatttgacacagctggatatagtaatatgttcgatggtgcccagatcattgctaagcagagacttcatgctattctaagtcgaaagtgtccctagaattctgaacctgctgaagcagccttcagaactgaagttgagaaaagtacattttctttttttttttattattattatactttaagttttagggtacatgtgcacaatgtgcaggttagttacatatgtatacatgtgccatgctggtgcgctgcacccactaacccgtcatctagcattaggtatatctcccaatgctaaccctccaccctccccccaccccacaacagtccccagagtgtgatgttccccttcctgtgtccatgtgttctcattgttcaattcccacctatgagtgagaatatgcggtgtttgattttttgttcttgcgatagtttgctgagaatgatgatttccaatttcatccatgtccctacaaaggacatgaactcatcattttttatggctgcatagcattccatggtgtatatgtgccacattttcttaattcagtctatcattgttggacattgttggttccaagtctttgctatcgtgaatagtgccgcaataaacatacgtgtgcatgtctctttatagcagcatgatttatagtcctttgggtatatacccagtattttcagttaaagaaagtctgagagaccgtgttgccatcacacccaaaccccaataaataaacttgttcaggatgaagaaaaataacagttggaaattctacttcacagaaaagatgaaagtgtgccaaaaatagtaaatatgtggaggggaaattactgttttaatgacatcctccaggaattacaacatgtacaaaagaaaaatctatgacaacatggcacaaaagatgagaggatggtaaggtaaggtttttatattttatatacagtgttatgatatttaatatacattaagtatttatattttaatttctgaacaactcaccaaaaataaataaatgaaacaaagagtcatagttaaaaaaaaaacaaggtacaaaatccatactaaaaaaaaacaaaaagaaaaccccataaaacaaacaaacaaaccaaaactaccataatccagaagaagatgaggaaggcggaacagagactgtcaaaataagtaaaaaggaaacctcaataaccacttttaaaacgaaatacacttatgagataaagatataaatagatttgaactgaaaagatggacaaatatacactatgcaaatctttgttatcaaaaactgcagccagtgtattaatggcagataagacagactacaagaaagacaagcatcaccagggataaagaaggatgttttatactaataagtccatttgcttagaaaacctaataagcataagcatgcatacacctaagaaaaataacaaaatacatgaagcaaaagttattgaattaaaatgataaatgcataaatccacaatttgacaattctaattcttatatctcagaaattaatagaaaaaaaactacaacaataagactacaaggtattaataggagagattataaccagagcactgggagaaaaacagcaatatccaatatgcttacaactattggttgacaactcaaaagttcccaaaagaatttttgacactaaataaaggtaaatagcctggaaaacctacaagccagcataggaaggaagtggaaaatgaaacattgattgaaaataaatctggaagtccgggcgcagtggctcatgcctgtaatcccagcactttgggaggccaagatgggtggatcacctgaggttgggagttcgagaccagcctgaccaacatggagaaactctgtctgtactaaaaatacaaaattagctgggtatggtggtgcatgcctgtaaccccagctacttggaggctgtggtagaagaattgcttgaacccgagaggcagaggttgtcgtgagccaagatctcccattgcactccagccttggcaacaggagcgaaactctgtcccccaaaaaaaagaagaaaagaaaagaaatctgaaaaaaggaaaagagaattgaggataaagctttgcaaatacaaaatccaaaaatcaaatgatagaaataagttcaaatatatcactttttcctaccaaacatagagggattaacctcatatattaaaatacaaaattatcaataactaagcagcactttcaaattaaagaaattaaaaattaaatattttataaaaattttaagtaaatattcacagaaagcaagctgctatcacaaaattaattttagtttaaataaaatttaaggaagaaataataaacaacaagattgacactgcacatggagggaccatagaaccgggtaggtgaaccaacgtcaagtccaatgctggcctcacctccaggacatacaaagaaactaacaggatagagcaggtctagagagggacactggaactcgtacttctgaatttaaatgggaaatagacaaagatgttatgtgtttataaaaggttttaaatcacaacaaatgctgaatgtacatcactttctagtatatgtaatacttaccaaatgggacccatattaggttgcaaaagaaattacaaaaacccggagatagggaccaaaggactgaaagaagtcagaacaaaaaacacgccccatatattttagggaaaaacagcacagtgatttaatggtaaatcactataaacatgaaggcattcacctagaatagagatgagatgccagagttcaagacgacaacatgtgtcagcctgactttctgaatgactgcacaggcaaggctgccatccatggaagcgcagaaaaggacaccccttaggtcctggatggaggaggatgacccccaatactggatagagaaagatgccctccaattctgggatggagaaggatgccccccagtcctggatggaaaaggatgccccctagtccttgatggagaaggatgccccctagttactagatggagaatgatgtcccctgagtcctggatggagaaggatggtcccccaagtcctcgatagagaaagatggtcgtccaagtcctggatggagaaggatgcccccctcagtcctggatggagaaggatgccccctagttactggatggaaaaagatgtcccccaagtcctggatggagaaggatgctccccaattcctgaatggagaaggatgccccctagttctacatggagaaggacaaacccagtcctgaatggagaaggataaccccccagtcctggatgaagaaggatgccccccaagtcctatatggagaaggacaaaccccagtcctggatggagaaggatgccccccaagtcctatatggagaaggacaaaccccagtcctggatggagaaggatgcccccccaagtcctatatggagaaggacaaaccccagtcctggatagagaaggatgccccccaagtcctaaatggagaaggatgcctccaaagtccagatgaagaagaatttcccccactcctgaatggaataggatccccttcaagtcctgggtggataagacacctcccaagtcctgggtggagaaggacacccctcaggtcctggatggagaaaagatgccccctaggtcctggatggagaaggatgttccccaagttctgcttggagaaggtggctctggggacctcatggggaaggatgccccttttccagcctccccatccatacttatcctgacttgttagtgtagaacaaagagatttggaggaagaaacacaggactaaactttagtcagaatgttttccttttaatcaacattttataaattctaatttttatttgataaaaataagtgaaatgtatgacataaacacagtgtaacaaccgattagacctatttttccgatctgagtcctggctaccggctctattagtcattctacttttctgtatttgtaaagcttctcaaaattaaagataaaagagtttattgctagtaacatgtataaatagacattgaataaaatgtggctctttaaaaattagtttattctatgggcttcttttgaaaggttatggtgtactaaaattactggtggatctttattacaagctcactggtaaaaatagtcaatatgggaatattctaatttgttagaaattagtgttgagtgagtattaatcaaaactttaaaaccaaaatacatggacataagaataaattattcgacttaattatccactgactttaaattctaattgctaaatttactttttgcccatttcacctccttcaaatctccaagtaactcttcatttttctctcctgtcaatattttattctcccttatttttttttctatttcctgattttttgaacaactccaagggagttgtgttttgcttgtgttgaatgacgtcattacaccaacccgttaggcaactagaacgtcaccaaggtgagcactaggagacttcagaccacggagcctctcctgatttttgactcaggttacctggcaactgtgtttaaattatgagttgtttaatttttttagatcccctatagataaagaaggatttttaataaccatcaatttaaaatgcactgggacacttcatgactgacatttcttgcagtttctgtgctgtggcctcatgagtaactgtctgtaaggaacatcatgttcctcattctgcccttgctccttgggctccaaagggaaagaccagaaattctgtggatataaaacatggaaacattcattctttaaaggaaaaggcggtaaagcagagatgaggaaaggatggtattgaatacatgcaaatggataaaacatgaatgatcatgttctcatgttcaactcaatttttaaaagtggatgtatgagcagtgcgagcatttagtcagggcatggtgggcctgtgggctagaacaagaggccacactcaaggagagatggcactcacgacggggggcctctgctcctttatgactccccttcctcagtgacccagagcaccctcctatcacagcctgtaggggagaggaaggtgttagggcactttgaatcacagcggagtgtgtgtctacatgctctcctcacatgccacaaatctgcatcgctttacaatatttcaatagattatgagtaaggaagatcgctgcagaaccagtaaaagctgccctcccagacaatgcgctaaattgggttttacaaagtattgtgagagatctcgggagagggggagcaacctgctcatagattttgccaaaatcaacatttaaacacctccgttaggcagaagagcagcgttactggaattagttagcagttctttcctgctggacatctctcagcctccagaccctacagagaagaggccatgacctaaaagcagtttaaaagcttgaaaaaatagaagctaaggattaagcaaatatcgaaatttagaaaaggagagaagactttatttcttgtagagggttacagcctgcaaggtggccaccccacaggctgggaagaacagcctcctgccgagaccagagatgggcacttccaggaggaggggttggggcaggagctttggggtgaaaaggttggctaaagatacacagtcatcaggagacaggcataacaacataaaaccagttgtaggtaacacagaatgattctgatattgatgttcaattccacacactaacagacgtgagaacctcattcaccgcacgtggagaaggcactgtatctgctccgtggtggtcccgatgacttgtgtttatcattgcctgggtctgcattttctcttctctagattttgcttatcctgcaaagtttgtgctgggacatcatttctaggattgagtttaagctgagcctcagagtttttattgcagctacggtggatatggcttggttccctgcagtactctctggaaagtaccttcctccgtttgaaatccctgacgtggtacctcctacagcctgcacagctctggcctctgccatgggtctcatggcctcttctgctaaaactagagaggaggttcatcccctgcctctttatagagaagagccacttgctgactgagctgaaaagggactccccactgagcaggctcaccagtgtcccgacagccgggcagatcatggggacggggaattctgagcagaacctcttcagaagttgagtctcaaggggccttggggaacttggtcagcagatggcaagacttcatctgtcagtgggcgggtcagctcagcgggactcctgtctttggaactgagactcaagtctctactctgtaccaagacagagatggaggccaggaaacaagacacacaaccattttccatcatcgaggggcaaggcagggcttggcatgaggcagaaccaggctccatcaatgccacatgtcaggaggaaccccttttctgtttcaatccctcctgcccatttgtgggaggcattagagaggcctgacatagttttttttctccacagcctgaggacgtgataggatttcattcccgccccaccttgtggttggatggaatcatgtgcccaattctggtcaagatcaagaaactgaggtatcatttttgtttgtgtgggaccaggaaaatggctctaatttggctttgtgtttgtgcatgtgtgtgagaacggacaggtaaatgtgtgtaatggagagtgggtaggtgagtgtgtacatgtgtgagagtgtgtatgtgagttgtgtgaatgtttgtgaagaaatgtgtgatagtggtgtttgaacttggcagtatgagtgtgtatgtggaatataactgtgtgcggatgtgtaaatatgagtgcatatgtgtgttaatgtgtgtaagtgtgtgaataagccatgtgagtgtggtgtgtgagcttgggtccatgagtgtgtgtgcgtgtctgtgtgagcatgacagagtgtgtgagtttggggtgtgtgcaggccacagccagtccctcctggggtactagatctttccaacccaagcacctcaagtcgttctccttcctcactccatcctgagcttcccagccaactgcctctcatccaaactcccacagggaaacagtccctgggactaggggctctgagcatggcacagtgccaagtctcctccctggccacctcctgagaacctgggtgtagcacaaaacagtcaaatatgttcctcttctgtcatcactaactagagctccacagcttcccagattgccctgttagctcttcaccataattagctattttctgatatcatactaacattccttaattattccctcagaaacaaagcaaatccgtgggatgcagagggtacgctgatgacttctgctggggagagaagcccaaacacacgtcctgggcagagcccagagacctggagtgtggctgccagtgggcacccggctgagggacaagcaggtgggcctcagtggtggctgccaggtccctggacgcagggggccaccggctttgcctctcctctgcctcggaagcaccggaggctttggggatctggtggtcctccggccctgaacgtggacctggtgtgacaaagggaagtttgccatctccatcctcctcaagctgcctgtgcaccccagtagcactcaccctctctgtgctcccgtctgcaccgcatgtcctggggtccttctttgtgctgcacccagtgacaggaaccagtgtcccgactgtgacttacttcccccctcagggacacacaaggactttcacatcgaggctacttttcaccccttctgcctcctgcagggacgctgcatgcagaggcaggaggacagaggggctggtctcaggtgtggcttctctcatacctggcgcaggtggccactccccttccccccccactcccccaccccacctcagctcccgggtgtgaatgagaaaggggaaccaagagatcatcattacatgggacatgccacaaaccccaaaaagacccatttggtgaaaagaagtaaaacaaccacaaggctattttggcctgaggtggtctcatggctgaagcagccgctggtctcttgcctgggctactcaaatagtaacccggtgtgtcctcccatgtgcattttccttcgggttgagcaaaaacactttgtcatcctcccactcctcaatagagcagaagggaatgaaaggcaactacagggccttacagagctgctccgggggccgcgggaaacttatcagcatcctagaaaagacaaaaccagtgggttgcatgtggcctctgacacctgccaccctgactgcagggagtggcctcccccacctttcaccttcccatcattagtaagcaaagtgaccccctacgcctggacaaagcgctcaaaagcccaggcccgcgggttagctccagccgctcggcttgacaggggccagggaggcgggccagccccacagccaagtcacagctccagggcctggtcgcacctgagcagcgcggcctcgggctgctgctggcgctgcaggatccgcgcctgaccctccagcctgcgcagcgggcactcggccgggaagcacctctccagcaggcggctcagcaccacgttcacgcgcccgcgcctgtggccgcgcgggccccagctccacttagcgctcacagaccgtgagcccgcagggcagcgtcacaggcttgtgcagcagccgtgggcagccaagcaggtcgcggggcgcgccgggcgccagggccggccctccctagccctgagctcgccgccaggcttccccgccaacagtggccgttcgcgcaggccgggacacaccaggccgcccgccagctcccccagctcctccggactcagcgcctccaacctcccggctacatggaacgcgcccagggccaccgggaggcggccggcgcgggccagcgcgtcccccagcctcaggcaccggccgcggtcgggctgcgccagcagggccagcatggagcggaagagcccggcgctttctggtacttgctcgcgcggaaggcctcgtcgccctcctccaagcggtgggcgattggcttcccgcagcagcagcccgacactggggcggcggcggcgggaccggctcagtgctgattctcgcggggctgcgaccctgcgggcctggagcgaaggcgcggagcaggggcgatgagctgctgctgggaactggccggcgggagcgcggccacagccttcgcctgcagaaccaaaaaaacggttttaaaaatctttttaacatccgcagaacgtgaagaattacattggaaattggttagagattgtattggacctatagattgatttgagtatgatggtcattttaacagtattaacacttctaattcaaaaaatgggataaccttgtctttacttgtatcttttcaattgatttttatcaatgttttatagttttcattttagacgtctttattttgccaggcattttttttatagctattttcaatggggattcctttttcagatagtatgctgttgggtatagaaatgcatctgatttttctatgctgattttgtattctaaaactttactgtattcatttactgtttctgtttttcagtatagggtcttttatacatatgacatgatctatgtcatctgcaaacagggacaatttgactttctttttgtttttcaatttggatgtcttttctttctcttttctaattgctctagctaggacttccagtgctatgttgaagagaagttattaaagtgaacatccttgtcttgttcttgatcttagagacacagttttcaatttttccttattcagtatcatgttggctgtgggttatcacatatggcctttattttattgagttatactctttttataactgatttgttaagagatcttatgtttacaaaaaacattgaattttgtcaaatgctttttctgtatctatttaaatgattatatgatttttatcttaccttatcgaatgtggtgtatcacatttattgatttatatatcataagccctccttgcctccctggaacaaatacagcctgattatggtgaatcatctttttaatgtgctttcaaattatgattgctagcattgctggttttgaatttttgcatttatgttcatcactgatattggcctgtagtttagtttttcactgttcttgtcgcattttggaataaggtaattctatcttcatagaatgagtttggaagagtttcctccttttcactttttttggaacagtttgtaaataattagtatatgttcctctttaaatgttttgaagaattcagcagtataagcattggatcctcgatttttattttcttctccttccctcccttccttccttcctccctccctccctccctctgtctctcttttcttcctctttctttctttctttctttttcttcttcttcttaaatatttttggtttagagacatggtctttctttgtcactcaggctggagtacagtggtgcaatcatagctcactgcagcctcaaattcctggtcttaagtgatcctcctgcctcagcctcccaagttgttaggactgcaagtgcacaccactaaacctggataatttttatttttatttttgtaaagactgggtctcactatgttccccaggctaatctggaaattctggcttcaagtaatcctcctgccttggcctccaaagtgtgagatgacatgtgtgagacactgtgccagccctccagattttcttgtattgagagacaatgcttcaatctctttatttgttattggtctgttcgcattttgtatttcttaattcttcaattttgataggttatatgtgttcagaaacgtatttatttcttctaggttttctaatttattggcatataattttagtactttctcatgattctttgtatttctgtagtaaccattttaatgtcttttttcatctctcattttatttatgtgaatcttctctcttttttcttaatctgactaaagatatatcaattgcgtttatcttttcaaaaaataactttttatttcattgatctttcatatttttgtctccattttgtttatttgtgctctggtcttcattatctatattcttttaccaatttggggctaagtttgttcacgtttctataattccttgaaatgcattcttaaattattaatgagagttttctttctttcatatagaaatttatttctacaaacttccctctgaggactttttctgctgtatttcgtaagtttttatatgttctgatttcattttcatttgtcttaagaatttttaaaatgaaacaaaatttattttttaacccattgtttgtttaggggcacgttgtttaatttgtatgtatttgcacaatttctgaagttcttgttgtttatttctagttttattctatattgtcagaaaagatgtgatataattttgatttttttttgaatttgctaaggctcattttgtgcctagtatatgatctatcatggaaaatgttccatgcgcagtagagaagactgtgaattatgcaattgttggataacatgttctgtaaatgactgctaagttatttggtctagagttcactttaaatatgatgtttctttgttgattttatgtcttgataatctgtttattgctgaaagtagaatgttactattattttattgcttgctgtttctcctgttagatctattaacatttgttttatatatttaggtccttcaatatagagggcatatatatttacaattatattatcttgtgatattgatccctttatcattatataatggctgtatttgtctgtttttataggattttgtttgaagtatatgttatctgatataaatatatctatactggctttctttcggtttccatatttataaaatatatttttccatctgatcactttcaatttatgtgtgtatttacagatgaagtgaatttcctgtagaaagtttatagttaggtcttgtttttaatcagtgtagccattatatgtcttaaatgggataatccatttacatacaagataattattgataggcaaggacttggttctgccatattattacttgttttcatgttttttttaatttgtactttgattgattgatttctctatcttcctttgtgattaagtgctttactctatcagtgtgtttcggtttttttttttttaatttttagagtatcttttaaaagtttttgctttgtggttaccacaaggcatgcaaagaacattttgtggttacaataagttattttaaagagatagcaacttaattttgattcaaaaagaggggaaaagaaaccactctactctttaactccatcactccctcacattttgcatttttgatgtcttaatttacatctttgtatattgctattccttaacaaattattgtaattattattattttatttgtattgttttttaaccttcctactaaggatatataagtgctttacatccaattattaccatattagagcattccaaatttgtctgaatcctcacttctacctgtgggtttataccttcagattttttgtgttacatattgctgccattttctttcagtttggagaacaatatttagcgtttcttgtaaggctggtttgattacaatgaattcctttgctttttgtttgtctgagaatgtttcaatctctcctttatttctaaatgatagctatgctggatactttattcatggttgacagtttttttaattcagcacttgaatctattatcctactctctcctggcctgtagtgcttctgctgagaagtctgctgccaggcatattggaattctcttatgtgttgtttcccttttcttagtcctttcagggtcttctctttgtgtttgacatttgagagtttaattataaaatgtctttggttgtcttattcagattaaatatgattgggcactttgaccatcctaaacattttaatctttctccaggtttaaaaagttttctgttatttctttgaataaactatctccttttcattcttagttcccctttaacaccaatgatatgtagatttgctcttttgttggtgtcccacaaatctcataaactttctttgtttcttttcattctttttttcattctactctgaccatgtattttcaaagagcctgtctttgagctcactgtttctttcttctgcttgatcagttcttctgttgatgccttccgttggattttcaatgtgttaattgaactttcctgcttcaggatttacatgtgatttttcccattattttgatttctttgttgaatttctctggtaaatttctgaattatgtctctgctttctcagtgttcaggctcttcttaaaacagccattttgaattctttgcctgccagatcattcatctgtatgtctttaagttcagttgctgacaccttgttttgtccatttggagaggcaacttttcctaagctatcattattatatgtagatatacatctctgtctacacattgatgaattagatatttatttgtgtcttctcagtctgggtttgtttgtgactacttttaagtgggcttattaggaaatgttgagcggacttaccatcgtattccattttagcattagagagagtccaaatcccacgttagacataagtcttccaatggctccaccactgctgcaacatttgctggatgggcccatgggtgatccacagggagcccctggctatgggggagaacaagtcaggccgtcaagcgtgtagtctgtgtattatgtttcacatggtggctgttgctggccccacctcctcttatgtccttaacatgcctcaggtggttcatcccttttggcactcatggtgccacttgtgggctgatacaggagtgagtctactgtgaaggcactcagtatagtggaaaaaacaaatatcaacctcctgctgacttttttcagtgtaaaaactataagccctatgggagtttctgcagatggtaccataatggcctgagggaggagtatcacagtcacagagtattggttctctcactctgtaagccatggttttacccatcttcacaggccaaaggtgcttcataaccttgttcatgtattgaggttctgttggctcttgtaatggtaatttcacatgtggacagttgttcatattgatgtttctataggggtatgatagctggagaggtctgcaccactgtcttgctctgcctcgatcattatttttttctaacaagaatttgtctcctcctagtttttctttttctcttaaccgacctaggtatagccttttaatccttctccctcctctgcttctaatgtcattgcttctttgtatgcctatcatatctacatgctacatgaccttcagctggttatgtataatatataagacttaatatcctataaaatagaggtaataatagcatctacttgataggaaagttaagaatattaaatgacaccattgatgttaaatggaggtaactttctgaaatgtattaatgagacatgattctttgttctagtccacttcgtagactagactactttgtttgagttttctcttttcagtcagagaaagcaataaaattgtaatggtaaaaattaaataaaatttaacttaaaattgtgttctggtcttctcattgttcagccgtggaaagcaataaaattgtgatagcagaaattaaaagtgagcagagacttatttaaaaattggtattctccttttcaatgccaaaataagaactagaaacttttaataaggcaacagtctgaagaaacaatttattgacgagaatatgggtttctaaatcctaacaagtttttttacgtatgtgagtcaagtttggctgccttgaatcctattatgactttaatggaagttctagttagggtggaaagtgtcaaagaaaacagttgcaccagacaaagttaaacacataaaaaagctgttattgaagactattgcaaaagggcaaagaggccagaacttagtctgaactcagctccgctgaaacaaacagcagtagagattttaagagccaggatgagggggagatcatagaccacttgtctttgatagttgtctttttccaaaggaatattaaactatctttcatctttatgacagaaggtgattttacaaattagaggaatatgcccaccaaaatttggctcttactctctcatggagtctgggagataatggtgttatcttttttgagaattacatttcaaagggatggctctgaggtccttgaaatggacatttctgaagtgtaaaactggcacgtgggctcttagaaagatttatcaaagaggcagagaaagaatttacaatgataacatttctaaaatatgctaaagaaaaaaagaggtgaggagccaagaatcagaaataatcctgtctaaaaattttatcaaactgaggggatggctttagtcaaaggtttagtgtaaggggaatttctatgaagaagaggaagagaagagcttttaactacacaggaagaagaaagttcccaggagatgtgactatggctctgcctgtgtctctgatcaggtattcagccccaacatcctcctgggactcgctcaaacagatggataggaaaaaatagacagttaaagaaagatgagaaaatatgcaggctggtgtcttacttctctagtgcacatagggtgtcccaggaatgacagagtggcaggacagggggaagtgcctgagagatcagttcccttactctcagcctgtgagtgctgtctgaaaagccagtctctccaagcttggtggaagggggactcacacctggtttgacaggaccagtggaggcccctggtgggacatgctggcctcagaatgtgaggtcttggaggctagaggaaaatggcagtgggtgaccagaaacttcatcactgagtgccaatacatgcaaaatcaaagagaagatgagccatgtcagcagatatcagtgaagaatgcccagagaagactccactgaccatacacagcacagaccagcctgttccagaggacagtgcaaatggcacgccacagcaacagaggcgacttcgaccccgcccacgccatcagcagctcggaccctagggtcagataccaccacagaggctaattccagtggtcgccccgcatctcaggaagacgggaacctgcactcagcaccatccccgtggctgcacagggcccaggactcgtaacccggcgctctggttgcgggccaagaaagagcgtaacctagggtggcatgtcggtgaactcggcgaccctctgacaacctgggagcagccccaacagcctcagttgtgggctcagctgcaactgccacctgccgatggtgcacgggagcagcagcggcaaccctcgaccctgtccccgccaccagcagcacggacagcagggccagatagcgccgcggcgcctaagaccttaggccacgcagctgcaggaggacgtgaaacgggcgctgaccgccccccagaagctatgcaatccccagcgcaggcgagtcctcactctgggcgcgggccaaagatcagacactacgatgaaaggacggtgaacttggtgaccctgaggctcgcaatgggtttagcagcagctgccaactgcaaccaaccctgaccctgcccgcgtcaccagcagcagtaacccagggccagatgccgcctcagcggctaattcaggtaatcgtcctccagctgcagcagggcggaaatccgctgctcagccccacctcggcggctgcacagagcccagcgcccgcacaacccgctcttggtaagggcaaaggaagagcggacctagggtgggaggaccctgcactccctgaccctcaggccgtctggggccagccctgccagcctctgtctaaagctacgctgcaactgctacctgctcatggcgcgcagcggtggcaaacccggactccgcccgccgacaccagcggcctcgaaaccctagagacagactccacctagtggccaaaatcaggcagtcggcccacagctgtaggagagcgggaacctgcccttcagcggattcctggaggctgcacagtgcccagcgccagccacccggatctgggcgcgggcaaatgaccctcaggccgtctgagaccggaccagccctgcagcctcagcggtgggctcaggggcgactgccacgtgcacatggtgaactatagcagctgtggcagcccccgaccctgtgcaagccaccggcagtgcggaccccatgaccaaaagccgccgcggcgcataactcaggcggtcggccccccagcagccagagggcggaaacttgcagcttagcccatcccagcgcctgcactgtgctcagcgcctgcaatcccactctctgggagcgggcaaggaagactggaccttagggtgggagggcggtgcattcggggaccctcaaggcttctggaataagcccttccagcctccgctgcgggttcagctgcagctgccagctgcacactcctggaagcagcagcggtggcagctctggtctctgccagctccagcagcagcgcggaccgccgagccagaggtcactgcggcgcctgttaggaggttggcctctcagctgcaggagggcgggaatctgcacccaaccagatcctcatggctgcacagtgtccaacgcccacgaccctgcaatttgggcgccggcctaggaataacggaccctggggtggaagggcggtgcactcagccacccttaggcaacctcagaccagccctgacagcatctgcctgggactcagctgcagctggcacctgcgcatggcgcacggcagtagtagtggcagccctgaccctgccctcagacaccagcagcaaagaccctagggccggatgcctccaaggcatctaagtcaggtggtcggtcccatagcgctggggattgcagcggtcgcccgctgcagcggggcggaaatcggctgctcagccccatagcagctgtggcagccctcatctctgtccatgccaccagtagcacgtaccccagggtcagatactgcggtggcgcctaattcagactgtagctgcagcagggcaggactccgccgctcagccccatcctggaggctgctcagagtctagcgctcgtacaccgcgtcctgggagcaggctaaggaagagcagaccctagggtggtagggcgatgcacccagagaccctcagggtgtctgggaccagccctgccggtctctgccacgcgctcagctgcagctaccaccgccaggtggctcccggcagcagcggtggaaaccccgctgaccttgcccgccgccaacagcagtgaggataccacggctggatcccttgccagggcgggaacctgccgctcagcatattctgggcagctgcacagggcccagcgcctgaaaccccgggctctgggctcgggccaaggaagagtggaccctaggctgggagggcggtgcactcggcgatcctcacgctttctaggaccaaccctgccggcgtctactgagaactcagctacagctgccacctgtacaagggcgccgcagcagcagagcaaccgggcactttgcctgcaccactaagagccaggacaccggggacaacgctgcctcagcgcctaattcaggcactcagcccagcagctgcagcagggcagcaacctttgccctcggccgaagcaccttggctgcacagttcccggtgcccgcgacccggaactctgggcgcaggcaaaagaagagcgtacactaggctgggacagtggtccactccatgaccctgaggctgtctgggaaactccttgtcaggtgatgggcccagctgcagcagccagctgcacatggcgcgcgcagcagccttggaggcaaccccagaccaggctcctacaccagccaggcggatcccagggccagacgccgcccaccggctaattcagctggtcagaccccagctgcaggagggcgggagccggccgctcagccatttcctggctgctgccctgtacccagcgcttgcacaccccgctgtgggctccagcaagaaagagctgactctagggtgaaagggccctgcactcagagacccccaggctgtctgggaccagccctgcctgcctctgatgtaggttcagctgcagtggtaacctgcacaaggcgcgcagcagcagctgtggcaaactccgaccctgccagtgccaccagcagtgcggacccttgggccagaagcctccacagcgcctaagtcagggtgttggtccccagctgcaggagggcaggaactggcactcagccccacctcagaggctgcatgatgcccagagccagggcccagctcttctagcgcaggttgtggaggggccaggggccacccagactggagggcagtgtcatgatcacagctcactgaagcctcaacctcccagtttcaagctatcgtctcacctcagcctcctgagtagctggtagctgggactgcaggcgggtgccatcatgtctggctattatattttatatacattttggagagacagtgtctcaccatgttgcccagcaggtcttgaacgcctggagttcaagcgatcctcccaacttgaccttcctcagtggtggtggtgggattatatgtgtgagccactgtgccctacctgccgcttttcttataaggatacttgtcattggatttagggcccatcctaatccaagatgagatgccctcatctcgaggtgctggatttaattacatctgcagattgttttccaaataaaggtacattcacatgttccaggtagacatatcttttgatagaccaccatgcaatccactctaggagtattaaagtgccagtgtggaccgaggcaccaaagaatcacattattatgtcatataacttgccttatttgtagtgacccgtgggcttggaaacagaaccatttgcagctgtcagggaagtgcacagtgcctgacctttcccgcagcctcctccccactgggcttccgtgagaggatcaccccttggagtgtccagagattcctgttaaatgctaaagaccacaggagagtttgggcgggggaagatgtttggggagcaacttagttgtcctgaggtgcccatcacccttcaccgtttcagcaatatggatcttccaaggatctgggaatgggaaccaggcataagacagatacatgtgagtgagaagaggccagagtctttctctgtgtaggcaccatccagcccaagatgagcattgttccagaaacacatgcactcatgatgctaaacccaatctattgaggacttaatacaaactgtgatttttttaagcatttaattcttaccacagtcctttgtcatcttattatctccattttacagataaagaaacaggcacagagggtttaagtaacatgtacaaggtcacacaatcacaactagtaaagccaggattaaagtccagtcagtctgcattcaaagcctgtgctcctgccccaaaatgacaagtaatgacttaaaggcaagaaaaacacactctcctctacccaccatcctcatacagacttccagcccaggatctaaaccattcattcatttgctctcatattcattcattcattcattcagttcttcatcacacatttagtgaagctctgtcatggaatgtccaaacagaaggtacaaaaatgaggcaggtatattttctcccatctaaagggggatgaccacgtgaagagaactgatgggctgtgtgtcccatggccttacagggcagtggtggagggtggcccaggtcatccactctctggggaggcagaaccagaagcaccagttggacaactgctaaagagatgtttgtgcagcctcatatgttaagtcctatattttgaaagctttttaaattttttctttaagattttagatgcttaccactgagtaccagagggatgtagcctgatgcccttatcaacaaagtcagggatggtggcacacaaggtttgactactgcatacacggtcacagtgctacccccagatagcctgatttccctgccttctctggtggggagaagggctggcagagccattagcatgggcttcagccaatcctggccactttgatgctcctggtgctgacccagggtcctggagtatgggctgaggcggcggggtagagatgttcagggcagtggcccctttccatccacactggaactatttcagtattttaccaccaattcggctattcccttatcggctggctgaacatcggccctgctccaggtctcagtttcccctttgtaaagggaaagccctggattcaggggtgactaggtcatcatggtcttgagattccaggcctgtaggcagggggagagaggttcactaggagtgcagaagaccaaggttggggagaggcagaggagagagtggcctccctttggcccaggtgggagattcacagagacaaccttccttcttctccaaggcaggacttgttaacagtgagcttcaggcagtctggcacttgggactaactaggatgtcaccctccctgcagcctccactccatagacaacatgagaggagtgtgtaagtataactaggaacaggctagtgtcctgatattctctgtgatagaggggacagccctcctcagagacccgggggagcccagaaccatggacagcctgaacacactttactttctcagcagtggcaaccagaaccctagcctactaaagccgaaattaaaaggagaaaaacctaaattcctgcctgtaccaggctgactcacatcaaggccctgctaggattaagctaactttatatacaaggccaagcagagcccagaaggaatggactccaggaacagggatgagaagaacaagttcttcttatcagcttccccctttgagattctttcctaggccagtatgtctttgctctgctctcataactatttttgtaactatttctgtaagtttgtaaggattttgtaagttcctgttttccatctgtgcaacactgagaaggtcacaagacatgtctgagcaagcctaaaatagtaaccatctgctgagggcctgctggacggcccagcagaggtcaccaggcatgtttgagtcatacacctgtcactgtttgattaactgcctttgttctgcttctgtaagcttgctaagcccaccctgtgagtttcacgcagctgcatgcttaaaaaccaggccccatctttgttccaggctcagccttttggatgcgaatctactaggccagtggccactttaataaaatcctcctgtctcatccattggtctctccagtctcttgaatcccgcaacactacaatggctccaagacagcatgtgggatctaagtaataactttttattttttttattttttttatttttgtacaagactgggtctggctttttcactcaggctggagtgcagtggtgcaatcacagctcactgtagccacctcctggtctcaagccaccctcccaccttagcctcctaagtaacttaggactacagttgtataccactatggttggctaatttttgtattttttgcagagacaaggtctcactgtattgctcaggctggtttcaaattcttgagctcaagagatttactagtctcagccttccaaagtgctaggattacaggcacgagacaccgttcctggccagtaattttgttttattatattaaggtgaggtttataccacattcttctggttacagaagtaatacatgctcattgtatacactgaaaaatgtaagcagtataaagaagaaaataaaaaaggatatgaaaatcactagtggtcccattgcctaccgtaacattatgtgctgcttcttaatctttacttcctctccctccgtgtgtgtctttgtgtgtgtgtgtctgtctgtgtggttttttgtttgtttttttggcacatagtacaatagctgacatttatatcttcccgaccagtgttgagcatggtgttaagcaattgacaaagtgtattgtatttaactcctacagaaaacctaaaaaggggaagggcagtataattaatagaattttccagatgaaaagactggggcctgagttgaggttacattttatatatggcattatattgtacttcagacatgtaacatagtaagtgtcctggagaatcttggtctgttagtctgtataataacataagcatcttttgtgggattaatagtttttccaaagcatgcctgggatgtttgcataatattctagtgtttaaatatgttgcttattgccaggtgtggtggctcatgcctgtaatcccagcattttgggagttcgagacagatggattgcctgagctcaggagtttgagtccagcctaggcaacacggtgaaaccccatctctactaaaatacaaaaaaatagtgaggcgtggttggtgtgcctgtattcccagctacttgggaggctgaaacaggagcattgcttgaacctgggagaaggattttgcagtgagctcagatcgtggcactgcaccccagtctgagcaacagagtgagaccccatctaaaaaaaatgtttatcaaaccattttcatctttgaaacatttcaggtctcttctttggctttttcgcattattaataatactgtgataaacatccttcagcagaaaccttcataggctagcttcctagaagtagaggtattaggtccaaggttttgaattgttttaaagctattgatttatctggataaaattgcttccagagatattgtcccattttgcattccaatcagtggatctcaccttcagtattttgtgcaattaaaaaaaataatgtttctccttttaaagattatatttaaaatagcttttaaatatgaaaaatttgtatctacaaataagagatagtgacaaaaaataaataataaaataaacacaagagcagaaagtagattgaaacattaaaattcaaatcacaggcctctgttatggagaagacagctgcaatagcttttctgttcttttatctacattggtaggttcttcttttaattaatttttaccccaacttaagtgctggctggtttggcaatttgttgctgggatggaaagaagaaatgtgcaccttgtcttttgcaggttatgagagccttgtctgtccttgtggttgtgtgggtgtctgttagattattgtgaatactgagctttgaaaataacctaacagtcaatcaattgctgagcttctattaccagtagtgggacataatgtacatcatgtagataggcaggcttgtcactgacaagggggctgacccctggaaaaccagcacagagccagctcttctgtgtgaatccactctctccagaatataccataagtcatggaaagaaataagagtctcaggaaatgagactcttaccgcgatgagaggtgaaccttgaaatctattttagcaattaggaagagaagtcccatttcgcatcccaaatcaagtagaggcctgctagtccaaacatagtttctgaataacctgagtcacctgggccctgaggaatcctggcctcttcgtccacatttgcagaaatatcaggaggtcaatcaggaagctggttaggcagctcaacacagggtcagaaagctcctaggtatgcaaataaatgtgcacactggaaattgagttctgtaatttttccatgacctagaaaactatgatgatgaaaatgttctacattcatgctgcctagttcagtagccactagccacatgtggctattgagtaattgagatgtggctagtacaagtgaccagctaatgttaaattttgttttatttgaattaattttaattttaatagtcacctgtggctattggctactgcactggatagcacagagatgagaaataatagaaaccttttttgttgttgtttcaatggctaacattgtcaaaagctgaattcctgttttatgtaaaattttggtttatattttctcaaagaagggaagtacaaaaaacaaaacaaaacaaaacaaaaggatgatcaagcagaactttggtaaggaagggtgaagcagagacacttaactcagagtggggaaaacagcaatgaccttgtttgaaatgcagctcctgtctatgtggctctctgtgctctgttggggtgtcagttctttacttcttagttaaagcagttatttcggcggtgcaatgcatttttgttcaataagcatgactttttacacagctggtttatctccagtatggaaactctctgcttaatcatcttgatttctctgggcttgttcctactctgcagatttaagcatgacacttgtatctctctctccaggctctgatctaggatgacagcttctatgatgtgcccatctacagaaatatgcaaattgcaaatttaggaagattaaaagagggccctgcaaaaggcatctacaggccccatgtgctgttcacctttcttatttattggtgaagtgagtcctcatccatttattgggcagttgcaagcaaaggaattaactatgacaattcaccttgatgtacaacaatttagtctgtttggagtttccactgttggaaaaaacctagttatcctaattaagaacagttacagatagtatagtgatagcttttttttttttttttttttttttttttttttttttttgagacaggggcttgctctgtcactcagattggagtggagtagcatgatcatggctcactgcagcctcaacctccctgggcacagtgattctcccacctcagtctcctgagtaactgggaatacaagcacatgccaccatgcctgaatattttttctattttgttttgttttatttgttttgtttcgttttgtagagatggggttttgccatgtcacctaggctggtattgaacttctggactcaagtgatcctctctcctcagcctcccaaagtactgggattacaggtgtgaaccagcatgccatgcctatagtgatacctttaagtaaccctctcttttcttcttttgggcaatttttcaaagcaacaggcactttattaaataagaaagttgatgtgctttcctaatgcctgctaataaagtaaagaaccaaggaacctctgtgatttcaatgaaatccctccagatgttataggctacttgttacagacaggtatggtaggaagtgtggtcaagctgtgataggcaaatagatcttgctgaagaggaagaatgattggctaagataatgtcccaggacagctggcatacctttagacacagctaaattgaatgctttctgaggatgagtgtattagtctgtctcacatgctataaagacatacctgagaatgggtaattgaaaaagaaaagagattgaattggctcacagttctgtgggctgtacagacttatgcttatagggaagcctcaggaaacttacaatcatggcagaaggtgaaaaggaagcaagcacatattcacatggctgaaacgagtcaggggaggtgctttttaactttttaaacaagcagatcttaggataactttatcatcagacagcactagggggatgaggctaaaccattagaaaccacctccatgatgcaaacaccttctactaagcctctcctccaacactggcaattacaattccacatcagattggggatgggggggtgcacaaatccaaaccatatcaagaagcatgttaaaaattgagggaagttctaatcaaatgacaagtcaggacacggcattccatcaacataacactcctctcaatacattccaaagtgggagaaaggaaaaagtgcaaggatgaagaagggacacagcaaaatgacaagatgactaacaagatgacccctgtggaaagcatttactgattcaacaaccaaataatgaagacaatagagcaaatttgctgagtttctatgctcttgatgtttattagggaagggcaaaagccagtccctcgacattgttactgttaattaacatcatcactgcctgctcttaagtgtctagatactttcaagaatctagtattatcttcacttaaatgtttcttggatgtgccctgtcatgcatgtgatattgcaaaaagattctacattaaccacagcaagatggctatgtaataattgggatcacgttaggggagcatatttctaccacattttgagatggaaaatgaagtaaagatatccatttgtcaatttcttctacattatgccaaacattcaaagagattattttatttatttcaaagatgtacacatgttgaaattaaaatttaaattaagaaaatttataaactgagtcaaaagaaaagtaagcgaggcagttctgcatgccctgaagtgtcaggcatatatgactaaagtattcggcatttggccaggtgtggtagctcatgctgtcattccaggatgttgagaggctgaggcaggtggattgcttgagctcagaactttgagaccaagcaaggcaacatggtggaaccctatctctatgaaaaatatgaaaattagccaagcatggtggtgctcgccttttcataccagctactggaaaggctaaggtgagaggatcatttgaacccaggaggtcaaggctgcagtaagctctggttgcaccactgcactccaacctgggtgcaagagggggaccctctgcccaggactcttgggatatgactatacccatagggactgcccgcagtaacctcacatttgagtggaagtggagatcatatgtacctgtaccaatatgtagtgaaaaaggaaaacataagaaatcatggcagaaatggcacaaagtataaaagaggcttggtgtaattgagagaggcattctggtgataaaatttgaactgatttctggagaatgggttgaattccaatagagggagatggaccaaagttaactctgatgagggaaatgtcttgagcaaaatctagaaaagggaaacatgctcattttaagtgttaatgagggtccagttggggtacagtgcaggaagagagttctagtgaaaaggtagttggtctgataggacagggtcttgcaggcagaggcagatactatcattattccattgttcaggttggaaaacagacacagagagcccaaggtcacaaagccagaaagtgaatctgggcagtctagtggtagcaccctcttcttaaatgatctattaaagggcctcttctccaggcactctaaaactcttctccatctttagctcccccagagtacagtgaggtcccctgtctacctcacaggatggggtctcagaaaagcaacagatcccaactcatactagcttttaaataaaaaaaaaaaaaaaaacaccttgcaaaacaagaagtgcagaggttgggagagagccagcactggttaattcagcagctcaacaataaatccaagacctgggtattggttcacctctccacaccaccatcctcatgggccagcttctacctcctcctgaatgctgtgtctttgcctagttttctccctgattttagctcaagtgctgcttcctgggggcaacctttcctgcctccctcttggggtcagtccaccttcccaggctcttgcagcacccctgggtctgctgaactttcccttgttacataattctgtgactaacatcacctctttctgttagactctcagctccactagagaagaaattctgtgcatttttgctcactattgaaccctggagtctactactcaaatatttgtcaaatgagtaaatggtagctctgtgcagggccaaggaacacaagaaccacaagaaacatgcaatctgccaaaatactcattacagctcactctcctctggtgacatttccctgaggcacattcctgttggtttcttcccctcaagaagcattcttctttctccttcctataaaagccaggattttctcagatagccacaccatgccccatgcaaagagatttggattattctatcatcttgaggcatttctgtggaaactgctgtcagtccaggtggcccatgacctaagctgacccaagccgactgaagggaggacgtattctatgcaccctatgcagttccacagggtgctggttgtcccggctgctgctggtggtcttcatgtagccaaggtatcactagtgcatatggagaaaacagagcaactggagagaaaccgagtaggtaaaagtgggcagggcttggtgatgtttggggatatgatatgagggataagacagaggatggtcttaggaaaatctcctgtattttccttttggacaatggtataaatgaataaaagttccaatcactgggatagaaaacacttggaaaatatgagattcattcaggcaagcctttcatacactattccataatcagtttcataagtgaaagggagtcagaactcatttctaccttgtttgcttctatcatactgtgttgtaccctgttggatctacttatcacattcctcctgctagtggacttacctgctaatgtttgcacttctgccttgccagcatggaacctctgagacaacaggagcagtgtgtgtgcatgcatgtgtgtgtgcacttttgtgtgtgtgtgtgtgtgtgtgtaattggattccccacagcacattattgttttatccatagtaaatggtggatgaatatttgcaggatttagctggactgcagcattgtggaggtcagataaccacattttgacagacaagttgcattctaaccttgaagcagacaaaatgcccatcttatcagcctcgctcacatcagctgtgcctttcctttgtggttgtatgtttatgaagctcatccaacaagcttcttaaaaaggggattggaccttcgccagcctcaggctgcatggcagggtgactgtgtctttgaatatcccagatggaggctggtcacccttttgtctttgggtgaatagactactcaggaaggcagggatgcaggcacccccatttcttgttaatgagtttgcaatttattttggcagatctaaaataataattcaaaggcagtgtagaagaagatggggacattacttttaattgtttaatattgttatgacatgacatgtgcttacagaaagagaggcaagccaccatcttcaagggagggcatagtcatcgactgtgatcctggtgtccatgttggaatatcatggcaactgtctcccagcactgaactcgatgacttctgctgcattcccagtgttagctgagttgcttaatttactttcttcaacgccatgtgtgaaagggaagctagaaaactgcactatgtatggcttcgtgcactgaaaatttgacattatcaaaggaggcatgatcttgtctctctccatccctctccaaatgttttctataattatattcagaggctcatgggtcttaccatgggtgatcaaggaagggctggtaactctttcaaccacaggtaaaatattacaaacatctgaaatatgcatttttacaggtgagagaaatgaggccagaaaagttaagtgcatcatgttgagtacaattttatttggtgatcaggcagccctgggttcaaatcctggctctattgctaccaattaagccacttaactccatctgagcctcaggttgcccatctgcataataagcagtaatagcagctgtcctgcaggactactgtgagaattacaactcaggcaatgatcatgatatttcttggcacagaggtgttcactacctaggtagtgttattattattaggcctaaagtcacaaagggagtttttgagaacgctggaatgaaaacttgttcctctcagctctgagcttattagagcccaccgttttgcatgaataaagcagccctggagtctctcaggggagggtgtttgtaacatctgttcaggcacggtttcatttgctatatacccagagactagcacggtacaagttgtggggagatactcatgtgagttggcggactttgggtcaaatattttccctaaacccaggtctctatggcattctacagtacactctgcatccttctaagggacactggaagagcaaatggattgtacagtgagttacaaataaaatggccaatctcagcatgaaaggctgggggtgttacctgaatgaggatgcagaccactccatctacatacaagcaaacctaagcgaccatgagcctgccggaaagaaatcacatgctatgtaaaggcttagtaacagtgatgaatatttgaacttgaactccagctccagagcagttcagtggcctctcttccaggaacagaagccaaagcagctcaggattcttgaaggctctgaaaggtcaatgacaatcctggtatatgtcaagactttcccaccaaagaagggctccatgtgtagagacttagaaaggattcccaacttccgccccttcaaaaccagaaacaaaggtgggggacagcccaattaagtggccctagagatttgcccaggagctggagccctccggagaagtccagttttcctatgcagggagaggactgggagttctctggtcacaagcgttctgcctttgttttcatgaagctatgtctcttacctggtaagaaaaatggaacttcatgcagctgctgaaaactttaaccaaaacccaaagatgctggcacaaagaaaggaggcctgaagaaaacaagtgaccatggaaacacatttagctcttaatctgaccaatttctcatgggccaggcctggtgccaggaatgctgtgatgaataaggcctgagctgagattgtgaggatgagacggagtccaccctgtggggatctgggatgatagaagggctccgcagatagaggacccggtggccagaagttctgctgagtggaaaagggctcggagtaactgaggtcagctggattccttaaacattgcccagagcccttgaagccatctaagggcacacttctgaggcctgctccgaaccacactcaactgggaatcttttaaggacagctgctctgttaggcttgcctgagatggtgcagttttcccccgcggcggcagaggcacagacagttaagaatgcaggagcggggcctcacaatgccttggactagggcaaaggaggacccccgcctctcccctcccggggctaagacatgggaggaccccgaccggtggatccattgactctggcaccagaggatccccgctctccagcgccctagactgaggcaacagaagacctcagacctgctccatcctgaactagagcacagtgggacccgcgacctgccgtggtctcaggcactggaggacacctgcaacgccgtgcgctagactatgctactgaaggacctctaccgcggctcagccctggactaaggcaccggaggatccccgccctgccccgccccgcggtgtcctggactgtgcactgcagaacccccacccttccacaccctggactctggctcccgaggaccttggccccggctcgccctgaactactcctgcccctcagcgccctggactgtggttccagaggacctggtcctggggcaacttgtgctaccgcgtggactccaggaccccagtccttccacgccctagaccaaggcacgggagaacctctgactcgccgcccccgacctagggcaccagaggacccacaccttgccgtgccccggactacagcacggaaggacccccgatccgccgggcactgggctcctgcacagagggacccccgccatggaggtctggactacccctgccccaccgcaccctggactactgcacgccaagaccctcgcctgaacacgccctacactctggcatgggggaacccggccccgcagagccctggactctggcattggaggactcctcggctaggttctggactcctgcaccagaggactcctgccctgccacaccctggacacctgcactagagaaccctgccccgtcgccccctagactatggcacgggaggacccctgccaccgacttcggcacggtaagacccctgacccgccttgcactggattccagcactggaggaccccctgccacggcgctctctggactacccctgcgccaccgcgtcctgcactacagcacagcaggaccgccgtcccaccgcgcactggactgaggcacagcagcacccgggcctcgtggttggtggactgcaggacgaggtgaccccccgccccgctgcgcgttggactatggcacaggaggaccaccattcccgcatgccctggaccactgcaggacaggtcccccactccgcagcggcctggaatatggcactgcaggacccccgccctgctgctccacggactccaccactgaagaccctcgcccccctgcaccctggacaaaggcacgggaggacccggcttcaccgcccagtgggctatcacataggaaaacccccagcccacccccatcgcgccagagactctgacaagagagaacccctgccccctgctccccggactacagcaaggcaggaaccaccctcctccaggatcctcactatggcaactgtggaaccccgccctggtacgccctggactaagtcaccgaaggaccccgaccccaccacaccgtgaactccagcactggaggaccattgccttactgcggactcaagcactggactatcgcagggctggatccctgtcccgccatgccctacactatggcacgggaggacccagcctcactgagctctggactccagcaccggaggacacctacacggaggactcctgctccgccacgtcctggactcctgcacaagagaacccccgccccgcggcaccctggatatagcaaggcaggaatcccgccctgcagtgttctggactgcggcacctgagaatccatgccccatcgcgccctggactgctgctccacaggactcctgttccactgcaccctggactatggcaccagaggacccagcccctcgcatcctggactatggcaccagaggacccagccccctggcgtcttggactaaggcacagtaggaccccgcagcatcgtgtactcctgcacaggaggaccctcgcagggctgcgtcctggactgagctactgaaggagcctcacccctgcctcaccctggtctaaggcactggagaactcttgctccacagagctgcggactcttgcacgagagaacctgcgcccagccgtgccctggactgtggcacagtagggcccacaccgggccatggactcctgtactggaggaagagtggtgataaatgtccaggtttacaagttgaaaagtagcagtcaatgtgctacaatggatggatttgatgtaaaattacaaatgctgaaaacattatgtgtaattgcctagccagatcaattacacaagacaaagaaataaaagaaatccatatagggaaggaagaggtaagattgtttctgttttctgaaaatataatcttaagatacagaaaatctttttttattattaatgttctatttacttatttttataatattttataaataaactttattcatataaaacaggccaaacatctgacattcaaaaatggctactgttataaaatcagaaacatagtcagagtgttgggaatattgaaatttctaaatctttatgaataacacaatcacttaagttatatccacaaagaacagaaaagaggcaagcttgaaaatatgaggatagaaagatgtcacagtgatgtgtttttagaaacagtaccttcacctctaagcaactttcaggtaggtgatagctagctcataggcaccagaaattcataacagaaattaaattacccaaaaggcacagaagaaaatgttaacacaagtataaaagtaattttatgtaaggttaaaacctatttttaaaatgcttccaaatatgtaaaactatacacaagtccattacacattcagcttaagtttaccattaaaaagtgtacacacaatactgtaactgtaaatacatgccaccgtttataatgtagcatttaccaccacagcacccaaagatattaacagaaaccaactccccactaaaatctagggaaaggttttagagctagtgaaataatttattgcagaccgtatttattataaagaaactattggctcattctactgtatccacactccctcacaatcttaagggagatacaataagtccactctcttctcctaaaatgatatttagcacatttgacaaggaggagtggttgctttattcctttttcttatctttttttctttttctttttttctttctttcttttttttttttttttaagaataaatcactttcacaaaactgagactcaaacttttttgaagctcagcttgatttgctggaactacacagagacatgtttgatcacacaacagcaactgtacatcctcccaagtctggaatacggaattgatggaggacacttacttgcttaaaatgtatttgattattctgcatttatgataaaaatatcatccagggatcatattcaagagggtaaatttaggattacatgtttctagaacatataatatgtaatgccatccaaaaccaacaacaaacaacatagagcactgaaaccgaagagccacttaaaatttagaattaggaaatttcaatctataattgtcaaacaataagtgagttataatatttttctaattagaaaaatatcacctaaagtggaaagccagcatttagttggggactatgagatactacatccttggtctggctggccaccattttaaagaccaccacagatctcaaggcatgagacctctcaccaacaaaatctatccctgctattgcacctagtgccatctcaatatgtggcagacagcaaatgttctaacttaatctgatagatgctcctttagcatataaaagagcttgctaagtccctattacctgtagcagtctatcaactaaatatttaagaagtcatttcataggcaaggtttatgaatgacttagaagtaaaattagtaatttctaaatcactgtagtgttttctatgtttttagagatattcctaacacagagttttccgaggagctgtgaaaacaagtacaaacgtacataagtaattttgtcagggatgtttctgtactaatttgggggagacttgtgggccataaataaatgagatacacatcctaaaaataatggtaaaaattatcaagtaccactttcagatggttactcaagtatcaacttggtatgcaagtaagttcaccgatttcttcacctatgatttcatactcaaagtgctacatcttacttaggtactgataacatttagaaacctttataatcagcctcttaaagaaaatccagccttttcagatggtaaacttgtctttactaactttaatgcccgtaactatttcgatataaccaaacaaaaatttttaaaaatatattccttacagctcctgattaacttattttctgatacattctgaggctagtaacaaaatttagaccagaataggttttcatatatcaaaaaaaggaaaggaacacggagagcacagatgagatgtatggaggctctatactatagacccatccttgctctgtgcgggaatcatcacaggaatcgcgcccattcgacttagattaggggcagctaccttagcaggtgggagagtcggactctgaggagtgcgttcaaagtcttcacttggtacttgtttatactgagtcttggaatatccttccatgttggaaggagatatggatcccagggatgaatgattactgcctatgtagcttctggcagtggacgtgtggctctttggaggcggcacatcttccttgatatcgtgatgaacttccttttcatatttttcttctctgcgctttttacgacagcaaaagatgataagaccaatgagcactagagcaagcaaagttcctataatggctcctgcaattagtccagctttatttgaaggagggacaacgtttacacgcaacaggcactgatcagagcccactctgtttctgatgtacagctgtatgtcccagagtactcagaagaagcatttttacagatataacagatgaagtcatttctgctaaccatgaagtgggcattttctgtgagtcagacaatttttgccactcatactgtaatggaagtgaaccttcttttggttcacattttaatttaaagtcacttccaatttcttctgatccatcaacgtaacatcttgtacctgaaggcttaccaagaactaccagctgaatcttcctatttgcaacaccaggagctcttttcactttgcactgatctgtgccaatatctgacagctgaaaattcgttacatttattgatgcatcaccagatttgagatcattactcttaaaatgtactcggcctttcagatctggatagtagtcatcataatttttgtctccagaatataaaataatcacttgatccaccttctgattatcagctggtgatatcagccactcgatgtccagtggtccctggtcttcaggactaagcgtaaatttgcatggcagataggcagtttcccctttggctttttcaatcatctgctcaggagtagtgatactccaacctctgatgaaatccgcgactctgcacaggagcacgaagcgcagcaggagcgccacggtggctgccgtgccgtgggcggcggctgcaggtaggcggctctcgctccaggtcctaggctccccgcgcctggcgcactcaaggtagagaaaatcttaaagactccaccacaataaacggttaaagctgataaagaaattcaataaagttaatagttacaaaatcatacagatagcattattgtttctatacattaatgacaaactattacctgaaaaataaattaatgaggcaattcaatttataatagaatcaaaacagatataaaaatatgtaaaagacttaggagtaaatttaatcaagaatgtgaaagatttgcacactgaaaactatagcacattgatgaaaaaagttaaaatggcataaataaatggagaaacatcctttattgattgattcaaaaattagtattgtaaaagtgtcaatgctacccaaagcaatctacagattaaatgcaaccactatcaaattcccagaaatagaaaaattactgctaaaatttgtatgaaaccacaaaagaccctgactaaccaaagcaatcttgaacaaaaagaataaagctggaggcatcagactacccgattccaaactatattacaaagctatagtaattaaaacaacatagcagtggcataaaaacagacatgtagaacagtgcaaagggatatagaacccgtaaataaatccgtatgtctgtggtcaattgactttttgataaaataactaaaaatacacaatgaagaaagaaaattattttcaataaatggtgtagaaaaaactgactatccacatacagaagaataaaatttgacttttcttttgctctttatacaagcatgaaatcaaaattaaagacttaaatgtaaaactactacaaggaaatatagaagaagactgtatgacattggcctgagctatgattttctgtagattattccaaaagcacaggcaacaaaagcaaaaacacatgaatgagattgcataaaactaaaaagcttttccacaggaaaagaagtgataatagaatgaagagaacccacaaatgggataacatttttaaaccatacatcagataaggggctcatataataatatataagtaactcaacctactcaaacataagaataaaactatgcttattaaaaaaaataagcaaagaaccagaatagacatttcgtaaggcatacaaaaggccaacaggtacatgaaaaaatcataaacatttctaattatcagagaaatgcaaatcaaagccacaatgagatatcacctcacacattttactagggctattataaaaaaagatggaagataagtgttgatgaggatgtggagaaaaagaaaccctgtgcactgttggtaagaatggaaattagcacagccatcttggaaaacagtatgaagcttcctcaagaaattataaatatatttaccctatgatccatcaatcccacttctggatacgtgtccaaaggaattttaatcagtatgtcaaaaacagacatctgcaatttcatgttcattgcagcattattcataatacccatgaattagaaacaacctaagtgcttatcaactgaagactagataaaaatatgtggaaaaattggaacccttctacaccactggtgagactttaaaatgtaaagcagtctcgcagttcttcaaatggttaaacatagagttatcacgtgacccagcaattccactcctatgtgtttaccaaaaagaaaataaaacaaatgctacacaaacagtagtacacaaatgtttatagcaacacaaagtagaaaacaacagaaatgttcatcagctgaggagtggataaataaaatgtggtgtgtccataaaatagaatcttatttagcaagaaaaggtaaaaaactgttaatgcatgctccaaaatggatgaacattaaaaatatgttaggtgaaagatgtgagtaaaaagtgactatgtgttattataattccatttatgtgaaatgtccagaataggcaaattcatagtcagaaagtagacgagtggttgcctagactaggaggggtttaaaaaagactggagaaaatggggaaagattgctaatgggcgcaagtctcttttaaggaaaataaaatgttctaaaattatattatgatgattatttgtccatccagttaatatactaaaagaatttgaagtttgtactttaaatgagtgaattacacaatgtataaattatatctcaataaagctgtggaaagttaaaagtatatgtaggatgcatacaaaaatactacttatctttataaatgaatgaaaatctgtcatttgcaaaaacatggatgaatttagaggacattatgctaagtaaaataagccagacacagaaagacaaatatctcatggtatcacttatatgtgaaatccaaaactgtgcactcatagaagttaagaatagaatggtggtttatcagaggctgagcagagtggggggcaggggtggaaaaaggggaaatattgaatgggataatgcttcagttaggagaaagacattctggtgatatggtgcacagcaaagtgactgcagttactcataatgtagtgcatatcttaaaagtgctaaaatagtacattttaaatgtttcaccataatgtaatacatatctgaggtgaaggatacgttatttagcctaattagaccatttcacaatatctacatgtatcgtaccacattgtaccctatatatatttatttatcaataaaatcaacattttaaaaagtgaggaacacagatgtgctagatcttcatctaaagacatttctgagaaaagtgtatctgttttccttcagaagaaatttacacttaatagatattatggtaactaatgtaaggcagataattttggccatcagcttttattgtgggataatctctttttgctgaccttgtaaaagctgtggcatattaacaagtaggaacatttttttttatcatgatcaggtaaagattctgcaagtttctattttgaatatttccccaggaatcacaaagtgtgaatgccttttatttcagaggtctagccctaaatggtttagtcaattacatcatgcattctgaaataagtactggtgcatttgggaaggtactatatataattgtgttttaaatttaactatcatataaatctacttttctagttaacagtttatattttatagaggccctccatatacataagagcttttctgatagtatatccattagatttcaaagataagtaaaggaacaattttgcttttatttattattattattattttttaaggctagtcaagtgaagcagtgggagtggagaaggaactgctttaatttttatatgttggtgttacaggctatatgtgacaggctgtatatttttctgctgaattttagaaacaaaatgaaatatttatttcctatttcattagatttagggatgatgattacattgaggggttgggactagactgaaggcaccacatcatcaatcacttggaaacaatattttgcctatgtgttatgttatattgacaaaaacttttattgtggcaggcaatatagctccctattgaaatatgtgaaaaatgtagagaaaaaaggacaatattagttatcaagggatatttaggcctgagatgcatgatgctaatattcaaaacatacactttttaaaaattagatttaaaatgtaaattgaagcagaacatttagaaaaagacataatatctactataaaagtcctgggttagaaaagttaaaatgctaaatgaaaaaataatgcttcttgggtggcttaaaatcgaatatgagacaaaagattactcagaaatttttctaagattaaaaacgtgtatacagtttctttgatataaaatgaaataaatgtctggatataactttaacagaatagaatagggagacaagggcaacgagcaggtgtatgtagaataaagtgaacatattattgtaataatgagagggacagagttgaatgattgctcttggagacaagggattttgatgtctaagttaatgacaaatcttttgtatgcaagtttaaaaatgtaacttaaacctggtgaaggaataaagggtggttggagggatgattctttgtacactaaacttattttaatgactaatgaattaatcataagttcaaatgattttatggaggccctttctttatttgatatttctggactccttttttctttgtgtgtgctccatttttacctacttgaacaatttttacccccaaagtttaggaaacactgtaaccaaatgttccaacatgatataatccctgaaggcatttgcagctgggggagtaggggaaaaggggtttctctttcaacaaatgcatgttaacctcggtgaaaactcagaagtttaaacatggtcccccttgggtcatgtggctaccccaggaccaatcattgcaccagacataggagataatctcaaaagccaggttggagtcaaggttctccagtggaatttccactttagaaatcagttttgtcaggctttgtgtttgcatattacagacatgatagccatatagctatctattccagtagagatgaaaacctaagagcatatgcccattcaaaggattttacatgaatcttcatagcagctttacttgcaacagccaaaacctgaaaatagtccaaatatccatggacaggtgaatttgtgacttataaacttactatggtatctgtatataatgaaataatactccctagtaagaacagaacaattgatagatgtagcaacatgaataaatctcaaaaatagtgatgctgagtgatcagaaagtatacataccctatgattttatgtatttggaaataaaaactcacggatagtgactagaagtggatcagtggttgcctgtggatggaatggggataggcaggaaaaagtgagtagaaaaagcacaaggaaactttggtggtaaaggtaatggatatgtttgctattttcatatgttgttggttttgtagagctacaaatgccaagaattatcaaaatgtacaattgaagtatgtgcagtttattgcatgtaaataaactttttaaaaattaaccgatacaaattgacttacatgaccagaaagctcttgaaaaactctcctgttttctcccctatttttattcttgcatgcccttatagcctgtgttaacacatttctcatcttaccgttattttgtgtctacatttcaccaagtcaatataactatcaccataatttcttggtttctctttagttcattagtaattatgagtaatgtattgaaatgttaaagatatgttcatgcattcagaatgctctgctctctgatccacataatagtgaattatgctctcaataattacacagtatagtaatttttttttttttttttttttttttttttttgagacggagtcacacttggttacccaggctgaagtgcaatggtgcattctgggctcactgcaacctccacctcacgggttcaagtgattttcctgcctcagcctcctgagtagctgggattacaggcatctgccttcatccccggctaatttttgtatttttattggagacagggtttcaccatgttggccaggctggtcttgaacctctgacctcaggtgacctgcctgtcttggcctcccaaagtgctgggattataggcatgagccaccacccctggccagaatattgctacttttgcaaatagctacaattgaccctgatctggactttgagttgatcacagctttgtaaaagaggatagcattgtaaaactgcaaaattagattaataataacatagaatgctttcagtataagaaataatactatcctaagcaaaaataaataaataaataaaactggaggaattatattatctaacttcatattatactacagaattacagtaaccaaaagagtagggtactgacataaaaagaggcccatagatcaatgaaacacaatagagaacccagtaacaaatctacatacctacagtgaactcatttttgacaaaggtgccaagaacatacactggtgggaaatggtgttgaaaaaactggatatccatatgcagaagaatgaaaacagactagtatctatcactgaatacaaaagtaaaatcaaagttgattaaagatgtaaagctaagacctcaaactataaaactagcacaaaaaaactttgggggaaatctccaggatattggtctgggcaaaaatatcttgagcaataccccacaagcacaggcaaccaaagcaaaaatggacaaatggatcacattaagttaaaagcttctgcacggaaaatgatacaagcaacaaagttaagagataatccacagaatgagagaaaatatttgcaaactactcatccaacaaaggattaataatcagaatatataaaaagctcaaacaactctttaagaaacaatctaataacctggttaaaaaaaagggggcaaaagattcgaatagatatttctcaaaagaagacctacaaatggcaaacaggtataagaaaaggtgctcaatatcactgatcatcagagaaatgcaaatcaaaactacaatgagatatcatctcaccacagtttataagacttgtatgcaaaagacaggcagtaacaaatgctagcagggaagcagagaaaacggaacacttgtacattgctcctgggaatgtaaattaataaaaccaccaaggtgaacagtttggatgtttctcaataaactaaaagttgagctagcatatgatctagcaatcctactgctgggtctataccaaaaataaaggaaatcagtatgtcaaatacatatctgcactcccatatttgttgcagcactgtttacaaaactaagatttggaagaaaccttagtgtccatcaacagatgaatggataaagaaaatgtggtacatatacacaatggaggactattcagctgtaacaaagaacaagatccagtcattgtcagtaacactgatggaacattatggatcattatattaagtgaaataagccaggcgcagaaagacaaatgttacatgttcttacttatttgtgggatctaaaatcaaaacaaactcatggacatagagagtataaggatggttatcagaggctgggaaaggtagttgggggggggattttgtgggaaggtggggatggttaatgggtataaaaatagagagttaataagacctactattttatagcacaatagggtgactatatccaataataatttcgttgtacattttgaaataactaagactgtaattgaattttttataacttgaaggataaatgcttgaggggagggataccccattccccaagatgtgcttatttcaccttgcatgcctgtatcaaaacatctcagggaccccacagatacatacacatactatgtacccacaacatttttaaacaatctaatacaattttttaaatggctcttattttttgttaacttcaattattgtaaaatatattctattatttatgatttgccttgtttgaaaacaaattttaaaaacactatttaagaccagataaatggactaggagtaacttgcataaaaatgacagaaattgctgctacttcttctaattattgagatggtatttctatatttgtgaaattatctgatagaaaattgaattgtttccaacattatttttcataattaaacatgttatattgctacttctttaaaagtagcctttaaaatattaccaatctattttaaagtctacttgccaaaacattaaactattcttaaaaaaagtaatttatttaattacctaacatcctcaagcaatgtcctaattttctcaagcaattatctgattttctcaagcaattgatattagcaagttgtgctagctaactgctgagaatcattgtctacatatgagataaatcatctatcaatcctttaaagaagactttatgagccatagagattgtagtccaatctgtatcactgactttaaacattggataattgacactccgtgttgtctgtaagcctatttcacagcagctgagtgatgttagtaggtacctcttggagtgccattttccttgtaacccttagattaattcagattgactgagttctgtgtcagtggaaattgccagaattatatcatgctgctttgcatctagtttcacttttccaaaagcctacacagatttcagatgtttagaaaatagctcttgttttccttctgggtaatctttttcatgtcaccactcttgtcagcatctgcattgggcaaatttcctaggacctcccttctgcgtcttttaaaatatgaaaacaaaatcaatgtagcgcagcaagccagggaaagtctgctttgattgacttacggccatagtcacccagcagttccttcagatgtggcttcccaggtcagccactgagcccaccgctgtcctcctgcctgcagaagtggctctgtgagccgtttgaggagaaaatgggggactttgggcttcagcccgaggagaacacggtggagatggaggagcccctgggcgtccgcaggttaactgaaaacatgagaggacacaagcacgggaccaagtctgtcactaacctgtaaagtactctcaccaagccgaccgggcactttgtctgagcgcctgcctttgccaccactgtgtgcaggaatgcctgggtcatgactgggccatcccagtgttcttatttctatacattccgaggttacccctcagcaaaacgccagaggctggcagacacagcggagcatcctgcagtagggatccgaagccgtggaatctccaaaggaccacttgaccgcgtcccagaagctccagctcaggctggacattgcccagaaagcccacatcgtctttggcaagacctcccggattgtggttttgatttgcatttctctgatggccagtgatgatgaacattttttcatgtgtctgttggctgcataaatgtcttcttttgagaagtgtctgttcatatccttcgcccactttttgatgggattgtttgattttttctggtacatttttttaagttctttgtagattctggatattagccctttgtcagatgggtagattgcaaaatttttctgccattctgtaagttgcctgttcactctgatggtagtttcttttgctgtgcagaaggtctttagtttagttagatcccatttgtcaattttggcttttgttgccattgtttttggtgatttagacatgaagtccttgcccatgcctatgtcctgaatggtattgcctaggttttcttctagggtttttatggttttaggtctaacatttaagtctttaatccatcttgaaaagttaataataataaaaataataatatggaagaaatttaaaaaaaacctcccagagaccaggaacttggggcgcgcggcctgagatcaccccaagctctgggtgccttcctgtccttctgcttcttccttggccgctttagggggcgcgccttgccatgcgtctccctgcgggcggcgcggtggtgctcctggatgtcacctccaggcgcttttgagactgcgaccggcaccgggcaccaggcacctgcggattggcctccccacgccgggttcagggacctccagcgctccgcggtgcaggctgcaggcgacctcaacgtggagctgctgccagcgccacaggccccaggggaggcccaggatgctgcttccccgccccaagaagggcagtttggaggaaagtctttggcctgatggaaggcggcgcccatcgggggcggggctgagaactaggccggcgccgctgcctggtaagcggggaccaagaggcccacggcctccatcaggaaccaggtgcttctccaaatcccggacgtccaggaggaacaacggcgtcaagctggctgacaccaggaacacccagaagtccccgctcctgtctgtccttccgcactcaggagcggggatggccacagggacaccatctgcccacaaaccgctggcgtttgctgccatggtgcgcggagatgcggtccccgaggaggccactttcggccaggacgccgggatcgtatcagcagcagcatcccgcgctgacactcagtattgacttttcccggacattgctggattttttcctttttaaaacaattttgcagtgggagaacaaaaaagggcatcctcagagcttttacaaaattctcctggacctgttgttctatggtgttcacctctgcgttttacggaccactaatgggccagagctcctaaggcctataagggccccacccagcgctttagacacccctgagggacactcgcggctcaggaggataaatgttctcaggggcgtgctgtgaggaggacatgcagcccctcagccaccacatcttcctccattccagcctggaaagagagaccttgccctccaccttacaggccttcctgaccttgggacccactctagaggccacgcgcatttccactgccaaagcaatgacacaggagatggaaagaaattcttggccaggcgcggtggctcacgcctgtagtcccagcactttgggaggccaaggcgggcagatcacgaggtcaggagatcgagaccatcctggctagcaaggtgaaaccccgtctgtattaaaaacacccaaaaggtggccgggcttggtggcgggctcctgtagtcccagctactcgggaggctgaggcgggagagtggcgtgaacccgggaggcggagcttacagtgagccgagattgcaccactgcagtccagcctgggggacagagcgagactacgcctcaggaaaaaaaaaaattattttgccttcactatatgcctaagtaatttctctattagagcccagagtcgtggggcccacaccgccagctgacacatgaaagtgtggcaacgatgtggtggtgtctctgtgtggcagcgtggtggtgtgtctgtgtggtggtgtgtccgcatttctgtgtggtggtgtgtccgtgtggcagagtgtctgtgtggtgctatgtccatgtggtggtgtgttcatgtatctgcatggtgatgtctccgtgtgacagtgtgtttgtgtatccgtgtgacagtgtctgtgtgtccttgtttccacatggcagtgtctgtgtggtggtgtctgacagtgtggaggtgtgtccatgtgacagtgaggcggtgtgtgtgtgtgtggcagtgtccatgtggcagtgtgtttttgtgttcgtgtgagtgtgatggtgtgtccatgtgacagtgtagtgatgtctcttgtgtgtgtccctgtgatagtgtggtggtgtgtccatgtggtgacgtctccgtgtgtctgtgtgtccctgtgatagtgtggtggtgtgtccgtgtggatttctccgtatgtctgtgtgtccgtccatgtgaatgtgccagtgtgtccatgtgacggtgtgtccgtgtggtaatgtctccgtgtgtctgtacatgtgacagtgtggtggtgtgtgcgtgtaacaatgtggcggtgttcccttcccggcttgcggagctggcgtctttccctctcagcccaggatgccccaggagacccccagcttggagggcaggaggtggcttctgtggagggaggcgcagggagccccaacagccgagttttggggtcccctgcattgggtgggagtgaggagaaaggtgcccgggcagccaggacaagcctgggcctgccctaaggaggtgacccactccgggcctgcattttggggcgagcactccagctcggtcatcttgtcctaagtcctttgtgtgccgtggagattgctgagttttgaagaagggaaggtcatctttgtcgcggaaagcctgatgtgtttctctattgctgtcacttttcagcctcatggctggcgaaacatcaaacattgggcaccttctgccaagaaaactcccggaagaaaatgtggggactggcagtatccaaccagaggagtcacacacagatttctgtttggttggagatcggccgtttttccctgtgggtgggggaagcgcagcagctctgcagcgggaaggaaggggggttctgtgtggccaggaaggtcctggcccggggcggaggggccagaggtgatgtgcggcgaaaggctgtgcagggcagcaggcagtgtgcatcgcccctactgccgggcgcccaggaggaggacaggtcccggcctggcaggagcagaggcgatgcggctggagtccccgcaccaggcttgagggccggcggagccgcaggctgtggcggagggggactcccgggcacctggtgggtgtccccatgaccaggatgcacaccgggctccggaggccaggcggaccaagctaggggtgccaggggaggctcgaggttccctcggtgggaggtgggtccctggaccctggtctcctgctgctgtccccccttcgctcaggggcaccccgccagggtcgcctatctgggacctcagcgcagctcctagtgggcgggaggctgaggcagaggcctccgggcccagctgggtctgcagtttccaccactcgtgatgcagggcgagctcaagctgtgccacccaggcaggaaaccctccgaccttgccagctttggcgccagccttggtgactctctccagctcagcttcaacacctttcaacagttctgtgttctctattatcacaagaattctttctgtattttctatcctttatcaaataggaatttaaatatgcatatggagtgattatcacagttgaaacattaaacaatatacaatttcatgtgtcttttttgtttaatgtataattttctaagaagtaaaattatgactctactgcaaatataagataaacacatatcaacaatgtttttcaactcaataagcgatgagggttccagtaacaggttcaaatcattgcaaggaacattaaaggagctttacagccaatgttaacgtcagatcgctgggtacttacagtactggttagtatccaacatagccagaagctgtcatctttgtgagttctctcttccatggcacagaaatgatgcgtttttctactgtacaaaatatttatcttttctactacttctgcacataaaaatattgctagtcagaaaagaccagaattgcactgaaagaaaatctcagtaatatctctcacctgtattcttactttttcttcctttatgaaatatctttcaactgcattttctatctgaaagtttatagagagatgaaaatgaataaaagcatagtaagtgaatattttgataacattttgcagctttattcatgtctaacgaacataaaacacacttccaatatttaaagtgtaaatgagatgaatttgatatgtacatgtgcccattaatcaccatgaaggggacaatgagcatatccaatactctcaaagcttcccagttctcttttgtaatgcacactcatacctctcaggtgtgaagtattgagcttcacacacacacacacacacacacacacacacacacacacacacaaatatatactgggatatctaattgtttcagaagcatttgttgaaaatgttatgtccatgaatggtctaagaactttatcaaaaattagctgatagatgatatacatgtgtatatctatatttgtactacattgtcttaagtattactgtaatgttataagtcttgaatccaggtgctgttaattctccagcagcacctggtttcaaagtaactgtttcctttcaaagtaatttgccattataggtcctctacccatcgatgtacatttcagaattttagtttctcaatttctaaaataagaaatccagctgtgatttgattggaattgttatagatcaatgtggaaagagtagacatcttaacaatattgagatttatgactcataaattccatttatttaggtctcgtttattttagcaatattttgtagttttgtagttttcaaatgtttctcttttttgctggtttatctctaagtactacatattttgatatttacaataatatcaaaattatggtaatattaatgcaaatgttgttttttttttcctccattaattgtcaggtagttttaaatcataatttaattgtatgataaaactgaattttgcgagaaatgtatacatattgtatatatactttttttcagtttggcagattgactgcattatcatatcataatttaaaattgcactaattaccactcagcctcctctcaaggacaatatatcaaaatatatagcatgtttcagtttacttagcatcatgaaactctcatattgcacttacttttggaaacctggaataataaaataatgtaaatgtcagttcacaggcgacatatgagtacatgcgacaattttctaaatatcgacctatcgctctttaattctatgttaatattgtcaattttttcctcctcttgcaactctcttatgcagcttattgacttttggttcaattccttccctgttttccccccaatctactttctaatattttactgatgttgtgctcctttttatttggacacttttaaaaagctgtgtaatttctcctttgtattaaaatgcaaatccatatccaaaataaatgagcggagggaccaaaaagatgtttgtgcagcgtgtccattagcaatattattcacaataatcaaagggagggagcagcccatgtgaatattgatggatgagtggttaaacaaaatgtggtatatacggcaacataataatattcagccttaaaatatattctcacacatgttacaaaatagatgaaacttgaagacatgctaagtgaaataagccagtcagaaaaattcaaacattctatcatgccacttctatgagttacttagtgaaatttgtagagacagaaagtagaatggtgattgctagggggaaggagagggagaggaatgggaagttggtgttcaatgagtaaagcattttagttggagaagaagacaagttttggaggtctatggtggtgactgttgcacaatagtgcaaatatacttaatgccacaaaactgtgcacttaaagtgattaaaaaggtaaattttatgttgtgtatatctttccagaattataaacctgccatcacagtatagaaatagaatatattatatagcgttaggtgatgatattttacacatttgcacataattagaatttcaaagccttaatttcagatacggtagtctaagacataacaatattgatgtaagaaagccgtaagaaatgtttattttcaatcagatttactaaaaaaatttattgaactggtcaattttctttgccaatattactgtattcttatttctagtaatagaggtgtgagaaagcatcaaggaaactaaaattgcattctcatactgactgcatacaataattctgaaaacagcagaagttatgtatatcccccataagtaaaacatgagtaacacaacagaacaaaaattaataggagacaattcaaataatggtgacctgttattcttatctagttaagtactattcttttctaacaggaatttgctatttcaaatatattatctgagatgtctatatttatattttgagatgccatacaaacttgagtcaatgacatagaattttacaaatcaagaagcttattctggggtcatttcttttgacattaaactactaaagaggcattaatgatccataaattatattatctatatttacagcatttaaaatgtgttcagcatgaaatattagttacaggataagtgaaataaattaaacatggaataaagatttatccttaaatataaattacaagaagacttggtattagtttttcacaagtgaagcattcttataaaatgtcataacctttttggggaaactctgggaaaaaatggagaaactctgaagggttttaagtatctttcctgaagctacagactccataatctctctttacagggagctcctgcagctccaacagaaatgagtggctgagattcctggttgcagagcagagcttctcatccaaaccctttccctttttagtgtctgtgtatcagtataaaagttctataaactgtagttacttattttaatcccaaagcacagtaacaatatatttcatccaagggttggcagtttctgtgagtgttttgtctaattctccaaaactctatctacaggattccaaacagcctaaaaagtaaaatattttaaaaaggggaaagggagaaagggaaagaaaataaaattaatagcccattctgtcactgttattaaacaccagaatacctttctgttaatctaattaaaattagtgacatcatttaacatttatgtcttcaacaaaagtttggaatcctgaaaaagacatttaatttcctaataaatatatttgaattgaattgaaatccttacatattactttaaataaagaacacaagatgatttatgatgtagaaaattctatccctcattgtccaaaatctaatagttaaattgaacttgttaaataatatttttggccaggcatgtggcttacatctggaatcccaatactttgggaggcaaagacaggtggattgcttgagctgagtagttgcagaccaggctcggcaacatggtgaaacccaatctttaccaaaaaaaaaaaaaaaattttagccaggcgtagtggcttgcctgcctgtagtcccagctactcaggaggatgaggtgggaggatcaccggagcctggggaagctggggctgcagtgagccatgattgtgccactgcactccagcttgggcaacagactgagaccctgtctcaaagaaagacagaaagaaagacaagaaagacaagaaagacaagaaagaaaagaaagaaagaaagaaaagaaaagaaagaaagaaagataaagagagaaaggaaggaaggaaaattaatagttttggtggcaataatctttatggaattttgctttaatgaaatagatttaactaagtagtgacatgatctgcttaagtgtattgaccctagcaatcagaggcctccgtatccccacaatgacttaacagttacatttgacaagccttgattctcctatcctacgcacagcatagtcagaatttcagaattccaactttccccatgctatttgggcacgttgcttaacatctctaagactcgatatttatactcttaagatactactaataatagtacctagtttttatgatataatgtgcatcaaaagcattatactttcaggcagatggcaatttctcaataaatatttgctaatgttttagtacaaacaggaaaattggattatgatatttatgacactgttgattctccttctagaaacatttgtttctaaaacttgttttcaaattagagcactattttgtattcagattgaaaatactatatgttcagattttttaaaaaacagtattgcatgaatgttttaattaaaatattcctaaatgagcttgagcaaggaggacaggggagataagtaaaataaggctttgtggcataggagacatttggtggaaatctttcagctcaactaagatttgaaaaaaaaagagaatttttataaaaaatgtaaaggcaggatttacactgatgagcttgtggagaaaatacagagtctaacataattcaaaagagactaatcagtcaaagtggtttcgaaggaatatcttgaagagagagaacataaaatgaagatcaggtatgtagttattttaataatctatccatgagataaaaagcattgggttttatttgtcaaaatgggacaatagttccaagaaccattatttgctcagcctaaagaggtttttacattttgaaccagcgacatattgtgctaagtaggataatatccaaatttgtgtctatatcaataattttgttctcaattaaaaacactttattcacacaactgatgattatctgcatttgatttagtgctgaactgtcaaagggggactaacaaaaacaaaatattagagttgcaagcagtgtaagtggaaaataatgatcatattgaactcatcattactgaaataagaaaacaaagcaaaaaataaataagaaaaaaattgactacgtgaacatttgcttctctcctaagaatcaaaacccttaatttgctgtggcaaaaaagcatctgggtccatgaacccatgcaaaagtctactgtttctgggagataagaagaagcaaaacacatcagcttccagagaaggttaagaaacctctcataccctaccctaccccacctgacaccaggcaaaggatcactgcttctgggagagggatgcaagaaaaatactcctccatcaggagaggaacaaggattgttttggggcccaggattttgcactaatgcagagtcgtgttactgtggtaaaggtttggaaagtctccatccagtgaccacagacaaaggtacattgttcctatggaaggagaaataaaagagtttgcccttattgtggggttgaaaacttgcaatgatataaatcaggggttttctactactgaggtgggaggagggtaaggtattatttcttctgcaaaaaacaacacaggtaagtgacagtttgactcccactagaaaaagagtcaagaagtgttaaaaataccccatctctgagtgtccaatgatgaaactggctcaaaaacaacacaaaccatccctctgtccccaacctgaattttttgcctagtcacacacacacacacaaaatgatgttctacagttagagaagaacaagaaagtggagagagaccctctctataacataggttgtaaggactaccgaaagctaactgtggaacaggatcattggcatatgctctccagagtctaaggccccacacaaggcacatcatatagcagtctactgctggagaaatctgagttacattgttcactgaatgtttcagacaccgcagcaaaaagcaacctttgttcctgcccacactaatcgcatgacacaaacaaaaatgaaacagaaatataaaacaatctcgacataaataattatctcatgatctactgtttttctacatcagatgatttgcattttttagaaattgggagacacataaaagcaagttagaaatttgagttatgagttataatattttcaaaggataaaaagtcaacagaatcaaattcagagataattcagatgttggaactaaatgaaagtaatttaaaataataatgatcaaaatgtgaaaggatctagttaaaaaaagacaacatgtatggaaaaatgaggaatttcagcaaagatgggaacagtaaaaggcaaaatctagaaataagtgaaagcatgagaacagagatgaagtattacatcagcaagctgattagcagactggtcatcagagttaaagaaagaagcagtaaattttatactaggtcaatacaaatcatttgaatggtagcacaaagggaggaaagagaaaaaccaaataaaccaatgaaccaagcaaataaaatactccagtgaatcaaagaattttctggtaatatgaaattaaccaaaatacaattaattggaattacagaaggagagtaaaaacagaatgtgagagaagaaaaatttgaaaaagatgactgaggagaccaaataacctcaaaatatacaagaaagattaatacaaaatttaaagaacgctagaataatcacactagtgaaactgctgaaaaccaacgattagcataaatcttgaattcagtcacagaaaaaataagaacactgtgtagagagataaacagaaacaaacattgtaatgaactgcttgtcagtaactctacaagtcagaaaccaatgatacaaaattcttaaataactgaagaaaagtcaacccccaatcttatatccattaactgtaatacagcaaaaataacaattaaatgacatttgcagattaacactggaagagtcccttgctaacaggcatgcactaaaataaatgtcaaaatcatttcttgaggcaaaaggaatatggaagcaggtgaaagttgaaactacacaaagaaataaataatgccagagaagatataaagatatataacccaattattttacattgctctaaagataattgattgtctaattttttaaaaaaagagtaactttatattatggaattcataatatttgagactataatgcatgacataaatagtataaaggagagaggaaacagaaatatacattttaaggtttttataccatagttggtatagtacaaattataggttactgtaataagctagaataggtattgaaatctctagagaaaccatgaacatttttaaaaaatggtatgtgcattaatgttttcatagaacttccagcttttatttatttgtttgtattcatttaattttatttattttttttgagatggagtctcgccctgttgcccaggctgcagtgcaatggtgtgatctcagctcactgcaaccacctccgcctcccaggttccaatggttctcctgcctcagcctcctgagtagctgggattacaggtgcccaccaccatgcccagctaatttttgtatttttagtagagacggggtttcaccatgttggccaggcttgtctcaaactcctggcctcatgatcggcccacctcagcttcccaaagtgctgggattacagacttgagacaccgtgccaggccccagcttttagtttttaaggtagttgttgtgttattacatgtgaagtaaggttattcttaaatatccatgttttgagaattaatgataaagacaagttaatttatctcaatctaaatgacattttaatattaaatatttaaatatttttattacttttcctttttaacagaagtcattctaactggtgtgagatggtatttcactgatgttttgttttgcatttctctgatgattagtgatggtatgcatgtgttaatatgtttgttggccacatatgtgttcttctgaaaactgttcacgttctttgcccattttttaatggggttatttattttttgctcgttgatttgcctaagtctcttatggcttctggataataggcctttgctgtatgcatagtgtgtgaatattttcttccattcggtaggctgtctgttcaatcccttgagagtttctcatgctgtgcagaagaagctctttagtttaattaaatcatacttgtcaatttttatttttctggcaattgcttttgaggacttacccataaattcattgccaagtgcaatgtccaggtgaatatttcctaggttttcttccaggatttttataggcagaggatgtaatctcatgtcaatgggtcttaataatcaaatgactccacactgagaatcattactgtgaaaaatcgattttgttataatgatagaaatttaaacatataaaagtaaaaacagatgccacctctttgctagaactctacaaggcaaattactataagagagccattgcagtgaaataagtgaaagcacattataaataaacttacctgattttacaaactaacctgtaaagggatttgtactaatttttccattgcctgcattgccctttcttctagatccaatttatatttttgtacttcaccaatgtgtcttcaccaatgtgtactttccatacgttttttaagatttaatattactttttccaacatctttttagcctcctcaagatttttacattcctgttgtattttttcatacataataactcctgttgaataccttgattgttttgagtcaaacagacatattttgaagatacagcttccagctctgctgtaagatcaccaaactacattaataaaataatataacttgaaaatgaagtaggctgagaataatctcatacaaaaccagtaacaaattttgaaatacatttacttgcaataaaatgttatctataatgtagattctttaaatgttaacccttaaattactcagaaattcaagaacaaagtaaaagccaccataagtcacatatattctttactatcatctttgccacagaacttttgcacttgatctttcttttacttttctgataatttgtgttttttcctccttaaatggctctatgttaactcttattagaaagtttcaaacccctttctctcatcatcgtgccccaaaatttgtcaaaaaaagtttcagagatataatattgagttatttaggccaaagtcaataaatggctcttagaataagactttgaaaataatgtaatactctatgctaggcatggtggctcatgcctgtaatcccagcactataggaggctgtggcagaaagattacttgaggccaggaatttgaaaccagccagagcaacatagtgataacataatctcgacaaaaaattttatttaaaattaaccaggcatggtgatttatgcttgtagatccaactagttgggagactaaggcacaaggatggcttggactcagagttcatggctgcagtgaattatgaccaagccactccacttctgcctggatgacagacagagaccatatctcaaaaaaacacaaaataatcctataaataaggattctaatgccataagcctttccctaggctgtaaatgttttatgctaatttgaattgcatttttaaaagtaatgactcttggggtagaggccatagaatacagcacccagatataaatccacatatttgccttacaagaaataaatccacattcttgccttacaagagctcctgaaggaagcactaaacatggaaagggacaaacagtatgagccactgggaaaacataccaaattgtaacgaccatcgacactataaagaaactgcattaactaatgggaaaaaataaacagctaacaacatcatgacaggataaatttcacatgtaacaatattaaccttaaatgtaactgggctaaatgccccagtaaaaagacacagactggcaagttggaaaaagactcaagacccattggtgtgctgtattcaggagactcatctcacatgcaaagacacacacaggctcaaaataaagggacggaggaatatttaccaagcaaatgaaaagcaaaaaaaaaaaaaaaaaaaaaaaaaaaaaaaaaaaaaagcagggcttgcaatcctagtctccgataaaacagactttaaatggaaaagatcaaaagagacaaagggcattacaaagcagtgccatctgcttttcctcaggactctgctccatcagccatcaggtggcagccattcaggctgttggaacctggccatccatgcttctttgagtgggtgagattaaaggctggtccaactgcaccaggagcatgcttgcagaggtggctgcttgctctttgagccagcttggccttgcctgtcatgcacaggccccagctactgacacgctgctctgagtgagcttgtcctgcctggggccaaattctaagtctggccagggccacagaagggcaagtcccctgggtggtaatcctgacttttttctgcacttgaacataaagtcctcctcaagacggcctgtggtctgcctcttggcaaccaagaagcctgcagtgccatataagctcggaggcatggactagagccccaaaggcagtgaacaccctgctcctgagcctgctgctcatttcctctgtgtggctccatttgtagcacagttgttgtactgaggcttgtgcatgctgggcaaggacaagctggctcaaagaggaaccagccacttctgcaagggtgtgccaggagcaggtagaccagccaccaacctcactcgctgcctgccagacatggcacatcagttcttctaccctagaggtagggccccagtgccatctgctttttctgaggcctctgctccatcagccatcaggtggcagccacacaggctgtgggaacctgcctatgcttgcttccttgagtagcagaggttggtggctgctctacctgctcccggtgcacccctgcaaaggtggctggttgctctttgagccagcttggccttgcctggcatgcagaggccccagctactgacatgctcctctgagtgagcttgtcctgccttggcccaaattctaagtctggtcaggtccacagaaggcagagtcccctgggtggtaatgctggctgctttctgcatttgaacacaaagtcctcctccagacgacctgtggtctgccccttggcaatgaagaagcccgcagtgccatatgagccctgaggcatggactggagccccaaaggcagtgcacaccgtgctcctgatcctgctgctcatttcctctctgtggctccatttgtagcacagttgttgcactgaggcttgtgcatgccgagcgaagccaagctggctcaaagaggaaccagccacctctgcaagggtgtgccaggagccggtggagcagacactaaactcactcgctgccggttggggcacatcagttcttctcccatagaggtcgggccccagtgccatctgcttttcctcaggcctctgctccatcagtctccaggtggcagccactcagactgttggaacctggccatccatgcttccttgtgtgggtcagtttgatggctgctacatctgctccaggcacacccttgcagaggtggctggttgctctttgagacagtttggccttgcctggcgtgcacaggctccagctaccgatacgctgctctgagtgagcttgtcctgcattaggcaaagttctaagtccggtcagggccacagaaggcagagtcccctgggtggtaatcctggctgctttctgcacttgaacataaagtcctcctcaagatggcctgtggtctgcctctttgcaaccaagaagcccacagagccatactagcccggaggcattgactggagccccaaatgcagcacacaccctgctcctgagcctgctgctctgttttctctgtgtggccccatttgtagcacagttgttgtactgaggcttgtgcatgctgggcaaggccaagctggcgcaaagagaaaccagccacctctgcaagggtgtgccaggagcaggaggaccagccaccaacctcgctcacagccggtcggtgtacatcacttcttctacccaagaggtagagccccagtgccatctgctttacctcaggcctctgctccatcagccatcaggacgcagacatgcaggctgtgggaacctggccatccctacttccttgagtgggtgaggttggtggctgctccacctgctccaggtacacccttgcagaggtggctggttgctcttcgagccaccttggccttgcctggcatgcacaggccccagctactgatacactgctccgagtgagcttgccctgcctggggccaaattctaagtctggtcagggccacagaaggcagagcccctgggtggtaatactggctgctttctgcatttgaacataaagtcctcctcaagatggcctgtggtctgcatcttggcaacgaagaagcccacagtgccacacgagccctgaggcatggactggagccccaaaggcagcgcacaccctgctcctgagcctgctgctcgtttcctctatgtggctccatatgtagcacagttgtcgcactgaggcttgtgcatgccaggcaaggccaagctggctcgaagagtaaccagccacctctgcaagggtgtgccaggagcagatggaccagccaccaacctcactcactgccggtcagggtacatcacttcttctaccctagatgtagggtcccagtgccatctgcttttcctcaggcctctgctccatcagccatcaggaggcagccactcaggttgttggaatctggccatccctgcttccttgagtgggtgatgttggtggctgctccacctgctcctggagcacccttgcagaggtggctggttgctctttgagacagcttggccatgcctttcatgcacaggctccagctactgacacgctgctctgagtgtgcttgtcctgagttaggccaaattctaagtccggtcagggccacagaaggcagagtcccctgggtggtaatcctggctgctttctgcacttgaacataaagtcctcctcaagatggcctgtggtctgcctctttgcaaccaagaagcccacagagccatactagcccggaggcattgactggagccccaaatgcagcacacaccctgctcctgagcctgctgctctgttttctctgtgtggttccatttgtagcacagctgttgtactgaggcttgtgcatgctgggcaaggccaagctggcgcaaagagaaaccagccacctctgcaagggtgtgccaggagcaggtggaccagccaccaacctcactcacagctggtcggtgtacatcacttcttctacccaagaggtagagccccaatgccatctgcttttcctcaggcctctgctccatcagccatcaggatgcagccatgcaggctgtgggaacctggccatccctacttccttgagtgggtgaggttggtggctgctccacctgctccaggtgcacccttgcagaggtggctggttgctctttgagccagcttggccttgcctggcatacacaggtcccagctaccgacatgctgctctgagtgagcttgttctgctttggcccaaattttatctctgtccagggcagagtcccctgggtggtaatcctgcctactttctgcacttgaatatcaagtcctcctcaggatggcctgtggtctgcctctttgcaacgaagaagcccgcagtgccacacgagccctgaggcatggactggagccccaaaggcagcgcacaccctgctcctgagcctgctgctcatttcctctctgtgactccatacctagcacagatgttgcactgaggcttgtgtatgccaggcaaggccaagctggctcaaagagcaaccagccacctctgcaagcgtgtgccaggagccggtggagcagccaccaaactcacttgttgcaggtcagggcacatcagttcttctaccctagaggtagggccccagtgccatccgcttttcctcaggcctttgctccatcagccatcaggaggcagccattcaggctgtgggaacttggccatccctacttccttgagtagctgaggttggtggctgctccacatgtcccaggtgcacccttgcagaggtgactggttcctatttgagtcagcctggccttgcctggcatgcatagtctccagctactgacatgctgctgtgagtgagcttgtcctgccttggcccaaattctaagtctggtcagggccacagaacgccaagtcccctgggtggtaatcctgctgctttctatactcgaacataaagtcctcctcaagacagcctgtggtctgcctcttggcaaccaagaagcccgcagtgacatatgagccctgagccatggactggagcaccaaaggcagtgtacaccctgctcctgagcctgcctctaatgtcctctgtgtggttccatttgtagaacagttgttgcactgagacttgtgcatgctgggcaaggccaagctggctcaaagagcaaccagccacctctgcaagggtgtgccaggagcaggtggaccagccaccaacatcactcgctgccagacatggtacctcagttcttctatcctaaaggtagggccccagtgccatctgcttttcctcaggcctctgctccttcagccatcaggtggcagccactcaggctgtgggaacctggccatcccggctttgttgagggggtgagattggtggctggtccaactgctctaggcacacccttgcagaggtggctggttgctctttgagccagcttggctttgcctggcatgcacaggccccaggtactgacacgctactctgagtgagcgtgccatgcctggggccaaattctaagtctggccagggtcacaaaaggctgagtcccctaggttgtaatcctggctgctttctgcacttgaacataaagtcctccacaagatggcctgtgatctgcctcttggcaaccaagaagcccacggtgccatatgagccctgaggcatggactggagccccaaaggcagtgtacaccctgctcctgagcctgctggtcattttctgtgtggctccatttgtagcacagttgttgcactgaggcttgtgaatgccaggcaaggccaagctggctcaaagagcaaccagccacctctgcaaggatccacctggagcaggtggaccagccaccaacctcacccacttaaggaagcagggaatgtgtgtttgtaccatgcattgcactacaagtacatttctcctgagtttggtggcctaggttttcttctaggttttttatggttttaggtcttaagtttaactcttcaatccatcgtaagttaatttttgtataaagtgtaaggaagtggcccagtttcagtattctgcatatggctagccagttttcctaacaccatttattgaataaggaatcctttccccattgcttgtttttgtcaggtttgtcaaagatcagatggttttagatgtgttgtgtcatttctgaggcctctgttctgttccatttgtctatatatctggtttggtaccagtaccatgctgttttggttactgtagccttgtagaatagtttgaagtcaggtaccgtgatgcctccagctttgttgtttttgcttagattgtcttggctacgcgagctcttttttggctccatatgaaatttaaagtagtgtttctaattgtgggaagaaagtcaatggtagcttcatggagatagcactgattctataaattactttgggagatatggcattcaggcacagaaatgtccttgtgttaggcaataccattcaggacataggcataggcgaagacttcatcactagaacaccaaaagcgatggcaacaaaagccaaaattgacaaatgggatctaattaaactaaagagtgtctgcacagcaaaagaaactatcatcagagtgaacaggcaaccctcagaaagggagaaaattgttgcaatctatccatctgacaaagggctaatatgcagaatctataaaaacttaaacaaatttacaagaaaaaaacaaacaaccccatcaaaaagtgggcaaaggatatgaacagacacttcccaaaggagacatttatgcagccaatgaacatgtgaagcaaagcactggtcattagagaaatggaattcaaaaccataatgagatacaatcttacgccacttggaatggccatcattaaaaaatcaggaaacaacagaagctggagaggatgtggagaaataggaatgcttttacactgttggtgggagtataaatcagttcaaccatcgtggaagacagtgtgatgattcctcaaggatctacaactagaaataccatttgacccagcaatcccattacagtgtatatactcaaaaaaatataaatcattccaatataaagacacatgcacacgtatgcttattgcggcagtgttcacaacaggaaagacttggaaccaacccaaatgcccaccaatgatagactggataaagaaaatgtggcatatatacaccatggaatactatgcagtcataaaaaaggatgagttcatatcctttgcagggacatggatgaagctggaaactgtcattctcagcaaactaacacaagaacagaaaaccaaacaccacatgatctcactcataagtaggacctgaacaatgagaacacatggacacaggaagggaaacatcacacacaagggcctgtcagggtggggggctagaaaagggatggcattagatcatgggttggtgcatgcagcaagccaccatggcatgtgtatacgtatgtaacaaacctgcatgttctgcacatgtaccccagaacttaaagtataatttaaaaaaaaagaaatttgcttttaattaagcttttcaacatagaacttgtaaagaaaatacttctgaatcttttactaccacatcatagctgggacaaactgctgatattttaaaagtaacacaaatatcaaacagaaagaactagacttaggaaccaaactcaggtttctgtagtgaacagggcagaatcttaactttgggtcgccaccactactccctcagtttggccttggctagcaaaagatgcaaccacttatgtaaaaaataaaaataaaaaagttaaaaaaatcatttctgctaactggaatttttttttttttttgcagccacatgagttttagccaattcagaagccttgttccccacaatttggagcattctttggatttcaccaagtcaggaagagatgggagaaaagtgaaacaacaacaacaaaaccccaaacataaacaaacaaaaagagttaagcaaaacaaacaaatgcacaattcatatgattactgagtgttctaatggtaacgagaaattaaaagcagctggtgagtaatcttaaattttagtcattaaggaaaaattttaagacaaaactctaattcagctacttacctggaaataagtctcaggctggtgattgttctctgccatcttagaagctggaaaaaacttacactcaccttccctgtcagaagcaagctgaaactcaagaaaggaggtgcctgctctccatcatcacggaagcaggaaaacttgccttgttggaaataagtaaaacttcagaaaaggagttgtatagcaaaatcaaccttagatctcaaccaaattttgggagatcagggattctctgcaggggagaagctccctaacctcagcacattatcctattggtttgggcaataaagatagcccaggttggtatcaagcaataatgagatttatcaaaggtcaggaccacctttgtaatctccttctctctcttttttttttttttttttttttttttttttttttttttttttttttttgagacggagtctcactgtcttgcctgggctgcagtgcagtggcacgatcttggctcactgcaagctccacttcccaggttcacaccattctcctgcctcagcctcccaagtagctgggactacaggcacccgccaccatgcccagctaattttttgtatttttcgtagagacggggtttcaccgtgttagccaggatggtctcgatctcctgaccttgtgatccatctgtctcagcctccgaaagtgctgggattacaggcgtgaaccaccgcgcccagccctctgtctttttttttttttttttaatctttattggtatagtctgctttgtcagaaactaggagtgcaacacctgcttttttctattttccatttccttgaaatatttttctccattcctttattttgagcctatgtagggcactgcatgtgagatgggtttcttgaagacggcatactccaatgggtcttggttctttatccagcttgccccctgtgtctttcaattggagcatttagcccatttccatttaaggttagtaatggtatgtgtggatttgatcctctcgtcatgctgtcagctggcttttttgcagacttatgtatgtggttggtttttagcatcacttgtctgtgtacttcagtgtgtttttgtagtggctggtggtggtcttttctttccatatttagtgcttccttcaggagctcttgtaaggtaggtctggtgataatgaattccctcagcatttgcttgcctgaaaaggatcttgtttctccttcacttatgatgcttaattttgctggacatgaaattccgggttgaaatttcttttctttaagatgttgaatatcttttctggcttgtacagtttcagttgagaggtctgctaagtctgatggaattccctttgcaggtgatgttgcctttctccctagctgcctttaacactttttctttcattttgaccgcagagaatctgatgattatgtgtcttggggatgatcttctcatggcatatcttactgaggttctctggatttcctgaagttgagtgttggcctgtctggctaggttggggacattctcatgaatgatattctgaaatgtgttttccaagttggttccattctcctcatctctttcaggtacattaatcagtcatagatttagtcgtttatataatcccatatttctcggatgttttgttcattccctttcattcttttttcccccattcttgtttgcctgttttatttcagaaagccagtttccagattctgggattctttcctcttcttggtctattctgttggatggtcttgcacatgagatggagctggtctgacctcagccctccctagtctgcttgcctctcccaggaccccagcctggccacatctgcttacagggcactctcaggtgcccacacatactacaataattttcataatgcaatcacacacaatcaccgtgtgactgcattatgaaaattcttctagtgtgatttacagctctgtcaggtcagttattttcttctttatacttgctattttgtctgttagttcctgcaatgttttacaatgatttttagcttccttgtattggattacaacatacttctttcactcagggaactttgttcctacccatatcctgaactctgcttgtatcatttcagacatctcagcctcagcccagttctgaacacttgctggagagttgatgcagtcatttggagaaaagaaagcatgctgaatttttgagttttcagtgttcttgcacagagtctttttctcatctttatgggcttatccaccttcaatctttgaggctgctgacctttggacagggtatttttcctttattatatctgatgaccttgaggatttgattgtggtgtaaggtggattcagccaacaggttttgtctttggaggattttaaggggccaacatgcagctcccaattcttggactgtgtgctttaactctggggaacttgtattgggccacaactttgttctctggctcatcgaggtttggagtccaccgcactgaggggaccaaagtgtggcagctgtggcagaatgctagcagatgcaaaagtccctgcctccctgtgggcattcacctagtggtggaggcaaaacagctggggtgtgggccagggggcccctgctgactgtgtgtgctgttgcactggaggtagttctggtttggggtgggtggctggccagtgaaggtgccttctctgatcccccccaagcaacagtggtcactcagggtataagaaggtcccttttcctctgcacagcattacctcaagggtgagatgctagcaggggtggggtttttggttctgtgcccaccatggcttcatcttcagtggcagttggtgtgggttggggtgtgtgctgcattcccatatgctgttagggcaagtacaacaaaacccacctgtgtaaacacacacagctaagtgatgtaggaagtttccatataaagggctgcagtatggagaggtaatgtgcaggctggtacgtggctgtagaggtcaccttgctgcagctctccactgatcagccacggtctgcttgtacagaagctatggtgtgggcacccaaaagtgccctctaagcaggtgtggcctggctggggtcctgggagaggcaagcagactaaggggtgctgaggtcagaccagccccatctcatgtgcaagactgcccagcagagatcaggtctcagaggagaactctctcaaaagtgaatcctcagcacagcacaactgctctacacaaacgcggccagacttcttttttaagcaagtccccctttttaggaagagaactcttagacctgatctgtgctgggcaatcttgcacgtgagatggggctggtctgacctcagcactccttaagtgctgggataaagtgtctcataagagcaagtggagcctagagacatagatgtccctgccctccaggctccacatcagctgacttgctgctccaccactttccttgtctcctgggggctacaccccagagaggtgtaagttaggagttacttaatgtaatcaccccaggatggagggtctgtgctgtgggcccaagccagggttccttgtctgttgatgagcagtaaggggtgtgttgtacccgtggaagatggactgacttgttccttgtgtcaactgcagcttgttggaggtgtcaatatggcacttagggtctttgctcccttgacattctgagggtagcaagggcagttccactgcagaggcagtggcagagaggatttctgttgctcctggaagctctgtccagggagttgctgagttgctactggcttgaaggctcaagtggggggctggctggagacccaggccaggaagacctgcccatcatggcccacccctctctctgggaactctgtcccaggaaggtttcaaatctccattggccagggaacactggtgggtgtagctggaggcctcaggtgggagatcctgtccagtgacgaggaacaggatcaggggcctgcttacagaagcattctggccatgatttggtaaagcagctgtgctatgccacaggatctcttctgtccctggtgagtttgtactctccaaagcccgcacgctggaatgactaagttgcccaaacaggaaagatggtggcctgcctcatcttttctctcagaatttatcctgtgtgatggagcttaatttttaggttgttaattttactgtcagcgttagagttgttcagaaagaatctcactgttatcttttaggtgagatatataagaattcattttctcctgtaaataaacctgttgatgtttgttctctggaaagaagtccctttcagctatctgactttgatcacaatcatgtagagcagtagtcagtctacaatgacatgattgaatttccatttccagtgtttcctagctgtgtcttacattctccagttcagaactgagcattctcagttgtcaaaatcctaagctgtccactgtacttaaatactggttttcgttaatgcttcttcattcagttgtatagcctttagaagtttttcttttacactttcaatttcctccaaaattttattttcccttagctggttctgatgttttgtttcatctagttccagtcttagcatggcaatttcttcccgcaacatgctgttttcacgcaagagatcttcttctttcttatgactaagagaaagctaagtaaacaaagggaacttttagttagcactcaatagaatgacatatcatgatttcttctaaaatcaaagaatgacatttatatttgtataatgaaataattcccatagtggatatttaactggaaaaaagttggacaaaacttcaaatctaaaagagtgtaaattccaaaaagttgaaatatttatctaaagaccatgaaaaataaatcactagaggatttttaagaatttcagaattgggaaagcctttctctgaattacaaaaaacccagaggcataaaatagaagattaatacatttggctacattttttaaattgggtttacactctgatatctaacctacaaaccacaccatcataagagccttagctatgcatatattaggacagaagcaattcctcaaagttctttaagttcctttttctgaggaatgttttatcaatatactgcttttctaatatttttacagtcagttataagaattacatttattcataactgttaaatctaagcgttgtacccttctacaatgtacacaccggcatctaagcattgcacttctacatacaacactcaactcatttaagatcacgattcttaaaaggagagatcaaaaaatatatgcagccaggaccagtggctcacacctgtaatcccagcacttcaggaggctgaggcaggagaatcatgtgaacctgggaggcagaggttgcagtgaactgagtttgtgccattgcactccagcgtgggtgacagtgcaagactccatctagaatacacacacacacacacacacacacacatatatatatgcaacgtgcaagatttttgccaggtcttctgatgctactgctagtgatcctccacaaaatcagttgcttctgtggtgtaaatatataaatacaaaagaagccttttatttcaaaatacaaatgataaataagatataacttacaaggcttttcttagaaatcatgagattatttgccattgcaataacttttctttcctcttcataatgtttgaaacattatagtagtaagtgtgaaatacgggaaacgtactgaactattcatctgggaacaaaatacttatcaataaattatcactaaatgtgtatcatggcatgtcattgttttcaaagctctttgcattgaaatgagaaactactcggagcaaactgttcctctcctcaaaagcaaggataatgacatccacaatgtggcctctgacccagctgtacatttcctactttcctattagtgaaaataacaaactgacttctctattaatattttaaaaagaactaatgtcccaaaactagcaaatctgttgttagtagcaaaacttatttttgatattggaaagataatcaattcttatgaaaaatatcaaatgcttttcctttggattgaggccattgtgaaggtcactactcgactgttgcaggcaaatgcagttgaattaagaacatggctttatcctatgtgtacatatatagatatatgaccaaggatatacagggggtgtgtgtgtgtgtgtgtatatatacacacacacagacacacacacacgtgtgtatatatatgatttaaaaatcctttataccttccaaaataaagctttttaaaaatatacacacatatgaaaacatttgataatgactaaagaaaataccttagaattcatttccttttcagccacttctatctgcttttgtttattagtcagaatctcatcttgtgatattccagtgttctgttcttcagaaagttgtttctgggtatcattttgttcgtcactagaagaaattttaattttcatgaaatactggaggtgtccctaaaatgatctacaggacaagatggcaccatcagatgtcattcacacaatgtatatctgcacattaatccaagacaaggcaaaggggcctcacatctgttaaccctgctctcccagtcatgttggcaccagggactagttttgtggaagataatttttccatggacctgaggtgggggatggttccaggatgattcaagcacattacatacattgtgcacttcatttctattattactaatatataatgaaataattatataactcaccatcatgtagaatcagtgggagccctcagcttattttcctgcaactagatggtctcatctaggggtgacaggagatggtgacagatcataaagcattagattctcatcaggagtgaacaacctagatcccatgcatgagcagcttgcaatagggttcaagtcacactcttatgagaatctaatgtcaccgctgatctgacaggaggaggagctcaggtggtaatgtgacagagagtggctgtaaacagatgaagcttcacttgctcatctaccactaacttcttgctgtgtggcccaggtcctaacaggccagggactggtactggtctgtggcctggggattggaaacccctgtgttaactcaaactttttatgtttattttttggaaacagtttccacttatattcttgattcctctgtaatttatagacaaattagaaattccctttggaacaagacagggtctaatattgtgtttttaacatagaactttgaattaattttatctgtgtatgagagagagatgtgaaataaactgatcattaatcgctttcaatttcacttttatttcatgcttattaagaagaaaactgggaagccctaggcagagcaattgggcaagagaaataaagggcatccaaattggaaaagagaaagtcaaactctctcttcaccaatgatatgatcttatgcctagaaaaccctacagactcctacaaaacactcctagatttgataaatgaatttagtaaagtctcagaggttacaaaatatacaaataccaatgaatagtaccactatacaccaactacaaccaagctgagagtcatatcaagaatccaatcctttttacaatggctgcaaaatagtaaaatacctaggaatatacttaatgaaggaggtgagtgatctatcaaaggataactggaaaacgccactgaagaaaatcatagatcatacaaataaatgaacatacattctatgttcctggactgaaagcattgatattgtgaaaatgccatagtgcccaaagtagtctacagagtcaatacagtttctaccaaagtaccaatgtcattcttcacagagttattttaaaaagctgtcattcatgtagaaccacaaaagagcctgaatagcaacagacataccaagaaaaaggaacaaacatgttggcatcaaattacctgacttcaactctaaggccacagtaacaaacatcatggtactggtataaaagtagatacacagatcaatggaacagaatagacaactcagaaaaaaggccacttacaaccaaatgatctctgagaaaggatacaaaaacatacactggagaaagtacacattattcaacaaatggtgctgggaaaaaaagatagtcacatatagaagaataaaattggatctctatctctcaccatgtaaaaaattaattcaagatggattaatggcctaaacctaagaccagaagacattagcctaggcaaataatttatgatgaggaccctgaaagcaaaagcaacaaaaataaaaataaataaataaataaataaataaataaataaagacctaattaaactaaaaagcttcagcacagcaaaagaaataatcatcaaagtgagccaaccacctatacaatggggaaaatatgggcaaattatgaatctaacaaaggattaatgtccataacctaccagaagctcaaacaaatcagcaggaaaaatacaaacaattccattaaaaagtgggcacatgacatgaatagacatttttcaaaagaagatgtacaaatggtgaacaagaatataaaaacatgctaaatattactaatcatcagggaaatgtacaataaaacaacagtgagatatcacctcacttcagccagaatggtcactactaaaataaaaaaaacagcagatgttggtgtggatgtggtgaaaaaagaagatttatacactgctggtggggatacaaattagtacaaatctatggaaaacattatggagagttctgttaaagtagatcttaccattctatccagcattctcatttctggatacctacccaaaataaaagaaatcatactctcaaaaagacacctatatacatatgtttactgcagcacaattcacatatgcaaagatatgttatcagccagtgtccatcaactgatgagtggaataaagaaaattatatatatatatatatatatatatatatatatatatatatatatatgtatgtatgtatgtatgtatacctgagactgggtaattcataaaggaaagaggcttaattgattcacagttacacatggctgggaaggcctcaggaaacttacaatcatggcagaaggtaaaggggaagcaggcaacttcttcaaaaggtggcaggagagagagaagtgaaagggaaagagcccattatagaattatctgctcttgtgagaactcactatcaagagaacagcatggaggaaaccgaccccatgatccaatacctcccagctggtctttctctcaacacctgggaattacaatttgacatgagatttgggtggaaacacaaagcgaaactattgggggggggtgtatccttacttttaaaatatcaaaatgtcattatttatatttcaaaaatagcaatttttattagtaatgattttgtttgaaaataaaatgacctggtaaattttcttcaattttagcctagtatttagtcaaaatataaaaagctgaatttgccagcagaaaactgtaattacttttaaatgaggtaaagatgtataagaatatcactgttattgtactgagaagaaagtgaatgagaaaaggaatttaaaaagagagtatcactaccatatacatacatgaactgacaaagagattaaaatctcctactggagattatgttaggacttgagcaaaagcttctaaaaataccaaaaacagaaagaaaataattaattttaaggaataaattatacagagaaatatgtattttaaaaaaggaaaacagatcttcctgagagctattattaaccaattcatcttgaccaaaattttaaaatgaagtctacaattctggaatataaaatactttcattttgaacatagttaattgaaggcaacttttatacagaaaatttttggttaaagttgactctaacttaggaaagaaatgacttgtaccaatggtaacaacaagccacccaaaagccagtttgaaatctagtcaatcaatcaatgaccactgctcttgctcaccaaccaatatcaatgtgagcagcttacttctgaaatacagccacgcagcagcacctgctccaccagaatagacagtgcctgaccagtattcctcttactataggaagcaaaaaattccaactctgtatctttatttcaaataccaaaggttcataatcccttgaaaagaatttgtaagtccattaaatgtgccaccctaatttttttttaaataaaatactagtggccaggcgcagtggctcatgcctgtaatcccagcactttgaaaggccgaagtgggtggatcacctgaggtacagagtttgagaccagcctgaccaacagggtgaaaccccatctctattaaaaatacaaatattagccaggcgtggtggcatgcccccgtaatcccagctccttgggcggctgagggaggagaaatgcatgaaccagaaggcggaggttgcagtgaactgagatcataccactgaactccagcctgggggatacagcaagactccatctcaaaataaaataaaataccagtaaagtttgcaattcctctgactcagtttaccataattacaattatgtttactagtaaaagaataaatagtgaataaccacaatattgggcttttctctctaaataaaaaaataatataaagaatgtagcttattataaagagccaaaacaatttttaaaatgcatgtaattaccgggcaaaactgttagaatgaaccatgtcaaacatttttaaagtgagaattaatcaaacaatatatccaggataaactccattcactcatttaataagtatttattaggtagcttcatccaatatgctaggcctttttctaggcagtgaggatatggtagtgaaaaataaaaaacccattcatgagagtgagaaaaacacacaataacaacagacagataaggcaaaatatacagtatgttagaggagaaaaactaaagcaggaaaatgaaatgtttatgtgtttcatggggagggtggtgggaaagttggggtggtcagaaaagtccctgctgagaaaggggatttttttttctaatacaaaaaaccttttatttgtatatcaaagactctaagaaatgacgacataaggttaacggcattgatgtcaagatacaaatgggtttgaagttagagatgttaaatcactttgtttcactgaaccttcccttcattacgttagagagcatccctggtaggcacccaattgaacctcaagcatgacgcgtctaggtagcacgctgttcttcctcagaaagtggttgttccttaatgtctttctttttaccctttttcctcttcttcttagaaagggggttttaaataaagaactgaaggaatggaaagagaaagctaggaggataactggggaaaaagcattccagacacagggaactgcgaatcacagaggtgtgcctggcatctttaagcactaggggtagataagggacggcaagaattcagtttggctgaagcagagcaagggagataattaggaggaactttgacacatactccgagtgaaatgggagataatcagaagggctggggcagaggaatgacacaatttgacttatgttttaaatacatccactgagttaagaattgatgaaaagggaagtttttaaaaaccaggactatcaattcccagtctatgacactcatctagactgcagatgagggtggctcagatgtacaagatatgactgacttctggacatattcttcaggtagacctgacaagatttactgagagattagatgtgaggtgtcagagagagagagagatgagtcaagaatgacaccgagatatttggcagagcaactggaagagttgcccttaaccaaaaataggaaagactacatgaggtgcagatttcaggaaggacatcagtagcccaattttggatctgacaagtgtgtgatacccaataactaaccaaatagagacgtcaagtaggcaggctgatatagaaatctggaattaaggagaaagatctgagctggagacatacattcagaaatcactagcatatacacagtagaaaaagtcacgaggggccaggtgcagtggcttacacctgtaatcccaacagtttgtgagaccaaggcagacagatcccctgaggtcaggagtttgagaccagggtggccaacatggggaaatgctgtgtctactaaaaatacaaaaatcagctgggcacggtggcatgcacctgtaatgccagctactcaggaggccgaagcaggagaattgcttgaacccaggaggcagaggttgtagtgagccgagatcacaccactgaactccagcctgggagacagagtgaaactctgtctccaaaaaagaaaaagaaaaagtcacaagaaagaagactgaggagtgagccctgggaaacaacaatgtccaaaaggagaaagatgaggaggagcaagcaaaacagaccatgatgaatggactagaaaggcaggaggaaaagcctgagggagtgaggtcctgaaagccagtgaagatgccgttagggaggagatgccctccattggctcaaatattgctgacagattaaataaaatgaggtggaagaaaagtgcctagatttattacagaaaaaaattagtgataatcttgaggaaaaacaatgctggaggactactgaaattgaagacttactggcatgagatcaagagtgaatgaaaagaaaatttgagttcgtgagtgtagacagttcttttaaggacatcatacttaggagtcatggctgagaatgttgtaattttcttccacagtcatggaaaagtaatagacaaatagtttcaaattttacataaaaggtgtagttttcaaattttatataacaattatatattttaaagcttataaaaattatacacatgtggcattaaaaatgccagaccaaggtgttaaatcttaaaactatagaactaaaagttgccttgaccatttctagattacataagccaattatcattttgttcatgcttatacataaagaccaagaaaaactaaaagtttcaaggagagtatttcttgcttgataaaaatcagccaattctaggacagttgatgctcatcgaatatacaaagtaattgatcaccataaaatactgaattctattaacaggaataaagtggcagaaatgcagaaaataatcttattttacaaatgaaatttttaaaattatatgaagtcactgtggaaaaatatggtgaggtgaataccaaaatatatccttttctcaaaggaaagatactgtcacacatgctgggcacttttataaataagtgttactgcattagcagcaccttccttttagcacaagggtcagcaaattagcacctgtgggccaaatccaggccactgactgtttttgtaagtaaagaatcttggaacgcagccatgcttattcactttacagtccatagagtcaattagctgggtgtgatgttgcacacttggggtcccagctaatagagaggctgaggtgggaggaggatcactagagcccagaaagtcaaggctgcagtgagctgtgatcacacaattgcactccagcctgggcaacagagaccctgtctcaaaaaaaataaatatatatagtccacaaagcctaaaatatttactaaatggctctttgcagaaaaagctggccagctcctggtttagcagatgaaagatactttgatatattttaataaaagttttacccaatatactcaaatgtttatattaaatataggtccccatgtacaatcccttggcaatattcagattgaaggtccaatattttggcactcaggcactgacaacaaaaatttaataactaccaatctcgttgctaacaaggtacagtgtcaatgtagcgtgtagcttccatttgcaacacagcagatattacaagaattctaacaaaattatcttaagatgtgttaccaaactaaatgctttaaatacattttaattgtgaaataatcagtatactctagatctaacctcatttgtaaaaaatgtttgcataccgtattattttctgggtatgaaaattgagccatttcctattggtaaggatttacttttgataatgataaattcctattgataaggatccatctttttgatataataacgctgtaagaaatgtccttatacataagtatatatgtgacaaatctatacaaatatccttaacatacatatatatacttactatgttatatatgtgtgtgtgcaaatatgctaataaattaatgttcaaaatatatttaccaacagtgtatgaattgtctttttcaatgagaccgtttcctttgcagcaacacacatggagctggaggccattatcctaagcaaactaatgcaggaacagaaaatcaaatgccacatattcttactcatttgtgggaactaaacaatgaaaactcatggacacaaagaggagaataacagacaccagggtctacttgagggtggagtgtggcaggagggagatgaccaaaaaactacctctcgagtattttgcttattatgtggctgatgaagtaatctgtagtccaaacctccatgacacagtttacctatataataaacctacacatgaacttctgaagctaaaataaaagttcattaaaaagaaaaggaaatgccttttccctcacatttgccaatgccggttatttttcaaataaattaatgactggaaaaaacggtaactcattgtttactgattttcatttttctgattaacaggcaaggctgaatattctagtaaaagtataaaatttgttcatcatgaaagcccaaattaggattagtttgacagcatatagttatctcctataggcttacctgtgatactcttcattctcagtgtcaggaaattgctgattttcaggttttctgctcttcctttgtggaattaatccatcatcaccattgccagcactggcaccattagtcaggttttctggtaatcccacaggattacttccatgcttctttatttcttcttcaaccttgagtggaagtttgatattaaggatggttatcactttattgaataaaaataacctttttaattgattttatcaattgactcagtttgccattattttagtcattaaaaatatttcacacttaaatttgatcatatatacagaactataaccgtataattttaagatgtaattatcatgtcattagtatatcactgaaatttttgtagtttgcttgattccagctgtttgactgaataaaacagaattttccaaaattcaaaaagggccctccttcattttgtgcttttattcccaaaaactcttcagaatcttatatatgaatttaccccatttgactcgtgggaacacaaaaataaaacgacatagacacaaaatgtgtcttctgtctttaccacctagattttacattaaacactcagatgtagaggatgagacactggggggcttcaggaatagaaaggaagatggcccttttctgcactaagatattctcctctcccactgcctttgatcgttcttttttcatttggttcctggatatcaaaaacatgatggtgctcactgaaacatgaaaaccaaagtttgccacaacacaaggagcagagtgaaactgctgaggtgcaagcatggaattccagaaaattagatgctccccaaatttcacattcaatagctatacaattttccagctggaaattacaaagaataagtaattatcttctttagccacattatctagtgataatcagactaaaaccaagaaagataaaaggattggtccaaatctcctaaagaggcattacctagcattttatggcaccattcaggattgttccataataatgaaagaatctctctagggtttgtatctcttgaaaactcaatgtacagaattctttctgagttaaatattaaatttttcactggtgatttatgctacttacatgataggatcatgtatgcgtacacttactacactttgttaaacagcataacataaaaatctaattccacagaaacatttgaacataaaggtatacctctctatcacagtccttatttatttctggttcttgagacattttctgcagatgcaaaaatagaaggttaatttgcttgttgtatttccgtgtatgtctcctcttttggaatgcatgttaaaataattttattcttaagtaatcaagtatggacatgaaaaattagaaaataaaataaaatttaacttaaaataattaaataaataaataattaaaattaagaattaactttttaatctatgtttagctactgccacatcattggcttctgactaacatgggaaaataattcaccttagacaaagggagaataaaaacatgaaccagcaaacttaactttgtcaccatttgtttggactaaacttaatttgttatgtgttaaatctaccaaaaatgaattagcagatgatttgtagtgttccaagggcttcctcacttgaaaagagtatatctcatgaaaccctaactagtgagcccctatagtgcactgaagtgctttttaaaaagattcctaattggattgtaggcacgctttaaattattaggagctgaaatcaacaccaaagaggaagaaatgcaaattcttaaattttaattgaaattatatgctgtaatatgatagtgttatgtatctagatgatctgcttaagtccagttctaatatattctaaggtgtactaattacagtggataaaaattttttaataatctgtactgattttctgcaactgaaataaggtagaaggttattgtgtttgtgcactaacaccaaatgtcccattctgcaagatatgattcttgtaataggcagttgggttgcttttatgacctggttccctccctgaacagaaatgctgaggtcagtgagagaccacaaggcagaatatgtctttaaccttggtatctgtgactgacaatataaaactgcagattttcaatcactggccgtgattattctttaaccatgaatccagctcagggaccttcagtgttacattgttcacagttctattgcttaataatataatccaataattgatggtactttatcatgttagggtgttgtaaaaataaaagaacaaacaaaggtctggaatatgtttttgcctctattccaaaaggaaagattagctataagctaatcaaaaaggcagataagaatattttaaataagaataccataaaataagagtattttaaattttatagtggttacgtttttaagctaaatatcaaatgtcaagttagaatttattaattcttctgttaatgagattgctgaatttattaaaataaattttaagaatctattaaaaaattcttaaaaaaagaatctattgattcttaaaacctagtctgaaaggtaatttcatttggactatctaatattattcaagcaaagaaaacaacattaaatcaaaaatttaaacttaaaattttccatgcctctggctggctattttcactgactttaagcctttgtgactcttcctctgatgtcagctttaagtcttgttctgttgagaaatccatatattcagttaaaatgaaccacttagaacagttaaaaactattgcctttataaaaatagattgaagacaacattttattttatttcataaactgagtgtttagtctttcatgaaatagttacttaggaaataattctccaaaacttcaacaaaccacttggggagacacctgatgtgattcactcacaaattcatccacccaacataaatgaacaaaaccaccagaaacacaactttaaaatacagtagaaacatataaggtaactcagtatgttgttcacttcctaatagtgaagcagtaaatgtaaagaaaaggaaatttagttttaaagagaaacaagttttcctgcacttagctagtctgactctaaggatagtaacaagcaggcccaggaaaggtcatggtgaccctgtctgagaagccagagcccacaggtatgggctccagacatcccagagcaaggttaagaaaacaaattcctttaccatctcccctccccctcagcatttattcatagctatttttacaaatgcatatattttgcaaattcttgttttccctcaatgcagctgcaaggtcgcaagctatgcagtggttgcaaaactgtcactatatgattaactgcctttgttctgcttctataagtttgcctatataagccaagccctgtctttgttcagggctcagctttttgatgcaaatccgctgagctggtgtgcacctaaacaaaatcctcttgtttgacccactgggtctctcctgcctcctgttttctgcaaaaatagtaccttacaaacgatttccaaaattactactgacacctttattagtgtacaatgtcttcttaacatctaaaatgtttccatccactattatgacaaatttattttcatttttcttttttttttgttttagctggggtcttgctctgtcaccaggctggagtgcagtggcacaatctcagctcactgcaacctctgactccctggttcaaatgattctcctgtctcagtctcctgagaagctgtgattacaggcacacaccatcatgcccagctaatttttgtatttttagtagagatggggtttcaccattggccaggatggtcttgatcttttgaccttgtgatccacctgctccagcctcccaaaatgctgcaattacaggtgtgagccaccacacccagccttgttttcatcttttaaaacaatgctatgggaagtcttccttgattctgcagatctttccccagataaacaggtaactccttccttgaggttgccttaggacctcactgatttttctactgcacctttaccacctgaactgtacactattcctccacatgtctgtcccctctgctccaagactgcagaggacagtcttgcacatcatctttgtaaaaacagtctttattttactcagaaatttcttattgagtcctgctacatacatgctaggtgttagggtttaaaaagaatgaaaataaagcctgtcagggatggcttttctagaacacctgcccaagcagagacttaaatattgaggctagctagattaaaagtggtagagggcaagaaagggtgacagcatgccacacagcagcaagagcaggagcgaggcctgaaagagtgaaagtatttgcctgcaatagaaggaggagtgagtagggcattaagagccactcagtaatgccagagaaagggcacacagggaaaagggctaaagatgtagaatagggcagaagtcagattatgaaagccttatgtgtacctttaagatgcttagacattaacgttcaagagtggtccctggtcctatctgtattaagatgtagatcattttaatgccaaaaccaatattcctagtgagccattattcattaagacaaggtgacagctagctcatgtggacacagctgagatgatactatgtagcaaattcccaataattctcatgaacacttggaaagtcaattctataataagtcatagaaattataataaatcacttaatatttgtttgggaaggtgctttataaagttatagtgtatatgaatataactaatagttgtgaattcagagctgtgagaataaagcaaaaaaatcacactgtgtttgagtcagcaatctttagatttctatctagtcttcctacccagtccataaattctaagtataatcctagtactcgctctcaagtttaagttaaatgctagcctatacaaaaaatactctttctcttacttcttttttgttatttatatgttgctttgtttaaaggaagaacacaaaaatgccctgctaaagggattctgtttggctgcaggctgcaagaggggaaaaacacaaagcacattttgcagaaaatgattttttagaagtcagaactatgacatgaagtcaagcagggcactctaggactgactttgctgtgcttccttaatatgctccttgctctctttcttttctggaagctgtgactcacacaggtcatggagaaaatttcgtactccttcctcatgcccagcttaaatactagtgtacaacgtggaaacctgtaaattatctgacatttctctctgtcctccaaacctttctcattcaattatcactaaatcatattgactatacctctcttctgcctctgctttatattaccacttccactgagaacataaacatttacaaaatggcttttattacaaaaaagccttccaactattaatgttatttctcacatgaaaaaaattaagcaaaacaaatgaaaaaagcataacaccaaaaaaaggccaacacattaaaatgagtaatggggattccaaactttatttcaccatgggcaggtgaaaaccttagaatacattgatactagtccaaggatgtgtgacatggaaactatagatgactactgcaaaagcttcctttgtctcctggtttctttacatggttatcttccatcaatcccagcaaactataggccacaggacaaatccaatctgccttttggctttgtaaataaagttttataggagctcagtcatgcctgtttgcttacatataatcatggtggctttcacactacaacaacagacaacagcctggttaagtagatatgacagagaccacatagtctaaaatatttcccacctggtcctttacagaaaaagcttgctaacccattttacaccataagcagaatatgccttaatattcaaatttaatcttgtaactcccctgctcaaatttctccaatgagcccctgcagcacacattgttggctcctatcaatagccattccttattctttcttgcagaagaaacacaagtctattgggatatttattatcccaatccccctcctcagcctcagaaagagaaatgtttattctaagctaatcatgtatttgccatcccattgcctggtttgggaatgagcatgtggtgtgacccagccaatgaaatgttacaggaagccccttgcatgcttctaagttttctccctgtttaaaagacacatgtgaagaaaagcagcccttgaaatgttgtgttgtgagaacaagatgtttggagctgctgcggattagccaaccatgaaaggaaacatgaagaaaacactgccaacagcacagctgaaagagggacaaatgggatcctaggatatcactgaacaaccaaaacaactctggttcctactgttttagccactgctcatctagtatttacagtccaaagcattctacctggtaaatttcccatggcccacagggtaagacctactcatttctatagtattaaaaaagtctatcataaacttgccttagctaagtattcacctcattcccaaactctggtgtctcacacttttggtactagcaaaagtgaactgctcagaaaccctgcaaagttcactcggcatcctgtcttttgcagttgttgctcttcctgccaaacaggcaatctcatcagatgttcttctggcaaacacacaaacttgttgcatgttccttctgccaaaaattattcttctgcttctttacctagaaaaattcttctcactctgcatgcttactttgaatcatacctactttttttcaaaactttcattcctcatcacgtatgtctggcacataattaatacataataaatcataattataagcttccagttggcatctagcacacagtaagcactgaataaagtagtaaaataataaaagtgacaatgataataacaagctcctgtctgtatttttaattgtgtgtgttctgtagcattagaaaaatgattagtatctaaaagacatttgatagttatttgttaagtggacaagtgaaaacatagaaatgttttctttgtaaattctgttgaaaaagcacagaaatgaaatagagacacctctattatgagcaccttaaagatcaaaactacatctattccatctttgtcttctgcaacttataaaacctaacttacagaagctttttgataaatagatggctaaattaaaggtgtcctcatccagtttggattatacaatgtattaggtgtccacaaccaggtggcatactagtatttttgttaatgtgaagcatttttctacttttattataatctgctgagcctagagttgggcaatttgtatatttattatgacaatcttttggtaaatggtagcagagcatcttgttctaacaaaattactgttatcaagacaattgaccagcaggtagagaacacatcttgttccaacaaagtaaatgtatctctttccaacttcaaatgaggaggaatgaagtcagtaagagtgagaccttgttgggacaaggatatgtaacatgacttgtgctttggcgttcttttgtgatcaaaaattccttacttttatttttttatctacggtaggaccacccagagcaggggtccacaactcccaggtcacagactggtaccagtccatggactattatgaaccacaccacacaggaggaggtgagcagcaggcaaaccagggaagcttcacctgtacttacagccacaccccatggctcatattaccgcctgaactctgcctccagtcagatcagtgatagcactagatactcattggagcatgaaccctattgtgaactgctcatctgagggatctaggttgtgtgcttcatatgagaaactaatgcctgatgatctgtcactgtctcactttgcccccagatgagaccatctagttgcagaaaaataagctcagagtttccacggattctacattatggtaagttgtataattatttcattatatattacaatgtaataataatataaagtagcacaataaatgaaacatggctgaataatcctgaaaccatccccaccttcccccagcccatggaaagactgtcttccacaaaaccggtccctgatgccaaaaacattgtggacaactgacctaaagtaattcattatcacaagtcttacctggattgctgttttcagaagagatttttagcatctgtttttctttatagtcagaaagtaattcacaaattctatgtataaaaatgtaataaaccaaattactattttaatactgatataaaaaatacttaccaaatgtaagattcttagagtatttcaaacaatatcataatatcagaatttaacagtattatcccatacacttatgagtacattctacaaacttttctttaagcttctaattaaagaagaaaaaaaattaggtgaaatgctcataaatcaagggcactgtgacccagtaaatcagcaggcattagcatgacataatagaaagtgtcccaactctgcataagtcctagctccataatgaacagctatttgttcttggacaactttcttctcttaggctcaatgtcttcttctacaaagtgaggactttgctgccttatttcactaggttgttataaagatttaacaaggtaacattttttaaatgctcagagaaatagtaaagcaatggaataatctgttcctaaactttatgactaaaattatcttggaatcccaaataaaaccccatgtgtattttgttcataggttctaatatgcaaatgctgtagttttcaggaaatgttattaagtcctaattttgcttcttagttgtcctactccttatggcttatcattcagggcatctcaactgtgtcatagtttgtaactaaattttttcataaatctctcattaaagtagataatgtgattgtccactattacggagttgaccaatttgttgtgctaagggcagaaaaaccaatggatgttaagacctggcttggagcaatgatccttctctacagactcaaactctgagccagcagatgtttgttaggataatgctttatattgatgttcaattccagctgacatgggagaccaaaactctacttttattttttttcagttttcatgaagaagctgcaaattgacattctctaatttttgacgtacatacttataatatattttgcactgaacacattattcagctctaaatcatctcacagaccatcttccatgactatttttgcagcacaaatcacatttcgatattttggtggcacccattttgctttgattcacactgtttccttagagctagccagcaaatagtgaaatgatcttccagtgactgcacaaaatatggaatgcttcaaagagttgtgctgcctccttatgcagaagccgtgctaactttctctgtattgttccaattttaggatatgtgccgccaaagcaggcacaaagccctacttttacacatgatttgtgatgagtcatgggcaaggcttggctcttgtccatgactcatcactacttacttaacccacgtgagattctgagaattctcttcaatggcttcctgtgaggtacaatttgaaaatattttaaaatcttgagctagagatggaagtagcttggacgattttcattatcatgtaaatcagatcactcaaggggccaaccacagctgggagccactgcttggggaaggctcatatgggactttctactgcctaaggttctacacaggatataaaggtgcctcactgtgtagatctggtagcaaagaagaagaaacaaacactgatctctttctgccacattatttgaacccctctgaccctttataacaagcccacctcatatctgctagagaaaagaccaacaacggcctgaaaggatctcttaccatgaaggtctcagctaattcttagctaagatgtgggttccacattaggttctgaatacaggaggaagggtcaatttgctcactttgtgtgcggataaagtcaggatgcccagcggccagagcagggtgctggtgctttgggaacaatggctgagcatataagcataggtaagggaactaaaaaatgttgtaacttcaaagtcactgtgtgaatccccatgaagacttgagggatctgaatcagtaagggcaccttggtgtcaaaggtcaacaattaccaggcagcagaagcagtttgagtggcaacaatgcagcaacagaaacaatggaaacaacagaatgattggaatgtccttttttctctcctccttctgacttgataaaagggactgtcttccttggatttagtgaacccctttggttcttgaaaaattcaaggagtatgtaggagacagtccccagaagacagtacaaggctttctgctaaactggacatttcaagacccaaataactaatcagaaaaatcaaagatgtgatactcttttttatgccatgcataggtgttatacttggatgaaatgaacaatattgggatctctaaggataaaggtcttaaaagtcctgaggtaaagaatcctgcacccattggtacttctaacttgtcttgctttttgtctgatttctggctgatgcaggggactaactcactgccactctaaaactacctgaaccaaactatgacatctcacctgatatgtaagatgcaattgttataattattttaaacctcaatttagcattaactagccttttcatgtaaacacttacacatgatgatgactagaaacagcatactctctggccgtctgtccagatagatcttgagaagatacatcaacattttgctcaagtagaagattgactatacttgctgatccacaacatacagcaagtatgagggcagttctaaaattacagagataatttctcctttagaaactgtaataaagttattttaaaagctaatttgatatactttaccaatttgacatcttgcctgtccatgcagaatcaaacatttacatgcgctaaaagacataagcatcttgggtgctcaagagttcatctttgtaaaataccaccaaggttaaaaggaagggacaaaaaggaaacctcttatctcagtggggtattgcatagcagaagctactaatttaaagtcctttgatgggcaagaaacaatgctagggccacttatctgaagtggacaaagatttaagtgaagattttgtcacagcttccctagactgatatgctgtgatagaaaattagctaggggctaagataaataagagctctctgcatgctgaaagcagtaatattaataataatggtaagaatagtagtcacaggagtttcagttaatgatgccaataagcatgtgctacgcactgaattaaatgccacatgtatctttcttgcttatgcacagccaactttgaaggatatattctcctacttttcacatatgacaacatattgggtggtaaatcacgttcccaatgtcacacacgtagcaagtaagaaagttaggaattaaacccagtcttgtgtgaatccaaagcgtagctcttttctctttgtcacccacctacagcttgccttcattaaaggaaaagtgtatccacttaaaactatcttcactccctctctccataccaactaaaaataaaaacatcaaaatacactggaaataaaaaaggaaaaaagctgttgaacccacagtatgtgggaatagcaattaattgtcatgtagggataagctaacattaatattcttcaaagaaagcaacttaaagcagagtcattgaaaagacaaaaggattttcaactcctatttatgtttaatacagcatatttagtggaaaagcatataagatacagaggttaaaacctactagaaagggttaaaaagttcaatactgagtcataaagtaaactgaaagttaaagttcaaacttcataaaattaatatgaaatccctttagctaacataagatcatgtaaccaaaaacatcatacaacaaataacatcagtcaatataataagagaagatgaatcctactaaaacagttctttatgttgcccagtccaaataattgcttttctacttaactgatttgtgttgatactgatcactatgtcccaataagtataatttgatcttattaatttattatttatgacttgagtgactgctatcaatctagaacaacacacagattaaaagaaataaccataccttccatatctatcaagtgcatttaaattagcttttttcttgattaaaaatttcaccacttgctgtttttgttcatgtacgccaagcaaaagtggtgtgaggccacactgtaaaacaatataaaacaaaaacaatatgtaattcaaaaaattatgtatctctcaactgaactggaagcttatggacttacactcacagaaagtaaataaaatttggtcgcttccttctcactcttctgtactttcccacatgccactccttcccttggaaacatcccttctctgcctcaccacattaaatctgatcatctcaaaaactcactttaaacatttactgtttccaagactctttgtttctaaatgagcatttggcatggcacttttggatgattttttttttcatttaaacaaaaagcttcttgagggcaggggctgtatcttttatctctattattatccaatcctaagacaaaattgttgtgtataaagcaagaatttgaatgtaaaatatttctttagtttcacatgttttaccaaagttcaagctccaacatgcaataaatattgctattaatactcacactgcccatttcaagaattttttccaacatttattcatttaaaatctatttgtatttaatttttccagattgttaactagatagataatcagttcataggattactgaaactaagagatttcctatctgtattcttaataactccatggtttttagtgtttaaacctgccatcctgattaagccaaagctctacaaacttaagagacatactggatagcccacaatatagcttcaattgacaaaaaaggtttagaatttgctacaattctgagaaaactctgctcttaaaaacgacttactgacctaagcacttgaatgattgaacaaagggacacaaagtcctgagagagccatcctctacttattggaagactactcactgcaaatttctaaagaccttctgaatggcagtgaataactgatggtagaaaggaaaaggtattattctgtaagctgatagatagtgccaataatatttattttaatgtcccaacgacagagataagtcagactaggccaggaatggtggctcacacctgtaatcttagcattttgggagcctgaggtgggtgattcacttgagcccaggagttcaagatcagcctgagaaacatggcaaaaacctcatctctactaaaaaaaaaaaaatacaaaaacagattggaggaccaccagagcttagggacgtcaaggctgtggtgatctgtgaccgcaccactgcactccagcctggggaacagagtgagaccccatctcaaaaacaaacaaacaaaaatttagattaatgttattggaaaggaaagatttaaaggaattagcacatatccaactccaactcttctagaaatatctgaagtttctgagatataagaatttacatattacacttctgtattcagtggttaagcaggagtgtatccggattttgagaaatttgttgttgttgttgttagagacagggtctcattatgttgaccaggctagagtagaactcctaagctcaggcaatcctcccacctcagcctccctagcagctgggactacagccatgcaccaccatgcctggcttcaaggaaacatttttaaacatacatatccaggctttattagacttactctatcaaaatcttcaggggaaaacctagacctgaagattatttaaaaattttcctgaggtaactggaatgcacaactctagctggaagctagtgcaatagacaattatttcagtctcatctctcatcacataaacaattccctttatcatttgaggatttggccaaaaagaggaaagagtaggagagagactcatttgctgaaaacaccacaaaattttccctggtaagagtagaacaaggtctagtaaactcaaaatccaacctgatctttttacttataagccccttatctcccaccttcccatcaagacattctagaattgaaagcagagttgagactctaattggccatttctaccagaataggatactaagttggttaattacttgttattccttctactcaagggtttcccactacattaccacatattcactgccaatctggttcctcagaggcctcctaaaattgatctctaggcagtttacaacccactaactccctctcccaaactgaaaactgtcattctctaaaatggaaaagaaccctgtctcaccatataaaggaaacaaatgaatgaacaacaataacaacacacacacacacacacacacacacacacacacaaacaaaaacaaaaacaaaaaaaaaacctcttcatggtcttttcccccattacctaatttccaagttggccttggtatttctgattgctgcatttttccctttccaattctgcctcatgagcaatcagaaatatcttaagccttgccactgagagatacatcacctcatatctattagtgtttttttaggaatttgccaaagtagcaggattactattcactgaaacatgtttaagttttcttggagttttaatgtaaaacctatttccagggcaaattttgtcattttacatttgttagggaaaaaaaaacttggcagggaaaaattgaaaaaaaaaaagtattaccttttacaaattccgtgttttttttttttaaaagcattaaccacaagtgcactgaaaaaaactgtaccctctaatgcttctttaaaagtaacaatatttaaaataaagtcttagataattaagtcatttcaaaatattttcattcaggttatgcttgagcttccaaatacggaaaactggcccttacacaggtcaatgttaacacgaatgcatttcagtattttgaagataaaattggtagatctataccttgttttttgattcaatatcagcaccatataagagcagtgctttggccattaatttatcttcattgtagatagcatagtgtagagcggtatttccatactcatcttgaatatttccatcagcgccatgttccagcaacattaacacacattcatcttcctggcattgtacggcctgtcagtattagaccaaaaacaaattataagtcctaggaattcaaaataacattccacagctttcaccaactagttatatttaaatgagaaaactcatttttatgctatctattgaaatcaaacccatctcacgctgatatagttgactactgcatacctttatcagagctgtcctttttttgttgtcaaggacgttaagttgacatcgtctgtccagcaggagttgtactacttctgaatttccattggcagaggccaaatgtagagcagtcctatgagagtgagaagacttcaggaaattgtagtgcactagctaatgccacattaatgattcatgtagttgcaaacactgaatagcctattactctgccttcaaaacaaactcaattttcctttgaagaaagcacactacttattacctctcattagtcactgtattaatgaaagagcagcctatttgaatagaaagagcatagctcttggatgacattcaacttgggctggaatcctacttgaagctctgtcgcttcctagctgttgcttagcctttttgtgtctcaatttcctcatcaataaaatgggaatgaaaatagtcagtttctcagaggaaaccactgtaatgcttaaataagactctacacaaaatatagaatagttcctaacacaaataacagctcaaaacttgtaagatattataatttttactaataccactaaagacaacatttgaattaagtgaaacgatacaattatacctacactttcaggtacattttaaagattacaggtagcgttgtactgtattttattgagtctaagatgatcattgtctccatgttttaacatttcttacactgaaataccacttattaattcatgatttactataattataattggcagcatttaaataattttcttagtgagacataaaataatggggcatcatacaatccctggtgccttacattaagtagaatatgttataatataacaggtctggggcagttccagtcagatgactagcatttagataaattttagttcttaaaagaactatggaataagagggctgaggtgaaaacaaaaacaattttctaaaataatctatttcttactttggttttcaaaaactttaagccaaagaaatcttgaaattcaaatgaatagcatgggctcatttttttcaatacttagatttatacaacgtatgtacatcagatatttccaatcattcatattaggatttaagactgttataaattttctctttttaaaatggatttatgaaactatttgtggagcttttttcaacttttacattcggggatacaggtgcaggatgtgcaggttggttaacataggtaaacgtgttccaagggggttggctgtacagattatttcattactcaggtgttaagcctagtacccgttagttctatttcctgcttctttccttcctcccaccctccaccctctgataggccccagtgtgtgttgcttccctctaggtgtctgtgtgttctcctcatttagctctcacctataagtgagaccatgcagtatttggttttctcttcctatgttagtttgctaaggataatggccttcaacaccatccatgtccctgcaaaggacaggctcttgttctttcttttatggctacatagtattccatgctgtttatgtaccacatttaagttcttaaaacagctaaaacagtgtttacccaagtcttatacattttcaaaagggcagttaagggttatcttttactattttccaccttcagaagtgcttttgtttgaaaggagggaggaaaagcttcaattgagattaagtcctaatgccccaattttgattctctcagcttgctcaggcgcagcaggtaaacatgaagttttcaaaggtggaaggatcctgagagatagcagaatatgcctgccatataataggtgtctggcttatgtttgatgactaaacggattgaaagaatggataaacataggttggaagttcaatatttttaaaagaaaactcctgttgagtagagcaatacatttgcgatagtaacgatcatttatatttgctattttagttttcataaatatataactaaactaaaataattaatccatactatttacacatcaatctatatataataagatgtatacacaataaaatctaccagaagaggtaaacagaagccctctacttctgaagagggtaaaagttcacagaagatagccatccacaggtataaaaataaataatagaatgtaagaaattatttgtatctatgcaagtagcatattccttctcttcccaaggattatttcattactaatgaaacttaactaaaactttgcagatgttcattgcagaaatcacagataagagaaagggaaaaacttcacttacaaatccccagaaataagtttgattatattttccacatatttccagctaacacaagagcagattctatttgtgtatatgtataacaaactgattttttctcacttgatacagcaaagtacatctctgcatgccgacatatctctgtatctactgacaccctcaatggttacatattattccatcctatggatgcactgaaatttgttcataaaatctttatatgagttcttctcaatacatggctattttaagcaatactaagaaaaacagctgtgtctgtttcatatagatatttcggtataatggaacagatgggtaaaaggcatacacattttaaaaatgtggttcttaccatcaaagtgtctatttgaaaagtcgcagcaacttaaactttcagcaggtatataagtaccactgttcttcaccctcacaaactttgtggacacaaaacagtatttcattcctttatatttatttatttatttttatttatttatttttttgagatggagtctcactccatcacccaggctggagtgtagtggtgcaatctcagctcactgcaacctccatctccctggttcaagcaattctcctgcctcagcctcctgagtagctaggattacaggtgcatgccaccatgcccagctaattctttgtatttttagtagaaatgggtttcaccatgctggccaggctagtatcaaactcctgacctcgtgatccaactgccttggcctcccaaagtgctgggattacaggcatgagccaccatggctggcctttcattcctcttctaacttaaacagaaaatagtctttcattcctcttctaacttaaattccttctcttagcaggaatgctatgttttcctatgtacacaggtcactggtagacatgcaaaaaagtaccttgcccaattttaaattgagcttattttattatatctgcatatatatgccggtttcagtggctcatgactgtaatctcagcactttgggaggctgaggtgggtggatcacaaggacaggagttcaagaccagcctggcaaagatggtgaaatcccgtcttgattaagaacacaaaaaattagccaggcatggtggtgggtgcctgtaatcccagctacttggtaggctgaggcaaagaattacttgaaccaggaaccagaggttgtagtgagctgatattgcaccactgcactccagcctgggctatggagtgagagtctgtctcagaaaaataaataaatatttgcacatataaataggcatttgtgttttcttctggtacttttctccttttgtatctttaaaatttttaatctatactccaggaacttatttttgtgacataaaaatctaggtagttttctccaaacagcatgcatttaatttatgaataattcaccttgttttaccaatatgaaacatcaccattatcaagtgctaaattcttacatatatttgggtatttctggatttcctattctgttctgttcacttatgtcttttcagctgttagtaaacaatttgtggaaataacacacgcacattttgatatctggaaaagcaagtctttttccattctgttacaaaaaatcaatttatcacaatgataaaatacatcatgtgcaatttaaagacactaagactttgctatttttatttggcttatgtaaaagtgataaacacagaaaaagctcacatcttaagaaaaacgaaccttcctattcaaagatatgaaccatacttcccatttcagtttccttttaaggttactcagtaaagaacgtgtttacatagggtacacatcgatataaaatccatattggattttatttgaaaaatatttagcccagaagttgatatattatgggacttagttctcaatatacacctttctatagtgtatagaacattgttttaaaatgtgtacattaaaaataatctgctgcatcgacttaattttgcgagttaaatcactttaaaaccgtctattagtgttctataagggaaattataattggattggaaatcagctaaagttttgtttttgtgttgctgtttataaagggacctgggccctgacatctctgaggtttccacacccagggtggtgtggggcctgcggaggaagagaaagcctggctcctccctccctgcgccaggagggtatgtccccatcatccccccatgtcccgcctcctcccatcccaggcccggttacctcttttgcttgtccctcttgttcatgtcagtgtccctgagcatgacgatgagatcctttctggggactttaccccaccaggcagctctgtggagcttgtccagatcttctcgacggacgtggtacctcggctccatgaaggcgctgtcgtcgtagtctccccaagtgcccacgttgctcttgccgctccccctgcagcaggggaagcagtgacagcaccacttgcccatcttgctcctgagtgtcttcataaaggagttgtcatggtctccagaagtgcccacattgctcgtgccgctccccctgcagcaggggaagcagtggtggcaacacttgcccatcttgctcctgagcgtcttcataaaggagtcgtcgtggtctccagaagtgcccatgttgctcttgccgctccccctgcagcaggggaagcggtggtggcaccacttgcccatcttgctcctgagatcaaatggcttcttcacagcagaggcagcgggcattgaacaaacctcagccaccatctgcttttaacagccaggggaggccggtagtagcgaacagatcgcgtctaccaaccagtttcaccaactagcaggaaaccctgggtttccaatctgtttgaagagaaaggtcaatcccagccaaaacttgccaagcccagcaagggagcccagcccaccccacccagggaaaacccacacccacccggggaaagcccacgcccaccagggggaccccacgcccaccccaggaaaggccaagccccccctcccaaggaaacacccagcccagtcaagggaatgccaaacccagcagagaaaaggtcaagtccagcaaaggaatgcgagggaggaaacgccaatccaagcaagaaacaccaggcaaagctactaacagccaagccaagctaggaacgcaaggccaagcgaggaacgcgaagcgaagtgtacccgttacaggtaagccaagccgttatgcgcgtgcggggcgcgcgtgcggggcgcgcgcctcagacgttatgcggcgtgtgcgtgaggcgtgcgcgtgtcattgcacgtggtccaggaagtggccgatgtgtgcaatccgcgtgcgcaagtcttggcgccacaaatgtcagtgacagccttgcgttactggcaaagttcatgggagttggcccagctttctggccactgaggagagaagcctgtggtgggaaaaagcctcttgaagcaggactggggctagagcgcctggaactcgaggatgctgacagcctcctctgaagaaagcccccaagacactagtggtggcgctgttgcgggtggccgccgctgcagcttagagctctggttggcggagctggatgcaaatggcctcaaaatctccgagcacaagacgcccacggagcccagggcctgcctgaggcgccttccacacctgctcctccttggtccgcacccagaacacagggccatcagcaacggggcactcggggccacagaatcggggctgggctgctagctcctgctgtggtgccccctgcctggtgtccaaaccagggccaacagctgtggggcttctggcccggggtgcttcgcttcactggcatgcagtagggttgaggtgcaggccgctgtctccaggcctgcaagagggggctgggaggagcacctaccactgatggggagatgcaggaaggcacccccacgtgcagatcctgggaacaggacactgccagcaccagggagccagatcggagcctccctggcagcctgtgagctggacccaggcagtggcacctctaccctcctgctgggaccctcctgctgtgcaggcttatgcagccaggctccaggctgcttcacccatactgcaggtgctttggtgtgggaggaaaaatgcattctggccgggcactgtggctcacgcgtgtaatcccagcactttgggaggctgaggcgggcggatcataaggtcaggagataaagaccatcctggctaacacggtgaaacctcatctctactaaaaatacaaaatactagcgggcatggtggtgggcgcctgtagtcccagctactcgggaggcaggagaatggcgtgaacctgggaggcggagcttgcagtgagcccgagatcgcatcactgcaacctgggtgacaaagcaagactctgtcaaaaaaagaaagagagagagagagagacagagacaaagacagagacggagacagagagacagacggagagagagaaaaatggattctaagcctgggacaccgacctgctcttgccaacaaaagcagaggggaagccaattgcaagtgcaaaaaaaaagtttttatttcagtgggatgaatgtctaggtgtgcagtcactggagtaaacgtcactgggacatgctgtgtaattctttgtgtacattgctgagttctactgctaatgttagcccattgcattcatgaaactggtaatttatgacatcccttttttctttatcattattagttaaggtttgtcaattttatagatattttcaaagaaccagctttatttctttgcttttctttgttgttttcttttggctgtttcatttatttctgctcttatccttattatattctttcttatatttgttttgattttattttgctactattttctactttcttgatgtgatagcttgaatttttatttgagagatttctacttttctattatatatatttagtgaaatacattttcctctcagcactgacgtcaactgtgttaaatcaagtttgatatgttgtatttttatttttattcagtttaatatatttaattgtttcccttgagacgttctccttagaagtgtgcttgctgtttagcactattcacaatagcaaagacatggaatcaacctaaatgcccattggtaatagactggatgaagaaaatgcagtacccatacaacatggaatactatgcacccataaaaatgaaggagatcatgtccattgcagggacatggatggaacaggaagccattatcctcaggaaactaatgcagaaacagaaagccaaacatctaatgttctcacttataagtaggagctgaacaatgagaacacatggacacagggaagtaagcaacacacactggggcctgtggatgggggagggagaggaagagcattgggaaaaatctctaatgcatgctgggcttaaaccgaggtgatgggttgataggtagggaaaaccaccatggcacaaatttacctatgtaacaaacctgcacatccttcacacctaccccagaacttaaaataaataaaaatgtaaaaaaaagaactaaaaaagtatgctgtttatttttcaagtatttaagattctgctgttattttacttttatatttttaatttgatgccattttggctggaggatacattctacaggatttcagtttttaaaaaattcttaatgtttgttaaaatccaggatacagtccattttggtttatgttctgtgggtacctaaatgttctgctgtattctgctgctagggggtggagcctgtttttttcttcttttttttatctccaggtacaatttgccctatgagacacctgatatagtaagtagcccatcaggtatccagcagtaaaaactaaattagtggaaggaagtcctgtcccaactggtttgacatattgtggctgaatttttaggttttagtgaaaataataatgatggcttgatcttcaaagttgtttttttttttttttaccatttcccaaatagctggggattattgtggtgtaaccacttaaaactctgatgaaatgtggaaagaatttctttttctaattgatactttgtgagtgcaactactttgcattgtgcagagagaaaaaaatatattccaggcattcgccaaatcaaaagtgcatgaacaagtccctaaatttcttcctgtcctcagatttccaccataaagtttcagaccaaataaaaaattgttttttcactaattttctttgaggaaatgtaagagaaaaaaaagaaagaaacaagtgttttgaagggtagaattttggcaattatatgagattgtaaaatccgaatgtggattagcttcaactcatcaaagattcaagaacagctacagttctaagaatgagccaaaaaaaaatgggtatgcattgaggggagggaattaggaagggaatttatagccattcagacatttcccaacattaagccttcatgaattttgcattggaaagaaatatttataaattaagaaactcagtatccagtccaccctgtgataaatactgcaatgtgcccaagcattccaatttgagtatggctttgtgctttgccaatcataacaatgggagatagaagtaataagagcctgcatgaagcactgtgctaatgataattttcccagtaagaacaaaagagaggccattacttttaaacatcattgaatataatcaaacactgggtaggcttgtctgtatttagattttataactctacggttatagctataaagtaaaaaagacatattataaaatttctgtcattaagaaaagtatttattattacaaatgtgaatttctctagacggtaaattctttggaattagttgacttcatgtaagttgatttgttcagtaacacagagtagacttcttgtaaataggaacaagtgtgcatctgatcaagatccactattttcttatatgtatatcccttttctgccttccctcagaatactatctttcacaaaacaacacacatctcttccaccaacttctccccagaatattgcatattcgatcagtgtccacaaatgttagatacagaatgttaaattactattaggttcgcacaaatgtagttgtgattaatggcaaaaatcgcaattatttttgcaccaacctaatagtaacattgaaacacaatattagttattcaacatcagaaagatcttccagaacagtcatcaccacagatgggccaaactattatttgtagggcactgcagtaagttagaattttatcaaattcataaattaatggatattttgttaagggatatgaacagcctgtagtataaatttgagctatacattgttgggagaacaaaataataaaacgatataatagtagcaatcaagtggtgacctttctgtcacacttacaattttcaatgcacttgtctacttattatttcatgtgtggatgggttagctgagtggcggggccatcagatgtcatatatacagatgactcccttctgtacaccattctgccattagttgatgtatattttacttttgcttttcccttcccatttcactactagataaaaatcctaatcttgagttctaaatcacacctagttttactcatgtgtagttgtacctgacaaagaattacactacataaattccatccattagaggtgtggccgaatggacagaaaaccattaacattgattacttcagtgcatgtgggattgcaaatgcagatgagaaggagaagatttttattttttctttatataagtttacattatgtattctaatgcaaggctcaagtatcatttatagtgaaacattaaaatgttcttaaaagttcatgtccttaatgttctgtaaaggaagcataaactcatttattgcaacaaatgcaacaatttatttcattcctcagattattgatcctgatataaataaaactgttcagaacttgcacagagatatttaaacgaacaaagaaacaaaaaatctagggaagaagtgaagaaaagaatgctttttaaattacttaatcattgttgatggactgacaacatccaacttacatctcctgaattaaacctgatattttcttggagagtagtgaggagtagttgagggtagataggaaagagagtgtattttgagaaatgtaaaatttagagaagcttaatttaaacactccctgtgtgtcaaagagctattaaataaaattttcatgattttaatataagtgaatctgaactagcatatggtctaagtttcttttaagttgcacatggatttaaaatataggggaaaaagatcacttggcaaatatgtttttggttttgaaaaacttccaaatgtttaaaaagtacttttcaaatcaaccatacccatatgcatccaggttttctcatcctcaccagtgaaggataaaaagaaatagaattaaggcaaaatggatggagaggtgatacatatgctgtaaaactatgtcagaaatatcagttgattctttagggaattggttaaaaaaataaatttagtccttatgacaatttaacccaaagaatctaacacttattcttagtggcttaggatcatggatgatattaatctgtcacaagatgattctatgactatttccagaagtggaaaagtgcagaaatagaaaatgcatatgatattgctattttattttgttccaagtcttgttactattggtggaaaacagttttccaaaggaatgaacatttagataaattatggcatgaagaatcattttcaatcctttatgcatagatgcattgataataactgaacatctttggcatctggcttccagatacagtgacgattccttcaagacatctagaaattaaatagatgtgcgtgaacactttaaaaaatgtaaatacattaaatgtcagttattttgaaataagttatttttttaaacaggaagcatttttaattaaaaattagaaaatagctatatttggacaattagttactcaatgttttttccaaataacagatgaaatatactttgatgttttttgttttaaataaatgcaaatatatggatgcaaaacaaatcaaacattgctacaaatgaaatatatgtgctgtcagtaattctcaaacattgaataatattcagtgaacttcaacacatacctttggtggcccgttaaaattcattataatgaattttgaattagattccaaaatgaacacactattttcttagcttttagcgtctgtcgtttttttctatattcatttttcttttttttttttgactgaggtggcgtctcactctgtcacccaggctggagtgcagtagcgcaatctcggcttactgcaagcaccgcctcccaggttcaagagattctcttacctgagcttctcaagtagctggttacaggtgcgtgccaccacacccagctaatttttgtattgttggtagagatgaggtttcaccatgttggccaggctggtctcgaactcccgacctcaggcgatccacccaccttggcctcccagagtgctgggattacaggcgtgagccactgcacctggctggttttttttttctattttcattactaagactaaacaatagttatgtgactgaatacagctgatcattttaccaactcctttcagcaaattcattttgtcattttaattaagttcaaatttaagaagtgaataaatatagatactatagcacatatatttcccaaaacataatataatatgtgtgtgtgtgtgtgtgtgtgtgtgtgtgtgtgtgtgtgtgtgtgtgtgcatttgggaaataaaagagtattatattttactcaaacaacatcaaacatgcagtcaagtaagtttgatgaagaagataatattttagcctaagaatgagaattctgtaagacaatgtgttactttatagtatcagttatgtgacccttccacactgatattttgggtgcaattgcaccctctttgccatatactcttgggagaatagaaggttcttcacatttttccattcattgtaacttctcctgtaggacagcccacagatacatttcctagactatattaaggaaacaaaagcaaacaaatatgagaaaataataaaggtaagtgtctgggagggtgagaaatcaaattcagtggggtttaaactatatctcatacaagtgtcccaaagttgtgcttttggagaaattcaccttggatagagacatggtcaagtgaccatgtctctttacctttaccttttttaaaaaacaatacatagctgtatccttggaagagaggcaaggagtgctgtagggtgactatctttgatttctgttgtggttcagaggaagtgtaactttcttaaaagataccttgacttttgtcacatttagctattcgttcctttttatttaggaaaaaaaggctgagcctgctgtggcttgggctcttattatcttttcttgggcttcttggatctcataaatgataactctacttttattgttgccttctccaaaggaacctgaataccagcatcaccttcatttaccctaaagcatgattctctgcctaagaaaacccctatggttgacatttacatttactttatacctctcttaatcttttgaggaatgcctctctacctattctgcatggtaaagttctaattaattacaactatgaaacagatatttccttcttttcttatgtttcagatattgaattactttattattgccaagcacaatctgctttgctaaattattcagtataagcttgcttcttccattagactttggaattcctgagataagaaattacgctttattctgaaagtgtgcttaaatcaatggaaagttggtttgtccaaactggatatagaggaatagagttattctgtacacagccacttttagttgcaagagcagctagaaataggagttatgctaccttttcaaagacatgtcctcagccaggtgcagtggctagtgcctgtaatcccagcaatttgggaggctgaggcgggtgaatcatgaggtcaggagatcgagaccatcctggctaacacggtgaaacccaactctactaaaaataaaaataaaaataaaaataaaataaaataaaataaaataaattagctgggcatggtggtgagtgcctgtagtcccagctactggggaggctgagggggagaatggcttgaactcagcaggcggagcttgcagtgagccgagatcgcaccactgcactccagcctgggtgacagagcaagactctttctcaaaaataaataaataaataaataaacaaaataaaggtaggctatactaagttaaagatgctggctgtaaccctagagccatcacaaaataaaataaggtaaaatacagatacagtaaataagccactagtgaagacaaaatagatacaatgaaattagaaaaaaattaaaatcctttaaaaagccccatttgcctcgattttcctaattacacaaaggaggcaaagtgtgaaaaaggatagatcacgttcctctaaggacccatgtcaggtatctgtggaatgcaggcggtgcaggagggtgggaatgggtgggtgcccagcgttgctaaagctatggagtgtcttcccatttttaaagaaatccagaagtgcagatctattcattcaaccattcattgatgtaaaatctggtttctaaggtgttcagtttgatgactaatatatgtatattttgccatcaaaatcaaactcattcacattcccatcatctcgcagagctgccctctttcatgtgtgtggtgagaacaataagatctacctcctcagcaaatgtcaagtatacatcgcagtgttgttagctatattcacaatgttgaacagtagatctccagaacttattcatcttgcataactgaaattttataccctttgaccaacatctgcccatctctccttcccccagcccctggcaaccactctatacccagcaatcccatttctttggggatatagccaaaggaaataaaatcaatatctggaaaagatacctgcactgttatgtccatttgggcatttttaacaatagccaagtaatagaaacaacctaaatgtctgtcaatggataaatggataaagaaatgaaaaaaaatacacacacacacacacacacacacacacagtgggatattatttagcattaatgaataaaaaaaatcctgccatttttgacagcatggatggacttggagaacatgcttggtgaaataagccaagcacagaaagacgaataacacattgtctcacttataggatgacactgcattcacgtttcagccacctctgccacacccacccatgcaaacacacccacccatctcagttcctgcccctgactgggggacagggtgggcgctctctggcacatgttccactcatgcttctccacctccagctattttaggctctgacactgaaaatgaaattcttaccaagacgatatgtgttgtgttgacataaaactgatagaaagtgtaccaaaaaacatggaagttttaaacataatccaccaaaagaacatactcacagtcgacgtttctttcattattaagaatgaatgtccataaccctcactaagacaaaagtcatcccatttgtctacatcttttttctttgcaaacacacactgaatgactttgtgtgacaagctgtgaagttttaccaattcttcaaactctttgatttgcattatgctgtttaatcctgagaggcgagcagctgtcgctggtaattctaagcctagaattccaccacctaataggtgaaaattatagtaggctgatcataaaaccatgttgttaactttttaaaatttaatgactaccaaggaatttcaccttaatgatacatcttttgagagattagaaaatgaagaaatgcacgtgttcaatgatccattttagaatttaaaaagtctttcaaatgagcatcttattcatatattgtgaagaaccactggaaacagttatttaataatgtggctaaacgcgtattcagagtaatgcttcctgtatatttgcacatttatacacttatgtcctgctcctggaatagacttaccagtttccttttcagaaaatttcagaatttctggaatgtgccgaagtactagtgggtaacttagatttggaatacactgtattaggtgtaactggaaaactgagaggcttcctacactggaaggtcaaagatctttcctggaggagagttaagaatttgccttttcttaccatgactctgttaaaagagaatataaacaatgcagtttcacaaaaggaaggggacagtggtgtaaataaacctccccatcatgttctggtggctttcctgtaagtcttgaacgttttccactgggtgttacagtcgagaggcccccacctcctgaggaagcaagaccccgaaaccccgagacgatgggctgtgctgctttggccccatcttgcttgtgttgtttgaagaggccctgctgccacccagctgtcattaacgccaccctcacctcccaggaactgcatcactcggacggacaagacacctatgtaatgaccatagtaagaccccatgtgcgtggctaatgaggcagtgcccaacgtggcgtggaagccctgctagggaaatcccgcccccccaccccagatgcgccaccccagacctgctctcggacctgcggcccctggcccctggccctttcccgttgtcaccgaggcttcttgctaagaaatggaacttcagaaaacccccaaatatatactgcattaggtaagggtttcattctaatggagtcccatgtgaccctggctttccgtccggcagcaatgcactcctgtctatgaatgagatgaaaagagtgcccacaacaagccaatttctttcaggagcgactaagacatgcgcatgtccgggggtgcctcagagcacccgggagggacccaggcctgggcagggagggggggccggccctaggggagcaaagctcttgaaactggcctctgttgccgggctcctgaccctgccctcccatccctgcactacaagaggacagcggcgactacaggaggcgccgaagacgctgctgaaggccctaaagaaacttcagcagaaccggaactccccttgcaggtccagccgcgggccctgcgccctcccgctcagccgagcggggccgagggcgcgtttgctgagtgtctggtggcctctacccaagcgcctcttcagagggctgttcctgcggcccagagactgcttgaggcgctcggggaaggaaaagcaggcgctggtgcgccgggggctctgctggggacggcgcggagctgactgaagggccgctgcggtagcgcagggcgcaggagctgctccgccccggagcgccgggaaggttggcgctggcagcctccagcccctgccagccgggcgagagcaggcggagaaggaggatgcaccgtcacctatggctcgcctccaccggccggcacgcaaggtgagctctgcgtgcgcccggcgggacagtgaggtaaaagggcgggagcgcgggagaggactcgtggccccggctcagcccgcacccctctcctctgggatcccgaatcgcgggctgcgtggtgggccaggagaggtgcagagcaggcggggcgccgcggccagtccggagcgcaaactttccctggcgactgcagcgctgaatctgggcgcaggagagcgcggggtccgggctgctcagccctgcccggcggggtacctgggcacagcgcacatgggtcagccggtaggaactgcgggatgggggacacccagcgccaccgtcgggagccgtaggagcgagatggaccacctggaaggcccgggtcagcccttgggctctgaggcacgcggcgtcccggcgctggtggcagggtggactcggatcccgcgagggtgtcgcgctagtcgcgggggctgcttgaggccgggggacttcgagctgccgctgcaccactcgctcccagcccaggaggaaggcgccggctggcgttgcgctctgctcggactcagggcaggagccggggaggtctgcaaaagccgggagcgagccggggagggcccgcgaactggagaggctcggcgcgccgctgcggacgcggcggatggccgaccacgggtgccaggggaggcccaggctgcggcgccgcagggcagcccccgcgcccacctgcccctgcgcgccggccctggcgagcctctgtggaggtcaggggaccgtagcctctcctggggttcctgcctagcgactgaggggcggcaggaggcgcagctccggtttcccgcatgcagcgccgcgtgctcgccgcctggttttgtccgggtcaggcagaccagccccaggacgcgcccagccgacccacgcatggcaacctgcccttcttggcaggagtcgcagagggctttggcttctgaggtggaagtacctgttatgtctcctaattccggagtttgcgggggtttgggctggcggggggctcattgggaaaatgcttttcaaagcattctgtttggctgccgtgagcacctatttgccttatgtgcatattgagaaatgtgtgcttctactaaggttagtcgctgagcccagggacagtgtaggcctggatttcaaatgcattaattagggtccagcacccagcctagagacttccacaaatgcagtagttatttagtcacggggactgaatgcggagaaagtagccacaccgttataggcaattgttatacccttgtgatcctgcagaaaacctgtttcttaaatgtgcttcccccctctttctttctatgtactttcagtgccttgcagaactaggagtagcgtgctgactttgaacacgtggtagatatttcagaaaggtaaaattgttaggcttgtggatttgacagatacaaaatacagttgctcagacaactaaagcatttattttaataattggactaatgtttcatttgataacatactaaaaaataaaacaggttgggcgcagtgctcacgcctgtaatcccagcactttgggaggccaaggcggcggattacgagatcaagagatcgagaccatcctggccaacatgttgaaaccccatctctactaaaaatgccaaaattagctggacgtgctggcgtgcgcctgtagtcccagctactcgggaggctgaggcagaattgcttgaacctgggaggcggaggctgcagtgagctgagattgcaccattgcactccagcctggcaacagaacgagactccatctcaaaaataaaataaaataaaataaaataaaataaaataaaataaaataaaataaaataaaataaagcagagtatttgagacatagaaaacaataaattacgatgactctgcactctgagtagaagtaaaaataagccaacttgttaatctttttatgtttcaacttactgcccggtgggcgtggtggaaaattccttgcgtgcagctgtgccagggaaggacagccagcttcctttctctaggttacagcagggaaggacagccggctcctttctccaggtcacaggatctgctctgcttggatttgatacggtggttagtgcagcccatagtccagttgctgcagcaaaagttgcttgagtctttgataggagaggacacttgaaagcaggaaatgagaaacacattttgatctttatgtaggagctcattgttcctgactctctcctgggataaaggacagggaagagtggacttttttgcacttctagttccttctccctgtagctgtagtcgtagcaagtaaaggggttgtactgatgctttttaaggcatattatcaacatacagccatgacttgtccagagaatctcacctgacaaaaactcagagaagaaagagaaagaagatgaaatggctggttttcaggtaaatgtgtcccagttcaagggctgtgacatggatagactgcatggtggtgaagtcagggcttttagggtatccatcatcagaataacatacatgtctctgaattttgatattagccatcctaacaagtgtgaaatgatatgtcatcattgtttgtatttgcttcatgattgaagatgttgagcagcttttcaaatactcttagtttacgtcttcactaaaaaaatatttctttacctgtcttttaatcatgttatcattactgtcattattattgttgttttggttttttatttgtatgagttccttacatattttggatattaaccacttaacagtggtttgcaaatattttctcccaacctgtaagttttcttattgttttctgtttataagttttttagtttgatgtagtccaacttttttatatttgcctttgtggcgcactttttgtgtcagatccaaaaaaatactgtcaagaccaatataaaggaggttgaccacattttgttttcttttaggatttttaagaattcatgtgttttatttgtccttactttgagttaattttgggatatgatgtaagaaaaatcatctaattttattcttttgcttgtggatacccaattttcttagctccaaataataaagggatttcacttactgcattgtgcattttcaatatccttgttcaagattaattgattttataggcataggttttttttttctaggctctctactttgttctgtaggttttcgtgttcatttttatgcacatgctgtcttttttttattactatagtattgaatataatttaaaatcagaaactataggggcgggtgcggtggctcacacacctgtaatcccagtactttgggaggccgaggtgggtggatcatgaggtcaggagttcgagaccagcctgaccaacatggtgaaatctcgtctctactaaaaatataaaaattagccgggcatggtggcgagcacctgtaatcccagctactcaggagactgatgtaggagaatcacttgaacctgggaggcagaggttgcagtgagctgagatcgtaccattgcactccaacctgggtgacagagtgagactccatctcaaaaaaaaaaaaaagatcagaaactataatatccttagctttcttcttcctcaagattgctttagctattcaaagtctgttgtaatttcacataaattttaagcttgtattttctattactgtgaaacaagttattggaatttttatagggagtttattaaatctatagatcattttggataatgtagaattttaacaatatttactcctccaatctatgatagctttacattttttgtcttctccagtttcctttatcaatattttatttttcagcataaagatctttcaccttagttgttaaatttgttcctaagaaatttattgttttttattttattttaaatgaaatcattttcttccttttaattggatagtttgttgttagggtataaaaacacaattgagatttgtatgctgtttttatattctgaaaattcattgagtgcatttattagtttaaataggtttttggtgtactatttatggtttttgtatataagatcatgtcatctacaaaaagtgacattttttcaatttagatggctttaaaatatttttccccaaattgttctacttaggactactagtatgttaaaatagaagcattaaaattgggcacaaggtggcttcattgtgactcctcttatttcgagcagactcaactgctttcagaactttgatctgtagggcagatgccagggccagggttctgaagctgggtttgcatatggcggccctgatagtaggtgtgtggatgaagtgtgacttctgctgagtacctgagagggttttctctccctttgtgggtctctaggtgggcagaactgtctataaactatggtgaagagggctgaaactgagtcacagacctgcttcagaggccacagtaaaggtgaaaggttaaattctgtaggtctgcctccattatcatgaatgtctctccccagttctctgtatgggaaggactaattccagaccataactgggaggcattggagatggttacagagtcacttcaggattctcagtgtgactgagtaggatgggtcaattcctagtctgtagacaagatcaggggttctcagatttgccccctgaatgagggcctgccttcccaaaacagccctcctcagtctttgtttttcacagggtatcataatgccctctctaatcccaaagctcccataaaggcacttttgtccatggatggctgcaaaagtattgtagctgtgggaagataaacaagagtgatccccttattccaacatccttgctgatgtcactctccttatatggtttcactttgtattttgctgtattacaaatttgtctgttattttagattcattcagaacaatatgctataatttccacaccatgtaagaagtaaatcagacaggcactccctatttattaaaatgttcatttgtacattacagttaactgaaatcatataggaatcattaacatttttgttttctcaacctatatctaaatgataaattacaaaaaattatttcaaaatatttgcattgtatataactcatattttacaacatacatggttttactttatttcaaagtctaatgcttttctttgcttctaaagagtgaattgcagcctttttattttctgtgaaaatagcatcaatatattaatagtaacacattatctttactgtctttacataatcattaaaaaaattttactagagcattttcttaatgtctgtaatgcattttctgtaaaattttactgccatacagtagacatcaatgattacaagtatgtgtgctccataggtgcacaatcacaggtgaactcggtagttacctagaaaaaggtgttataatgatatatcaatgttgcatacagaattttataggtaaatgtttatcttgtcttgcaattcctaattactgtgtttttagtaaggatacatttataggcagtttattgtgtttctgttttacctatgtattataattttgaatgacaatttgcaactctgtatatatactttaaatcaaggtggggtttaattcaaagatgaattaaccagctgtctatcactgttaaattatacatatgtatgggcatggttgtctctataaatataacaccaactttgtttatggttcatcttgtgtatttctcctcttggctgattttttttttttttttccgacggagtctggctctgttgtcaggctggagtgcagtggtatgatctcggctcactgcaacctctgcctcccaggttcaagcgattctcctgccatagcctcccaagtagctgggatttcaggcgtgcaccaccatgcccagctaatttttaaatttttagtagacagggtttcaccatgttggccaggcctgggtcttgaactcctgacctcaggtgattggcctgcctcagcctcccaaagtgctgggattacaggcgtgagccaccgcgcccagcccgtcaaatatagtattattttttgtttctagatatcccatatcagtgtattcagacaacctgtcttgttgtgactgcctttatttagcatgttaagattttgattttatatgttacatatgctgattttgcaaagctgagcaatattctatttttatattccaaattttatttattcatttaagaaagtttaagctgctttagcctatcagcttttgtcaataatgctgcatgggtgtgcaaacaactcatttgaccacacatgtgtagctgtatttctaagttttctattgttttattgttcttgttgtgtgcatttatgccagcaccaaattcctttagctactgtagcttcacaatgtattccaaaatcaggaggtgtgacacccccgatattgttcttgatatttcaagattgttgagtcttcttggtctctttgtagtctgtataattctggggttgcttttttatttctgcaaaaataaactgagaatttggaaaggactgtattgaatctgtagaccactttatgtagtctggacatcttcataatattaagtattcccacccttgaagaaaagcatgttcgagggtgtattgtttaactcccatatatttgtgaatgtttcattttctattttattcaattttggttataaagaataagcagtaatatttcattttaaaaaaaggtgttaagacttgtttcatggcctaacgtcttctatcaagaatattttctgaaatattgaaaacattgtgtattttgttggatgaggtgttctctacacatgttgaatttgatttttatagtgtattcaagtcttctgttcactgtgtatttcttgcttcaatgtcatcaatgtttgctttataaactggaaaccctgatgtatgatatagatgtataattggaaaccctgatgtgtgatgtagatgtagatacaggtataagcacacacacaggaatccacacacaaacaacatatacaatttttataggtttccaatgaatgaacctttgtattatttaatgtcttttttatgctgtagttttgaattaaattttataaaatatgataatgattgacttaaagtcttttgtcacagtgactacttctgctctcatttggctaacatttgcatggaatatctttttccatcctgcttttagtctatctttgtgattggatccagtgattctcttgtacacagaatatagttgatgctgttgatacaatttttagaatctcttcatgaaatatgtcttttgattgggaaagttagtccattaatatttttaaagtattctgaaatggaacttactattattatattaatcattgttttattattgtagccattttgttcctttttcatctttcttgctgtctcactgatttctctggtgatatggtctgatttctttctcaatttctatattgtatttctctaatatttgtggttatcatgaagattacaaaaatcttcttaaaattacaatatattttgaattggtaagatattcagatgcatagtttttttcagtatgtctgctctcaactttgtaagtcacaaattatattgtcatattgtgtttataactactttcatgtttttgtctatcaaattttgaaaatagaattgttttctgtattataattttaatacaatttcctgttatgtgcatgtctttattagagagttatgtgttttttatataatgtaggttttttctagaattttattttcagtggaagagacacccctaagcattttcagtaaggcagatatactagtgatgtacttttactgcattttgttactttggaactttttttgaagacttttcctatagtattcttgctttgaaagtttttgtttcagcactttgactatatcacttaactttttttctggcctgcaaggactgtgttgataaatccactgcaaatctcaatgaagcatgctatagatgacacaacaggtttatcttactgcttgcttccaagattccttttgcctacgacttttaaaattttgcttataatctgtcttgttatgagtaactgtgtttatcttagccaaactaatttaagcttcttgatattttacaagtattttgtttgagaatttctgtctttatgacttactgtagtcttcagctccataatttttgaaggtttttataattttttgtgatattctcattttgctgctttcatttagttgtctatgttcccatttcatacactgagcatcatttagatggttattttgaatattttcaagtaatttgtatatctcaattttttagggttcatatctggaaatttattgtgtttttttggccatgttactctggtactctgttgtcatctttcattgtgatttgagcattaacagaaagctgtcacagtctttataaagtggtttggagtctgacaccaattgaccaggctagagattctggaggtttctaaagcctgttctcaggctgtgtctactctgggattgtgtgtttattttctttcttcagaaagaagtcagaagtttacttctataagcatcatgctgcattggagaggaagaagggctgtggtgggtaaatgcaacaaattttccttcctctactatttggcttttggcattctgcttgcctggggtgctgcaaactcttgatttttaaacttatcacaatggaattttgttcaggatatttttgttaagtgtatatgtatatgaagaaattagggcctatgatttttattgtgccactttgctaatgtgcttgacataactttatacattaggtttctaacacgtactcacctgaatctaataagtgaggtaatttattttcccttttcccagatgtgtattctcattttatggaagacatgttgccagagtaaagcacaatatattcatcttgaaatgtaatactgagaagatatggaagttatggaagttgtggccttcagaattgacacttacggagagactagaacagcgtgggtgagttgtgaggggcaggaagcatgtcttaatggacttaaccaattttcgtcaactattcacagtaaaatctttcaatgtacaaaatttagtaatctgataaacaataaacaaaatatttgaataggcatttttcataagacgtacaaagggcagacaggcatacgaaaaggtgctcaacatttttgatcatcagacaaatgcaaatcaaaactacaatgagatattatgtgactcagttaaatggcttatatccaaaaggtaggcagtaacaaatgctggagagaagtggagaaagggagcccttgtatgctgttgacaggaatgtaacattttgaaaattcttcaaaacaactaaaaataaagctaccatataattcaggaatgccactcctgaggattcacttactagaaaggaaatccatacattgaagagatatctaccctcccatgtttgttacagcagtgtgctccagccaatatttggaagtaacctgatgtccatcaagaaatgactggataaagaaaacatggcacatatacacaatggaatactatttagccataaaaaataagatcctattatttgcaacaacattgatggaaccatagattaagtgaaataagccaggcacagaaaaacaaactttccatgttctcacttatttgtcggagctaaaaatcaaaacaatataactcatgtaggtagaggtagttgccagaggctgggaagggcagtggggaatgtaggggacggtagggatggttaatgagtacaaaaaaaaagaaagaattagtaagacctagtgtttgatagtacatctgggtgactatagtcaataataattttaattgtacattttataataacgaaaaaagtaaaattagattggttgtaacacaaagaataaatgcctgaggggatgatggataccccattttccatgatgtgattattgctttctatgcctgtattaaagtatctcatatatcacatcaatatatctccaactaagtacccacaaaaataaaaaatttaaaccaattcaaaatgccagaatttctatacattaactataaactacctgaaaaagtcaagtaaacaattttatttataataactacaaaaagtttactcataaatgtaaccaaaatggtgaaagatttctatattaaaattaaaaaacactgagtagaaaaactttctaaatcacaaataaatggaaagatatttctggttcattgattggcagaattaatactgttaaaatgtctacactgagcaaaacaatctacagattcaaagcagtctcttatctgtatacaaatgaaattatttagaatatttcaaaaattctaaagttcatatggcatcacaaaaacactaaacagcaacagaaattaagcacaaataatacagctggaagcattacactacctttgaaatacactacaaagctttaggaattgatatagtatgataactggtttaaaaagagaaacataggtgaataaagcagaatgcagagcccagaaacaaattcataaaatttcaggatcttacacaaaggtgacaagaacacacagtggggaaaggacagttacttcaaaagtggtgttatgaaaactgagtatctccaggcagaacaatgaaatgagaccctccaccaacataaatcaaagactcaaaactctggaactgctacaaaaaacagagtgaaagctccatgacattggtggggacaataattttttcttatttatttcacctcaaaatcccagcaaacaaaagtggaagtagacaaatgagattacttgaaaactgaaaagcttctacacagcactaggtacaaccaacagaagaaaaataacgtataaataagagaaaatatttatgagttatatatctgacaaagggttactatccaaaatagacaggaaactcaaacaactatagaacaataaacaagtaactattaaaatgggtgaaagatgtaaataaacatttcttaaaggaagacatacaaatggtaaaaaatatatgaaaaaaatgcgaggtaaattatcataaggctaatctaaggttaaggctaatctaaggttaggactaatctaaacctctattagataacaactcactactgttagaatgactattaataaaaagccaaaaaaataattattggcaaagatgtggagcaaagggaatgcttgcgcactgaatgtaaatcagcgtagccattatacaaaacagtatggagatttctcaaacattaaaagctgaactatcatatgatacagcaatatcattattgggcacatatcaaaaaaatcaagtatgtgaaagagacatctgtgctgttatgtttattgcagcactattcacaatagccaagatataaaatcaaactcagggtttattatcaaataaaatgataaagaacatgtggcatacatccattctgtacgaatggattattattcagccttaaaatagaaaatactgtcattttcaattacatggatgaacatgaaggagattatgttaattgaaataatccagacacagaaagacaaatacctcatgattttgctcatatgtggaattttaaaaaattgatcgcattgaagtagagactaaaatagtggaacgagaggctaagatattttggaaggggattgggtagatgtctttcaaagaatatataattagttagattaaaggaataagttaaaaaaacctgttgtaaagcctggtgactatagttaatgatgacatactgttatgttttaaaaatactgatatagtcaatgttaagtgttctccatcacaaaaatgataactatatgaggtaaagcacttgttaattagccagaatttaatattacacaatgtatgcatgctttaaaccacattttacatgacaatacatataattttatctgtcaatttaaaaaatttagaaacatgaaaaggtagtgtttcaaataagcagtctgtgtcttattcataagcttagcagagtagtatcaaaatatatagtttttgtggtgtttttgtcatttcacttgtcagtcataagcatagaaactcagatatttaccagcatgtgcaagaaccagcacagtgcctgggagaatcctatgtactttagagcttttactttgagctccaggtacctggaattcctggtatagaagacactaaaaaggcaggtgctgctaatggtttcgcctctggcccttctgtaaacactgaaaacaagtttgcatccaaaatcactgagaaaatgttttaatccaaaagcctgccattgtctttgagatttctctaaagagaatgacctagaatttggctgtaattaggtgtctgagaataaaaactgtggactgtaactgtgcccattcaaataaaagaagttataataatatgagtgagaaatttcccaagatggcaatacgaatccgcaaaaaagattattccaaattttaaacccacaaaggttattttatttttgtccaaaacttattatacccactcaacaacagaagattctgcatggaaacaaaagcagtgggataaatatttcatagaaatttgaatttaaaatattttacttaccactaactctccttaatacaattttatttctaagacatgtctctaatgagatatccaaattttgatttgttttcttatgtagcactaataatacatggcccactggtattaatacttcacttagtctaatttgatatttaccattctttgtgttataatataataatgtttaacaatgctatctgtccaacgatctaatccatggatactgcgttatcttatctaaattaagtgacaagaatgttgcatttgtaatctataaatgacttcaaattctccagctacaaagaatttttaggcacattaaaaataattctaacttgtcctcagaacctgcagagtactgtgtgaaataacatggggtggggagaacagtgagcaagctgttgccataagacaggcaaagaaagagaagggctataatgcatatgtatttgggggtgaagataaaaagacagtgaaagaaaaactgaagataattagaaaataaaagaagcagaatttatctgtctaaatttagagttagttgtgcagcctgactacagatttcctctctcaccatgcaaaaccaatgccacttcttcactctgggtgtttttaatctcttatatgaagatacaaactcactcgagcagaaatatttcctgataattgtaaagcatttgttacacacctagcaccgtcttgtgtttgtttacttcatacaaatggcaagaaaatcccatggcttatgaagcctcccgagtttttaccttaaaagcatggctcaataaattcaataattatatcaaatatgtctactataaaacatgaaagaaacagtaataaaaacattttgcttaaatagaattgtctaattgaaaagattaaatatactaattaaataataaaatttaataatatactcactgcaaaattactcagatcttcaaattatttagttagcaccattacattttaccgaaagagctataatcattaggcaggtcacgtaaagaatacttcatgaactttgaaagaagaaaattgtatattaggtctagcatgaatagaaggcaagctagaacaaagggtttggatggggagattctgaaccacaagattttagagatgaatggaaagcagaggaaataaatttgctttcagaatctgtgaggttttagtttgctagtatatcataaacactcatgaaatcatctgctttgttctgatatattttcctactcagaataggtccacactcacataaaaacaattacttctccaattcttttatatctaaagtttatctttagagtaatatatttagaaattttacaccatgtaaattaaaactaaaattttgtgtttgtagaaccagagataacatgttcaaaaaaatgtaggctgaattttctaaatagttattcagaattcagaaatgtagggcttttgattatactcctatataatcttcagtataaccatcacaataacttcacagttacaaaataaataaaaatgtaatacgtgggaacaatattctctaaattatttgaagtataaggccactgggaaaaagaatcactacagatgttattccaccatattacttaatggtatagtcttaccatgttttacctacaagcctgagtaaggtagaataagttaatgttgacagcaggatgacacttcaatcaatgcacaagacccttaacatattaaaaatattttttatttgttaaaacaaataaagtttacaaataatctgagacatatcaaaatccactctattttattagttttatgtgcatttggtgaaacaattttcttctaaattttacagtgtttattaataaaatgcagaggatatgcactgaacacctacctcatgcatcgcttacaacactgttatcacttaaccacaaacagcctctccacttagattttcttcatgtatcttacatttccaggtccttaatcttttatggagaagtatataaatgatgaccacctaatacagaaggaccgctcagagctgtaatgcatcaaacattgaccacatgcttccatataaacattaggaataaaggcaaagcactaagttattcgaaagtttaattatatcaatacttgctattcaaaacatttaaaattattttaatgcaaataattacactcaatataattttaaatcttcaagaagcaatctcctactacttttatcctacatacaaataaattatccaattattttaactttggattattctctataatgaacactctgaataatttaactcatgacaggattcatacaattaaccttttaaacatttgtcttatagtttacatcacattgattacccttttatcagatctcagtagcaccaaaaacctgacaatggtatagacactgcccactagcctctagacaccacggtcatatgcccatggcaacgttgaggaggttgagatgatgaagtccatcttgtacatgcccaccgagaaactcaccggcagcaggatgtgctgatggctcttgcctctgcaaagatccttaggtagaggctggggctgtgaaggtaccaggatctcctgtagttcctgaatgagagtcatcatgtagacacttgagaacagcattatttgtttaagaaaaacatctctgaataatgacagagtgaaaaacagtcctctgattatggagtttattgggaaaagtgaacagtatttactgacatgcaaattgatctgggtcacattggaagaagccacagtgtaaaagatcaggctactactaacaggaaaactgagagaccatgagaacaaatggaaggtaaaaattgtggatttccatttaaacctcaccaaccaggaaatgctggggctgatgttgacgacctgcagcatgcccaggaggcaggtggtacaaatggagaggaccctgatcaccctcctcaggtagaaagatgcctcatatttgaagtcattctgaaaattcagtgattcaaagagctgtggagacaagaacaccatggtgagaaggaccaccatgtggatgagggccacatgacagactggtaggtaagtgcgctctggcctgagatccagaaaaagcagaaaaggagaagacgcagaaaagaaggagaaaagtgttggctgagatgccaataccagcttagaaatgaaaggcatttttcatgggaacacaagtgcaaagtaatcatctgaattacaaagacaaacatactttgtacatcaaaatatgaagtataaaaaacattttgtacttcacatcatctgtattatatattctatggccaaaattatcataaacattatttttattccactaatttttttcttaattaatcctctcatataaatccttgatatatatagtgtatgtgtgcatgtatgtatatataatttgatgtataatgttgagaatgtattttgaagaatgtatatgaaaaactggctcactttttacaaagcatttcttaatgaagagtgatggttacataacaataactcacatgtttgtatagttgagctaaagtaaattttatgttaagggaaaataatcacctaaagaaaaagttgaaaaaaaagtttaactgactcacatcacagcactcagtttctcttattatttctttcacttttaagaatgcttataattacattaggcccaaatctgtaattcaagttaatgtttttgttttagagtcagctggttatcaaccttgatttcatctgcagcctgaattcccatttctcatataccataatacatgcctagaacctggtggttagacatggggacctttgcatggcattattccacttaccacaagtcctattaaacgaatcccttaaaataattctggctctgttcaagttttgtttttatcccagagaaatctcatgaaagctttatttcatctcaggaggaaattgctaaaatccagttttcaatgctacaagtacatggactacctttttctactttatgggatccatgaatttgcattaagtgataattttcttgatgcttcactttatacagagatacccttccatggaaagatgcctttccaagccttggaaaaacaccaaggtcactaatagtaaagataattctccatctcttaatcatgatatctctgtatgagaacccttcataaaattttattgaataattctgcaattactttcttctttgccctgaatacagtcatcactattgtatccaactaattcagcccgcagcttagaataatagagctctggctcatgcctataattccaccgctttgagaggctgaggcagggacattgcttcagataaacagtttgaaattagcttgagcaacacagtgacaccctgtgtctatcaaaaataagaaagaaattagctaggcatggtggcacgtacctgtggtcccagttacatgggaagctgacatggaaggatcacttgagcataggatcttgaggctatagtgagccagtgagttgtgatggtactaatgcacaaaccacaaatataaatgtgcaaggcaatgaagatgatttgacagtattttttacctcatactcagaaattaacatctgagttagaaaactgctaaccaattttaaaccacctgatatggatgagtttacaaaaaggaaattgcatagtttatatatcagtttttattttttctcctaacacataatctagtataagtacacatttatctcaatgtccagaaccaaacaatggatagttgccaccaaaatatactgatgccatcaacatgatatggttcttttgtcatgttaaacctaaaagaagctccaggatagtatcagattaaagccataataatctccatatattaaatactgcagtctagttccagaaaataaacatggacaattaatatacaaataactacttactacttatgtagaaatcacttttactaaatatactgtgtgtattaaaagttatatcacagaaagaggtaatacaattagataaaacaacatacgtaagaattctatttttttctccccataaggtatccagatcacacactttaattcatgccacaccctctctaatgactactacataccgcaaaagaatgtatctgctaattatcaaactttatttttctctaatgaaggttttcaggtcattaatgctgagtctggagaaaagaacagtggctcccatgaacaagggttgacaaatgtaacacacttggttatatttgaatttcaggtaaatgatgaattgttatttgtatatactccagtaattgcttacacatattatacacagatataaaaacattgcatagctatactaaaaagttatttgttgtttaccccaaatttaaatgtaacttatgttttctctattttatgtcacaaatgtgccacaactaccatagaactattgtataatttgggacaacatgttacaaacatgggaaaacagaataaaagaaaaaatatcaaaggttttataaaggctgagtgctgtgacttatgcctgtaatttaagcattttaggaggcagcagtgggaggactgagcccaagagtttgagacctgcctgggcaacataatgagaacccatcttcacaaaaaaatttcaaaaattagccaggcattgtaccacctgcctgtagctctggctacttgtgaggctgaggcagcaagttcacttgagcctacacggtcaaggcttctgagacccctgatcaaaccactgcactcattcctgggtgtcagagtgtgaacttgtctcaaaaaaacatcaaaacatgagatgcagcaaactactgagagaaattcacagcagtaaacacctacattaaaaataaacaattctaaattaataacctaatgtttggcaaaaatagttaagggctaattaactactcatcacaccttggagaaagaatatcagtgcggcaagcaaaagtcatgtagaatatctaagagaaaagactgaggagtgaggtgcctgggggattcgggctttgaaaattatccacatattcctgagaatccagaagcccataagcatgttcagggtcaatcaagggacaggcaaatgctcacaaagacctacgaagctgttatctctcatgtctgctttacctccaagccctgcacaagcaggaagaaaagaaaacagcaaagttgtaatctttctggctaagtaaacccaactgcaagaactagtagatttatatttgatgtgagcaggcatttgagaaaatctctgtcaaatagctagctcacatgaagctaataaagcagagatttttattgctaaacacgacaaaaggatgatattttaaaaataattttgaaaactcaccaaacaaacaagtaaaatttacaataagcaacaaaaaaacccaacgggatgagagagaatattatttcagggttgttgtaatagaaaaagtctagttttcagcaacagcaatgaaatacaaagcgtgcaaataaattaatgaaaaaataatggcccactaataagataacagatattaacagaaacagtcctagaggaatcgtaggcattgaaaaatctagaaaaagtctttaaattacctgtcttaaatgtgctgcaaagataaataacatcaaaaggaaaaacatttcagaagaatagtgtctcatcaaatagaaaatattaatagagatagagattataaactgaagccaaactctaaagttgaaaattaagataactaaaataaaaaattcaccacaaaggttcaacaaaagatttaagtagacgaaagacacaaccagcaagcttgaggtcacttcaattcgtattatcccaactagcagaaataaaaaataatgaataaagatgaacagagcctaagataacaatgggatactataaaatgtgccattacaagcattatgaaaactcccgaaagaagggagaaagataaaatggggcagaaagaacatctgaagaaataatggctaaaaagttcccaagcatgatgaaatacgtgaatctacacattccaaaatctcattgaattcatagtataaactcaaagaactctacaccaagacaaattacaataaaactttcaaaagctaaagagacaactttgaagaaagttatggagaaaagactactatttgcaatgcatctacactgacattaacaactcactaaaaactagagtccagaatataatttctcactaaaaactacggagtccagaatatgataggacaatatatttaaagtgtagaaagaaaaaaaaaagccaacaaagaactctattttcagcaaaactgctcttcaaagatgaaggacatccttgaagacctttgaagacactaagagctatatagattaaaacaaatttaacagcttgtcactagtagacctggtatgcattaaatgacaaaggttatcttttgggttgaaatgaaatgacaaactaggtaataatgcaaggccatatgaaaaaatgaagaatgccagtaaaaatgagtacatggcaaaatataaatgccactattaaagaatattttgtaacttttatctattgttcttttttacatgtaatttaaaatactaatgcataaaataattataaatttttgttaatgtcatacaatgcataaagatgtaatatgtgacaaaacaacataacattggaggagcagatctctattgaaacagcttttaaaataaaactgaattacgagcggtattaatttaaagtacagttacacagtgatgagattaattgtcatccttaaggtagccactaaaaatacaactaaagaaagaagtgaaagaggaaatgagaagagaatcaaaactgttttggaaaaatactagaacattaaagatgtcagtaatataagagttaattaacaaaaatatacaagactttagaaaacaactagaaaaatggcagaagtgtgcccttccttataaatagtttaaatagaaattaacatctacaattacaatgcaaagattggcagatggtttaaaaataaacaaaaacatgaactaactttatgttatctacaggagaatctctttagtcctaagctcacaaataggttgaaagtgaaaggatgggtaaaaagattccacacaaatagtaagcaaaataagctggggtggttacccttagacaagataggcattaagacaacattgctataattaattgacacaggaaattttatgttaaaaaattataaatctatcaagaagataaaatagttttaaatatgcatgtacctaacaaagaccccaatatatgaagcacaaatggcagaatggtagaagtagaaaattctcaatgtgaactgctgactttaatataccaactagacctaacggacaaattcagaaacacctaatcaaaaaccttgaaatgagcaaaaattgattgcattttcagattgttttcaagcaagcaatttaaccaccttgctattttatggcatgcttatttttttaaaaaaagttatgatgaaatatgcataacatcatactcaatacaaagtttctggtatatttataattatgcaactatagccatggtataactttaaaatatttccactatcaggactagacaatcattactgatttcccttttatggacattccattttatcacctttattgtttggtttggtttcgtttttgagatggagtctctgtcatgcaggcttgagtgcagtggtgcgatctcagctcactgcaacctctgcctgcctcgcgggttcaatagattctcctgactcagcttcctgagtacctgggattacaggcgcccaccactgcacctggctaattttgtttttagtagagacatggtttcaccatgttggccaggctgctctcgaactcctaacctcaggcaatccacctgcctcagcctcccaaagtgctagaattaaacgtgtgagccaccatgcctggtccatttttattacctctttattattgtggtatgattactattttgtataaatggaatgatacactgtattatgttttgtgtctggtttatttcacttaatgcatgtgaggtcagttatgtcatttttttttttttactaattttttgtatattttagaaaatgcatttagaagagaataaaaaacttttaaaataacttccatatttctcaatgttgtgcatttttttcaaaaaataagcaaatattttattttttttggtttctttgagacagatcttattctatcaccatggctggagtgaagtaacatgatcatggcttactgcagattctacctcctaggctcaagtagtcttcccacctcaggctaccaagtatctgggaccacagctgcacaccaccatgcccaactaatttttaaattttgtgtatagatggggtctcattatgttgcatgggcttgtctcaaactcctgcgctcatgagattctcctgcctaggcctcccaaagggctgggattacaggtgtgagccaccacacccagcctatttttttctaaagacagggtctcattctgtcctcagctcaagtgctgtggcgtaatcatagctgaaggcagcctcaatgtactgagctcaagtgatcctccctcactgacccaaagtgctgggattacaggcatcagccaccatgtccagcctgaaataatattttaattaaacattaagaaaaatagaagaaataagatctagtgtttcgtaacacaataggacaactatagttaaccgtaatttattgtataaaagatagaattgttgagtaaggtgtgagcaccagtttagggttttggcacattctttacacttgaagagtttctatctggtatgaattatttgatgttgagtatgggttgagtgtctgttaaaagctttgccacattcttcacatttgaaaggtttctttccagtatgaattctctgatattgagaaaggtgtgagctcctggtaaaagctttgccacattctttacatttgaagaatttctctccagtgtagattctctgatgttgagtaaggtgtgagccctagataaaagctttgctgcattctttacatttgaaagacttctctccagtgtggattctctgatgtcgagtaaggtgtgagcccctgttaaaggctttgccacattctttatgtgtgaagtgtttctctccagtatgtattctctgatgttgagtaaggtgtgaagctctgttaaaagctttgccacattttttgacacttgaaaggtttccctccagtgtgaattctctgatgctgagtaatgtatgagcttctattaaaggctttgccacattctttacatttgaaggctttctctccagtatggattctctgatgttaagtaaggtatgagcctctgttaaaagctttgccacattccttacacttgataggtttctttccagtatggattctctgatgttgagcaaggtgtgagctcttcttaaaggctttgtcacatttttcacatttgtaaggtttctctccagtatgaattttctgatgtccaagttgtaagcccctggtaaaagctttgccacgttctttacattttactgatttctctccagtgttaattatcttatgtctcttcagatgtgactgactaaagactattatacattttttattacatctttgtgagctctctccaatataagttcttcgatgttgagtaagttttgaggatgggttagaagtttcaccacattcattagggttgtaaggcttttcttgaatatggatactttgaggattgataaaacactttctcacattcattacatttgtaatagttttctagaaaatgagtattctgatgtttactaatatttgagtcatggctaaaatttatctgatttttattacaaaagacagattccaaaaattgatgttgatatttactcacaggaatacatggttctgtaggagtagctggcagaaactgaggcttcttcagaaatattctatgttcttcatctcctttcacagttaaatttttgttatgagaagttgtcaaatattggctacataaattataattctttttgtccttcacctatactttcccagtttttccataagcataaattttcaaggccacagctcccatatcttcccagtgttgcttttcctagtgttgcttttttgaatgactcttctatgccttgctctggtaaaatgccttggttgtaataagaatatatagctcaaagtagtaaaaataactaattattctacatactgaatttagctgaatatactttacaaatccaatatgaaattttaccaagctgagaacatgagcacaatgccatagtagaaaaccaacagaggacagagcaagatggctagatagaaggctccagtgatcatttcccctggaaggacaccaatataacaactatctattaaaaagcaaacaaaaaccttcataagaataaaggcgagcactcacagtacctggttttaaccctgcagtacacaaagaggcactaaaacagggtaggaaagacagtcttgaatcactaatgccactcctcactcatgccctggcagtagtcacatgctatgtagacagaatctgtacacttgggagagggagagcactgggattgtgagcattgaactcagtgctgccctatcatagcagaaagcaaaactggaatgaactcagctgatgcctgcccacagagggtgtgtttcaactggccctggacagaggggaatcaccctcccagtgattggaacttgagttctggcaagcttcaccaccatagtctaaaatgctctggggccctaaagaaacttaaaacagtctaggtcacaaggacagcaactcccaggtgtcatgctgaactgggcttagagccagtggacttgggggccacattacctactaagatacaagctggggcagctaagagagttcttataccacccctcctccaaactgaggctgcacagctcacagattcaagagaccacttccatctacttaagaagacagaaagagtaaacaggactttgtcttgtattttggataccagcaaggccaccagtcagagttataaaacatccttctcagccactagctcctaattaaaatttctaggtacatactggactataaggaaatctgctgccttgaatgaagaaatccggtactaacaagacccatcaactgctaagtaaagggcccttggcctggaataacctgcagtgataaccaggtagtttgctgtgagctttcattgagactctgaggcttgctagaatcaggtgagactcggcacattcacaactgtggtggctacagggagacactgaaaaaggtagaggaaaaactagagaacttcatcttgcaacttaggtcccagcatggccaaagagaggaagagcaccagtgggctcttggggtcccttattccaggtcttggcacttggatggcacttctggacctgtactgggacagaagggacaccactgaccaaaaggatgagtagcaggccaagcatcattcactataagtgaactaaagagccttgaaccttaagagaacattggtggaagcctggcagtattcccgatgggcctgtggtgatggcagcaataggatgaggcccctctgcctgttgagtaaggagggaaaaatgggaagaaccgaatttcatggtttaattgctagctctaccacagtacaatagaacacaaagtagactcctaaggttattgactccagcccctggctcctggatggcaccactgggcttgcccagaacctgagggaactcactactctgaaggaaaggatacaaacctggctggcttaccacctacagattataaagctccaagaccttgagcaattactggtggtaccaggtagggttacagctcaccatgggtgtgatcaagtgctgtgctggtttcaggtctgacccactgcagtcctactgatagcaacagaagacaaactcctaggcagacagggatgggtgcactggtgaaactcgaccttcaaggaaacaacagtctaaaaagcctgaaaactgagctaccagttccagaaagaattcatggactagagtgagaacttccatccctgtctaacctgctctctattggttctttgagaatgatgccttttaaccaattgaatggtgtcttttccaagcccacccatgaaccaatcagcatgcattctcctgttttaaacccataaaaatcccagactcagcctcacagatggctacctactttcaggttccctcttgctgctgatagcaagaccagaaaacaaagaacaaaatggcaagagtaagtctttatataatcaataacaacactgaatgtaaatggactaaattctccaatcaaaagacacagagtggctaaatggatacaaaaattaagacccagcgatttgttgcctacaagaaacacacttcacctataaacacatagattaaaaagatttaaaaaaattccatgtcaaagaaaacaaacaaaaatagcagtagttgctacacttatgtcagacaaaatagatttcaagacaaaactagaagaagagacaaagatggtcactctataataataatgagtttaattcagcatgaggatgtaagaatgttacatacatatgcatccaacactgaagtactcagatatattaagccagtattattagagctaaagagagagacaggctccaatataataatacctggagaatgcaacatcacactttcagcattggataaatcttccagacagaaaaccaacaaagaaatctcaggcctaatctgcactataaaccaaatggacacaatggatatttacagaacattttatccaatggcttcagaatacacattttgctctgcagtgcatgaatcattctcatggatagaccatatgttaggtcacaaaacaagtcttaacacattttaaaaattaaaataatatcaagcatcttttgtgactacaataaaaaaacctagaaatcaataacaagacaaatttttgaaactatacaaacacatagaatttaaacaatatgctcctgaaaggccagtgggtcaatggggatattaataaataaattgaaatatttctgtaatatgtcacaatggaaatacttaggatttacagtaaaagcagtactaaaagtttataactaaaagtgtctacataaaaaaattcaaatgaacaacttcatgacagatttaatgcaatttccatgaaaataccaccagtattcttcacagaactagaaaaaaaaccctaaaattaatatggatcaaaaaagtgcctacatagccaaagtaatactaaccaaacaaataaataaaaaatatggggtcatcacattaccctacttcaaattatactacaaggctatagttatcaaaacaacatggtattggtattaaaatttacacacagaccaatgaagcaaaatacagaatccagaaattaagccaaacacaggcaactaaactaatcatcaacaaggcatataaagacacaaattggggaaagaacaccctattcaataaatggtgctaggaaatactggcaagccacacacagaggaataaaactggatccccatctctgaccttatacaaaaatcaattcaagatggatcaaatatttcaatctaaggcctgaaagcatacgaattctaaatgataacataagaaaaaaaactcttctcgacattgatttaggcaaagaattcatgactaagaccccaaaagcaaatgcaacaaaaacaaacataaataaatgggacctaatttaactaaaaagcttctgcacagcaaaggaaataagcagcagagtacacagacaacccacagagtagcagaatatatttgcaaactacagatctgacaaaaagctagtatccagaatctataaggaactcaaagaaattagcaaaataataattccatcaaaaagtaggcaaagaaaatgaatatatattttttcaaaagaagatatacaaacagctaataacaacctaaaaatgctcaacatcaataatcaaggaaatacaaatgaaaaccacagttagatatcaaataactcctacaaaaatggccattttttgtaggccaaaaaaagtcaagaaaacaacagatgttggcattggatgtggtgaaatgggaacacttaacaaaataatgtcatttgcagcaacttggatggagccgaaggtcattattctaagtgaaataactcagaaatggaaaactagatatcgtatgttcttacatataagtgggagctaatctatgaggatgcaaaggcataagaataatgtaaaagactttggggacttgagggggaaggctgggaggcgggtgagggataaaaaactacatattaagtacagtgtgcactgctcaggtgacaagtgcactgaaatctcagaaaacacactaaagaacttatccatgtcatgaaaaaccacctgtatttccaaaacaattgacactttaaaaaaaaaaaaacctaatgacgtatcttagagagctagaaaaacaagagcaaaccaaaccaaaattagaagaaaagaaataataaagatcaaagcagaaataaatgaatttgaaataaaatacaaaaggtcaataaaatgcaaagttgttttctggaaaaaaaaaaagaaacctgacagacctttactcagactaagaaaaaaaaaaaaaaaactcagcaggcagtggctcatgcctgtaatcccaggactttaggaggctgaggcgggcggctggatcacctgaggtcaggagttcaagatcagcctggccaacatggcaaaaccccgtctctattaaaaaacacaaaaattagccaggcatggtggtgggcgcctgtaatctcacctactcaggaggctgaggcaggcagaattgcttgaagtcaggaggcggaggttgcagtaagctgagatcgagccactgcactccagcctgggcaacagagcaagtctccatctcaaaaataaataaataaataaaagaataaaaggaaaagactcaaataatatcaaagatgaaaaaggagacatttcaactctacaacttatactgcaggaattcaaaagatcattagtgagtactatgagcagatagatgccataaattggaaaatctagaacaaatggataaatttctagacacatagaacctaagaagattgaattattaagaaatccacaacctgaatacacaaacaagacgtgatgagatccataatacaaagcctcccatcaaagaaaagcctgaaatctgatggtttcactgaatttgacaaaacatgtataaaactaatagcaatcccacttaaactatttcaaaacagaggaggaggaaatactttcaacctcgttctgtaaggcaagcattactctcatactaaaatcagacaaatgcatatcaaaaaaatctataggccaatatcagcaatagatgcaaaatttctcataaaaatactggcaagtaaaattcagcaacagattaaaagtttattattcctcatcatcaagtaggatttatctcatggatgcaaagatacttcaacatatgcaaatcaattaatgtaatataccatatcaacaaaagaaagaacaaaaaccacatgatcattttaattgatcctgaaaatcatttgacaaaatttaatatctcctcatgaaagaaaccctcaaaactatagaagaaacatacatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcagcactattcacaatagcgaagacttggaaccaacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcgcaagaacaaaaaaccaaacaccacatattctcactcataggtgggagttgaacaatgagaacacatggacccaggaaggggaacatcacactctggggactgttgtggggtggggggaggggggagggatagctttaggagatatacctaatgctaaatgacgagttaatgggtgcagcacaccagcataccacatgtatacatatgtaactaacctgcacattgtgcacatgtaccctaaaacttaaagtataataaaaaaagaaacatacctcagcatataaaagttatatatagatatatagatatcacatatagtatgatactaaatggggaaaaatgaaaagcttttcctctaagattgacaacatgacagagatgcacactttcactactgttattcaacacatggcagctagagcaattagcaagagaaaaaataaagggcaagcaaattggaaaggaagaagtcaaattatgtttgtttgcagatgatgtggtcttatatttggaaaatcctaattcactaaaacactattagaactcacaattttagtcaagatataggattaaaaagttagcagcatttctatatgccaacagtgaacaatgtgaaaaagaaatcaagagagtggtcccatttacgatagcctcaaattaaaattaaatacctaggaattaaccaaagacgttaaagatctctacaatgaatactataaaacattgatgcaagaaatttaaaaagacaaaaatatgtattttatgttcatgaataagaatcagtatttttagtgtctatattaaccaatgcaatctacagacttaatgcaaccctatcaaaacatcgatactcttcacagaaacaggaaaaacaatcctataatgcagacagaaccacgaaagactcagaatagccaaagttcttgtaagaaaaaattttgcctttatgtgcctggcttatttgtcttaccatatgatctccagttccatccatgttgttgcaaataacaggatcttattctttataagtgaaaagtactcctgggggtgtgtatgtacatttgctttatccattcatctgttgacatgttgcttctaaatcttggctaatgtaaacaatgctgtgtgaaaggaaaacaaatctttggaccccaaaatcactaagctaaagggaaaagtcaagttgggaactgcttagggcaaatctgcttctcattctattcagtcatccctctgctcactgcaagtcctaccagtacacaggagaaattttaaaaatgaataaaagcaaaataattcaatgaaaacaaaaaagcaactgtcattacctccataagaggtgactgtgtaggtagaaaatccaaatgtaactgactagctgttagcttaactgtacaaaacactattaatattcctaaattctatccatacttagaaaataaaatacaatagcaaacttcacctgctccaccctatattactccctatgttgataacagttgagatgtctcatgtagctgatttatttaaatatttgcaccaattcagatttaatcaaattttactattatttttacttctttgtttttgccgactattgattattattattatttttttaagacagtctcactctgtggcccaggcttgagtgcagtggcacaatctcagctcactataacctctgcctcctcggttcaagtgattctcctgcctcagtctcccgagtagctgggattgcaggtgcacaccaccacacctggctaatttttgtatttttagtatagacagagtttcaccatgttggccacgctggtctcaaactcctgacctcaggtgatccacccacctcggcctcccaaagtgctgggattacaggtgtgagccaccacacccagcctgattagtatttttaatgcatttctttgaattcattttctcttctttatggagtgcatcctccagttttgtttttttggttttttttcccctcacagagtttacaggtagtcagtagtatatacttctgaataaattctgtcttaggttggtttcagtgatagtttggctgactgtaaatttctatttccaatgttcttttctgtgagaacccactattgatttctgcacttctttttgcttctgatgtcaccaccctgatcaaatcaaagtctctctcattcctttgaagcaaatcagtttatatcattctggtgatataaaatgtgaccttcatgtttctgggtatgctttttgtttttgttgttttccatttatccatttcaacataacatgaacttttataacaaaagcacattatccttttccagtttctggaagtttttctcaattatttttgttactaattctttgaaatttattaaaactggctttatgccaagtaaagtggtaactattacatatgcaatttaaatggctgcataatattctctaatcactatatatgtccattaaaatcaaagtgggaaataatctattcgaatcttctatatccttatcctttcactttattttatgtgttctacttgtccattttatctagtttttttccctctctcttcctgcttttcttttgaatttatttatttatttattgagactcagtctcactctgttccccaggctggagtgcagcggcatgatttcggcttactgcaacctctgcctcccggattcaagtgattctcgtgcctctgcctcctgagtagctgggacaacaggtgtaagccaccatgcccagctaatttttttctttgtatttttagaatagaaggagtttcaccatgttggccaggctggtcttgaactcctgaccccaggtgatccacctgccttggcctcccaaattgctgggaatacaggtgtgaaccactctgcccagtctcttttgaataatttaaatccttctaccctcacccaccaattccatcttttttcctttgattggtttggaaattaaacctctattggtttggaatctttactattcttttagttgttttccttgaaattttacactgcattttgcattacaatttaacaaaggctaaaattaagctaattttaactccctccacaaaataatgcaaacactgtagaatgccttcactctgatcacctcatttttgtatttattttcagttgttcgcttattctgtcttgtttcctttaattccaccaaccacaaacagaagttgttttacatacagctttcttattgttgcaaatacgtgattagagtttcagatgtgtcatctgcttactagctactagattctaactattcataactgcactccttaatcttttcctttcttgctaaccttctctattaacatttctttattgaaactttgttggtcttaaatgctcttaagtcttaaagattatatttttctgtaaatgactacctcaattttatttatttatttatttatttttgagacagagtctcactctgtcgccaggctggactgccgtggcgtgacctcggctcactgcaacctctgcctcccaggctcaagtgattctcctgcctctgcctctcaagtagctgggattagaggcacctgccaccacacccggctaatttttgtatttttagtagacacagggtttcaccatgttggccaggctggtctcaaactcctgacctcaggtgatctgcctgccttggcctctcaaagtgctaggattacaggcatgagccaccacacccggctctcaccttcattcttgaaatacgactctacagttcttcattggtaatgattattgccactgactctccttcatggtggtttgtttcctctgtctacaattttccctggaacctctgctgctcctggtatgcaccactccaaactcactgaggccagactctgaggacacgcccatcttttgtagtcactctcgtgattgtcgttatttgatgaatttattttttaaattaattaatgtatttttttgagacagagtcttgctctgttgcccaagatggagtgcagtggcgtgatctcagctcactgaaacctccgcctcccaagctcaagcgattcttctgcctcagcctcccgagcagctgggattacaggcacccaccaccaagcccagataacttttgtatttttagtagagatggggtttcaccacgttggccaggctggtctcgaactcctgacctcgtgatctgtccacctcagcctccgaaagtgctgggaccacaggcgtgagacaccccactggccatgaatttattttatggaagaagataaacatactaaagatttcataattatttttcactaatgttatactaacaagaagttacattattaaataattgcactaatactggtgctcaatattagatagtggtacagttacttttttgttcctcccatataaatttctcagctatgaatttgtcttgccacaaaagaggcctaaaggataaatctattcaggcagatttgagaagagtagttgactcccccaaaatacacattttcctatttcaacatcattgttaatgaaatgaagtggcagtgctcacctggaagaaaacacttgcaaaacatacatccaacaaaagatctgtaaccaaaatatacaagagctcttactgttcaatagtaagacgataaatcaccctaataaaaaataggcaatggtttaaacagatgcttcaccaaagaagacatacagacagaagcaagcacaagaaaagatgctctagattgggcgccgtggctcacgcctataatcccagcactttgggaggccaaggcgggtggatcacctgagctcaggagttcgagaccagcctggccaacatggtgaaaccctgtgtctactaaaaatacaaaaaattatctgagcatggtggcaggtgcctgtactcccagctacttgggaggctgaggcaggagaatcgcttgaacctgggaggtggagcttgcagtgaacgaagatcgcgccacagcactccagcctgggcgacagagcaagactcagtctcaaaaaaggatatatataatgatatagcactgcatatgtatcagaatggctaaaattaaagatggaccataccaaagctggtcaagatatagagccactgaaactctcatacactactgctgaaaatggaaaatggttcaactgctttgggaaacaacttggcagtgtattaaaaagttgagcatgcacttaccatatgcactaggcattctactaccaggtatttagccaagagaaacaaaggaatatgcctacagaaaggctagttcactactgatcatagtcacattgcttgatacttgaggtccacaggagcagtaatagtgactaaaattcactgagatttactaagttccaggtattactttcatatattaatttgtttaatcttcattaacatttccatgaggaagcagtgagggaggaaggacatctctctggccagccaaattcctggccagccaaattcccttaagtcaaccatcaatcacttaccatcgaggtcaagttcatcctcctccaagggaaggctgaagatactgatggcggctcagttatggtatctctcagggaagggaaaaaactggcttcttccctagagagtggggccgtgatcaatgtggccatgattaatgacacacatgtccttttcatgatgagtttcatggtgcatcgcatgctagcctacagactgtacctttccactcttcctgtttcactttgcaatgatattcactagaaaaaggatctttttatgggctaacaggcagccaatcttccagcaaatgaactgggtcacttaatgaagaaccataagttgtcatcaatagtgatgcagacttctcaatgatcaggtttgcaggtttacaaagacagatcagtagttcttcatgacaaagaacagtaaatgattatgatcaaaattgtattcttataatctaaaacaccaatattgtctttctttttctttttcttttttttttttgagacggcgtctttctctgtcacccaggctggagtccactggcgtgatctcagctcacttcaatccccgtttcctgggttcaagcaattctcctgcctcaacctttcaagtagctgggagtacaggtgtgtgccaccacgcccagctaattttctgtatttttagtccagacggggattcaccatgtttgccaggctggtctcaaactcctgacctcaggtgacccacccaccttggactcccaaagtgctgagattacaggcatgagccactgcacctggctaatgccttgcagtacacatctaaagagagcatttgactttatctaaccagtgcttgactctgaaatctgttaactgtatgtcttctatgtctgaaagtataagtattttttttccaattcctatgctaagtgctctatttacttccttatctcatgtgaaccttacaaaccatacgaacgtattttttagaaattttccttgaaactttaagaaagcaaatggcaatgtggtgtgtgctttcttaaacttccttaaaactttattcagtgtatcctcttcccagcctcactttttgtgactcttggcaatgactgcatctttcacaccatagaaaataacctgctctgaaacatcaacgctcacaagctggtcttaccagaacctccatgaaccaaatgctgcaaagaagcctcagaatcacagatgcataacatctagctagcctgataacattacacagctgtttattttttatttttatgtctattacttttagtgtagcagttttcttatactcaaatgtctaaacattgaaaactcagccaatgcaaagctatacaacaaaccctttgacagccttcgcacatttgaacagtattatttttcttaaatgagccaattctgagacacaaatttcataattcttgaaagattttcttccacaatagaaattttggttaaaatgatttatttgacccgaatcaaattatggaattatgttctaaaactaactgtattacatttattacatctattggccctcaagccaaaattctgccagcatttctcgtcttcgtgctgtgctcacaaggaccagcagcatgtgctaatactgactgtctgcccagtaacatgctagagtatgaggaaggcacctcaggcacatggaggcaatagctgcaactgggtcaaggcacatgccctatttcttcatcactcacacactcagaaatccacaatggggaatatgcattttgcatggaagaagaaaaaaatgactcaatcctagctagggggattcccacctcactccctcacagcactctctacccaaccaccttccctcgccacactcagacatgctcacacctacacacaaggatgatctggccacttctcccattaattcaccactcctagaaaaactgtatttggcttaactttatcaagctgtctggctgcctgaagatttatagatgtcaaaataaaaaactaattacaactcggaataccgcagtagcacctgatttaatgtctaaggcagcaggccagtgaacatactgagaaaggagaaccctcacacactctccataaaggagccatgatgaggatcagcatggaggatcctcagaaaactaaaactagagttactatatgcccacaatcccactgatgggtatacatccaaaagaaaaaaaacaatatatcaaaaagatatctgcactcccatgtttatctcagccctattcacaacagccaatatatggagtcaacctaagtgcccataacagatgaatgcataaagaaatgtggtatgtatacacaatggaatactattcagccataaaaaagaatgggatcctgtcatttgcagctacaaggcataactggggatcattgtgttaagtgaaataatccaggcacagaaagaaaaatattacatgttcttagtcatatgtgagagctgaaaaagtggatcttatgaagacagagaataaactgatgattaccagaagctgggaaggatttggcaggggagggctcaggaggctgaggcaggagaattgctggaacccgggaggtggaggttgcagtgagccaagatcgtgccattgcactccaggctgggggacaagagcgagacttcatctcaaaaataaaatcataaaataaaataaaattgaaaaaagttcccggttatcatgttgttgagtagtacttaatcagaatatacttgaaaacaaaagattctttgtggttttttaactcttggtaattaatccattttaggcagtcttaaaaaaatgatgtaggacagggaaaccaatatgaaatgggtagtctgaaaagcagttattagatattgaccatcattttaggaaaggcaggctatttaccccactatatgctcccaggtaaacttgtcttcaattcctgttaagtcaaacgggaaaaaccaaacttgccatctctctatatttactatcatttaaaaaattctgttaagagacaccaaaacatagtatttcgtacctccttgcaacataaaaaattggcttcccagctttggaattcccagcttggtaaaaaatacttaatgttttcaaagccttgatctcttctttttcacatacctgatgcctaaaagaaaaagaacagggtaactgtgaggctttgtgttgtctactgagtatgtaaaacagcccataattggataaacaataaaatgctaaaatgaaaaattattttaaaagcaacaggcattctaaagggtaatttgacaacatgcacaaaaaatctcaagatattactctttgaaccacaaaagcacttttaggactattctaagagaactactggatgaggatattaaccataggattgtttttactcatgacttctttgtgtcagacagaagtttatgattttttaacgaattcattttattaatcttttcctttctagtttatggattttgaatggatgaaaaaggccttgctttgcccatgtttttttttctttctgatttatgggagtctatcctcataaatggtatgaaaatattttttcagatcattactcagttttatcaacaccatttattgaaagtccatcctaatcttgatttcaaataccacttttatcatatattatgttcccatatgtattaaagcctggtttactttttatatagtctgctcaagactcagtgtgcttctttaacttcaagattaatgtcattcatcaactctagaaaacattcatcctttaccctttcaaatattacttcttcccattctcactgagctcaatttctagggaacacctactagacatattttggaacttctcattctatcttctgcatctcttaatctctttcatattttccatttctttgtctgtaatgactgtatgctaggtaatttgcttagaaactaccttcagctataaacttaattaattaattaattaacagatggagttttgctcttgtcgcccaggctggagtgcagtggcacgatctcagctcactgcaacctctgcctcccaggttcaaatgattctcctgcctcagcctcccaagtagctgggattacaagcacccgtcacatgcctggctaatttttatttttattttttttttagtagagatggggtttcgccatgttggccaggcttctctcaaactccaaacctcatgtgatccacctgcctcagcctcccaaagtgctgggattataggcgtaagctactgcactcttcctaattttttttaagtatacatgttttcttttacacttagtgtatctatgagtattgtgatttgggaaggagactgtattaactcagcccatcatgctgctggtaccaggtcagcattttaaaaatattaatggaaacaacctagatatcatttgataggagaaaaacatatacatgtgcatagataaatgactgggagactatacaccatacgttaactgaattatttctgagcaggaggataaacaatttttaatttttttttactttctttagatttctatattgagtaattcaataattttttttaaataacagaatattggctgggcatggtggctcatgcctgtaatcccagcactttgggaggctgagaccggtggatcacctgaggtcaggagatcgaggccatcctggctaaaacggtgaaaccctgtctctacaaaaaatacaaaaaattagccaggcatgctggcgagcgcctgtagtcccagctacttgggaggctgaggcaggagaatggcgtgaacccaggaggcagagcttgcagtgagccgagatcatgccactgcactccagtctgggcagcagagcgagattctgtctcaaaaaaaaaaaaaaaaaaaactgaggctattataaagctaccttcatttttttaaaacagaaaatgggtctccaaaagcatcagtgggaatttagaacaaaaataagatctaacatttattaaacactttacaagtaccagatactgtcctaagtatactatatatattagatcacataatcttcaaaagcacaaaagactgctttgtaaggaaaggtaggatcttagaaaaaaaggagtaataaaaacattttcctagaaaaatagaaaaatggccaggatgtcctcagtgatgttaaatttaaaaattgtttgttttgatgtactcatctttatatgtatttctatttacttattttttttacttcttttaatttatatttttacttatttctttatttatagacaagtctcattctgtagcctaggctggaatgcagtggtgcattcacagttcacttcagccttgagcaaacctcccacctcagcctcccaggtagctgggaccacaggtacgcaccaccacacctggttaatatcttattatttgtagagatggagtcttgctatgttgcccaggctggtctcaaactcctggctcaagcaatcctcctgccttggcatcccaaaatgctgggattacagacatgagccacagtgcccaacctatttatttatttatttaagacaaggtctcaccatgttgcccaggctggtcttgaactcctggtctcaagtgattctccaaccttggcctctcaaaatgttgggattacaggtatgacccaccatgcctggcctaaaaatagtattatatttttgtattatataattttcaattaggtaatatgaatattctgtacagaaaatatgcccttaattacataggaataaacgtttgctacactaagaaaaatctaacaaagctaaaaataaaaattaatttggaaagtacattatatacccatacattcttatgtttatacattctttcatatattcatatattcttttaacagtatcaatggtttggagttatgtgtacaaaaccatgacctatatgtaatacaactaacaacaggcacttacaattcaaggcatatgatatacaaagctttaacttctcatcatcagattttgtttttttctttctgttttggcagatactgtgaacacaacattcaactcacagacactatggagaccttactaagcataaggtactgtgaaatgtactttaaaagattcagcaaactactctcactgtatcatcatagagtcagtgtctaaccatgaagatctttttgttcacaagctaaatgccatgaaatgggattcaaaacaaatgtccacagaaattttatagcaatactgaagtagactatattttctgagccttaatctaaaagaagttaaaaccattcatctttatgagggttctgaaaagtgttatagtgtagtagaaaagttctgcacttaaaaccaaaagacctatgaatcaggtgtgggatctcacacaagccagttattcacactgagttgcattttccttaactatcatctgaaaataatgttttcttcattccctggtaggtattaaatgtgaaaacttatgaaagcaagatgataaaatatgatttgttactactattatggcaatcaacatataaaacatattctttatatatatatatatatatatatatatatatatatatatatatatatatatatatataaataatatatagaataggagaaaagttgggtccccaaacatggcaatgtgattattagatgcatctttcctcatagtcttctatcatatctaacaagtggcctagtggtaaactctgcttctcaaccaaaaagaaagcagtctacatttcaaggttgtactttacctcatcataaattcctcaaacttttaactggtaaggttaaggctggaccggtatgtatctgccacaggtttgtgctctggaggaccgaggtatacaagaagtgttgccatttatcaaaaggtcatcttccaacagctttatgatccctagatatagcaaactacttagaaaaaagtagcagttcacatttagcagtacacatttctttaacttgtaactgttgcttttcctttaactgtcagctggtggtccctgttgatttgtaaacagcacccaaaagacctcaggcccatgtctacttcaatccattaataatgcataaaagattaaaatgctctgtggtttaaactcccatctcccaattgcttacccttagcttcatagtccactacttttcctgtgaatgtgctaaccacttttattggcatttaaaaataatttggactcatttttcctttgtaaggaactcctcatacttaggaattttgtccctttacaagtttatataactagatgggacagcaagtaatttatgttaacacaagagactaataagagctaatgaaacaatgcccaaattaataatttcaatttttaagtattttttctttttttttttttcccctgagatggagttttgctcttatggcccaggctggagtgcaatggcacaacctcggctcactgcaacctccgcctcccaggttcaagtaattctcctgcctcagcctcccaagtagccgggattacaggcgcctgacaccatgcacagctaatttttgaatttttagtagagatggggtttcaccatgttggctaggctgatctcgaactcctgacctcaggtgatccacccacctcggccacccaaagtgctgagattacaggcatcagccacagtgccaggccagtattttctatataaagctttatttgcatatacttagagtatcacaaatgagtttatcatagaattgaaacactgacaatattttaattactgaattcctatgaattagctgttcttcagattcaaatgccaacactaatttgaacttctttgggtctatgacagtttgcaagccatacaaacccaaagagctaatctgtgatttcttaacttgagaaaataataataataaccaccactggaacctacataggtttgttgattatttaacatgacttaacctttcgtttgtatttttttgaaaaaaaaaaaaaaaaaaaaaaaaaaaagactttctctttctaaaccataattcttagtccaagaagatgcaaagtttttaaaaagcactattcatgaccaataattttattgatctaaattaaaatggagaatgttcactatcctcatgactgggaaatcttacctgttgttagaaagacactggccaattttctcctgattgttccggagtagatgatgtaaagcgagcacattgccgtcactgctgaaggaaaggctatgatttactgcatcacttgtaggacaatcagatgccatatcaagaaaaaacattagaaaatgcaaagtcactagaattttcaacaccagagacacaccatacttatgtttgaattaaatttatacgaagtaactttgtgaagcaactgagatgacaattacaaatatggagggcttgttcccacaacgtgatttgtcattagacaaagtaaaaaggacaaggagaaagttggctttccatttctgatacctggcttcagcttctgtagttaaagaacagcaaaattgagatggatgaaactttggaaagaggctggtattttacagataaggaaatgaaggtccagacaaaagacctccccaaagatatatagcctgttaggtcaaagccagtattaaaactttgttccttttaactttctttgggccctcagtctgccagaatatgaatcctgtgctgacattcactctctttccaacatggcttgtcattcagcaatataccttttaaactccaattttcctaaaagaataaaagtcagtaacaattacaatgatgataaactggaagagagagttgtacaaggctagcttagatgataaggatcaattagattcacactgcatgaaaagcagaattccagacataaatttacaaagcactttcttatgaattatctcattttttctctctaaaaacaactcaggcaaagagtttatccccactttacagataaaccaataactcagagaaataaagtgaaataactggttatggaaatccagcagaaaagttttctaaaatcataaagttcagttactcatgaacaaaatcttacgtgtttgcattacttggtttaaagaataacattttagtttagatacacttccaaatttaagtatcacaaatattctgatactaataaaaaccttattaaacattcttatgcattatcaataccaatttggttttagttttaaataaaaggaatcctatttcttccttatccccatattgtaccatcctcaaatcctttatttaactagacatgtccaaaatgcctcttggttttcaaatatgaaaatcactaccaaattataaaaaatattaatttatttcaagactgtcttttatagtaaaataaaataaggcaagctatgtcttgacctagagcaggaagagaaaaaaacctacacggaacttcatgtaaaacaggtacatggatttatgtgaaactgaaaatatttgattcaaacagagcaagtgaataagtggcaagtagcttaccttcaagctgcatcaaagctgcttttcacaaaatcattgaaaggccgcatatgctcttcttttgtgaagagaacatgattggcaatactctgaagtatttacacaataaaacagggttataaataatcagattatttattgtatgaagtttatacattaatatattctttaaaaatatgaattttcttgatataatttctgctagtagttaaaatcaatcatttctcattctatattttaggtagtgtttctattcttcctaattataattatatttacatgtacaaatacatattaaaaatgtttaatgtcttaaaataaaaaatcctacagccttcactgtagtctgtttcagaatgtctagaatgattacgcaaaaaatgatcctcatgacacaagacatctgctataataaaacgtattctcatgaaaataaggtccatcaggtacctaactaatgaattcctttgtaatataaacaaaataaaaacacataactgaaaaccgtagggtatttccaatataaatgtaagaggaagtactgtaagaaaagctgaaaatttagttggaaggggaatttaagatagctagattatcaaaataattcacctttgacattaacttcaagccccttccgattctaggtggtggctttttatctaaaatccctgcttcatacagtgagacaatatcaggattcataaatctgaggaacatggcacttcctgctgcactgatactgttctgagggaaacgttggctaaccccctaaaaacaagttgagacttgagtataaggtttgaattaaaataggggcatgggaacaaagagttcaaaggtcaacatttgcacaacaactctgagtcaatcagtcctcatgaatgacacatttctattttttcttctcccaaaacatgagaaaataaagtttcctctcaattctagtcttgtatcatattaaagtacaatttaggtatctcagaggaaagaaaaacctcatggatgagatgggtagaagaaacctgaaaacagatcttcactgtatcatcacctatactgcaagtttgaggagtcatgaaaacagaccaaattttcacacaaagatgatcataatttattaagattaacagacatgaaagtgtggtcaacattataaggtgaaactaaattttcaacaacacacccccaaaacatcctatacctgatagtacatatttatgttttgttgtgtaccagttacaactgaattgaagaaaaaaatgcttgctataaaaaaacaaaatcttagattcctattgaggaaaaaaaacttacttacaagtaatgttattgcctgttgccagcttcctttataacaacctacctattatttgaaccatggagggatgggaattcttgggcacctaaaagaaaaaaggatctcagcagaacagcgaacccctatgtctacctcaatgtataattctgtcaaataaaaataatttaagaattcaagaaatggttgtccagcctgaaaagtaatgtgaacccaatatttaaagtggattgattttctctttataaaacattctacattaagataaagtaaaaggtaccttagactgggaagagtgccataaaatgggttcagcccccatcccttcccagtgtcccctgctttaaatcatgttatagatgaaaattatattattttggaatttacatttttatatataccatatatattcatttttaaagaacacaatgtaacattttaatctctacagctattcttgcttagtgtggctaactgctgtttaaagtagcagtgattacaaaactgtagcattccactcaatgttttgtgattccgaggataaaccttcctttcaaaggatattggtgtgggggacccagatttacatgcagaatatcacttaactattttttgcacaatgcctcaataaattaatatttcctgtcctaaattcacatggctgactccagattaactctggaatcgggattatttcacttcatcctgttcaacgcagtgcttcatgaagtccacattttaaatgcattcttatcactgcttataatctcaaaatagctttctgtaatctctaataggaagttagtaaaaattagatgttagagaataaagtatttgtaagcggtgaggtgtaacaatatagtcccaccttcagttacactacacacagttcaggaagctttctttatgttacagtgtttattgcatgaagaacaaccttaacccttcaataaggggaaactggtgaaggtggctaaatatagctgctttattagaatggctttaaaacctaaataccatttatttttagctgaaatatataaatttagaattagatatagaagttttagctaaaactataaaaagataaagaattaagaaaaaatttgagtgcttcgactattccagtatagtgttcaaccttctggggatgaggaacctctttgaaatctgataaaggttagaaaaatggatgtatgctttcacacaaatttcttcacataattttagaatattcatagaccatcactgctactgagtggttctcttaaaactcccaaattttaatctcaaaacagacaattctctggttgggcatggtggctcacgcctgtaatcccagcattctgggagactgaggctggtggatcaattgaggttaggagttccagaccagcctggcaaacatggtgaaactccatctctactaaaaatagaaaaattagctggacgtggtggtgcacgcctgtaatctcagctacttgggaggctgaggcacgagaatcgcttgaacccaggaggtggaggttgcggtgagccatcgtgccactgcactccagtctgggtgacagagcatgcaagtgactgtgtaaagtgatatgtaaagtcatggaaaaaggaaagaggcttaactagtaacggtctgtggaggtagaagtcaaagacatccttctcctgtctgtccctggatctaaggcagataaaaagaaggataacttaaaaaaaattacagatatcattaaagaaaagcatatttgtatataacttttataattaaaaacaaattttaatgatcaagaggagaagttatgagggccttgcttcatgcagtgttagcaaaaaaaaaaaaagagcacttttatgtgaaaagatgataaaactggtaggatccacttcaaagctaacatgttgcccatcagaggatgtgatctcaattcgtaataaagcatccaggagtttttatagataggtagcaccatatacctatagaaatgcatgagtaggacttcattatgcctgctccatacattttaccttaaaagaagacaatcagctctgcacattctgtacataatcattacttgacatacctcagcacacacacacacaaaatgaatgatacaaaccttgaaacagagtgtcattattttactggccaaactgttgtctcagaggagagtctgaatggagtcagtctgccaattctacttctttacaaaacatgttccagagcagttggtagagtaaatgccaagaaccaaatagagtaaccagaactcaagccagttcatcctgagaacaaaacaaaatcaggttagtgcatttttgttctcaggtagatagctgaagagtggcaaaatcataaacccaaagttgacaactacttgctaaattaaggcaaaggtgactgattaatatttctcctgagatttatctgcgtatattgtttatgatagatgactatatacgatgtctacgatagctgttaattccaaggattaaccggtgaaagctattaagagaggcctaggctttaccaggagacaaaatctccaagattcagttcaaattacatcacaaaatgaaagagaacagaaacagaagatgacagcaaatactttagtttgatttgtacaagcatttgcacagagcagaaataagactgatgatcagaagagttctactctcttctcatacagtcaggggaactcagtgaatgctgaacatagactaggtagagacatgacaaaaacagaaagactataggatttttgagaaatcaggaagaaaaggaactgggcgttcagaacccagagatcagccagatttacatacaaagcaagggggacagggatgagggctgaaattccaattacctaaatgacatccttgtaactccctgtagtaaagcagtttggggtacactcaagaaaaatgatctactggtaaatcactgtttaatcacaagaagaaatttatagagaataggggtagccataaaaagatgcctcaatcctcaagcagtaacaacaacggccaggatcatggcccatagctctctaattcttgcctggtcccaggattacaataatgtgataggtgagatctggcctaatagaaaattccttctcaaagtcatttaatataaaactcaacaacaaattaaagctacttgaatttaactgattctttatttaaaaaattactgagtattttcagtgctaatcataggtagatcctaataagataattcacaatagtcattttcaaaacatttgaacgtttgtgaagtaattttaggctttaggaagatttcaatgatttggcgctgttgctaatcaatcagtataaaatttcagttatacaaggtaagttctagagatctgtggtgcagcattctgcctacagatagcaatactgtattctacacttaaaaatatgttagagggtagatctcatgctaggcgttctcaccaaaataaaataccagaggagaagcatttcaggtggtagcagcagcaagggtgcttaaggcagaaacaagtctaacaaggagggacagaaaggtagctggtgtggctttggtgaacaagaaggaaaatggcataagatgatgttagagatgaggcagggcccaaatcaggtggagccttgtaggacaggataaggagtttgaattttactttaagtacaggtgtaacaaatatcctacagctttaagcagaaacaaatctacaatgacagattaccttattagttatactttactataagtgaaaccatttttggtacactaaaaaggaaatagccttttaacactggaaaggaaccaccacccttctcaacgttttcacatgtattaggaatgatgtgatttgaggaaaatttttcattaaattaagagagagacctaatagccatatgatgttttcagtgtttaaaacaaacaatatcataatatcaaatgcaaatacagtgcttacatttttaaaaattgtgtaagatattatggggaaaagaacagcaaactggaggtagtaaacaggcacaaatcgtggattccaattccagcgttgcaacaactgactgaaattaggtttaacttaattaccttctcaaatatatgaagacagcggagtagatcagtgatttttaatcagtgtttaaatggaatttttcagtgggatgaaatgatataggacactattcaggtctagcagtgccaaccacttccctacagctgaaaagtcacctaactaaacatctaagatttcttctggctctaaaattttatcaattcattcaacaaacatttattgaacaaatatgttctgaaggatttgctatgtgccaggcacttttcttccccacttactctatgcacttacccactgagaacaaggaaccacactggccagagccatcgctatagggagctctccttgatcacccatcactgtgaccagttccaccaattgctcaaacccatcagccaataccgtttctgaagtgtgtcaaattctgtgccttgttgagggattttcatcagaacttccataaatgtagctgtctggagatccttgtagtaccctaaacctgatgtggacaaatggatgcaaatttactaacatggccttactgaagtaatttttgcttatcttacaagccagttctctaggctgtgtatttctatatgaaactttcatttgatctcacctatggagtgcatgagaccaccgtctatgctggcactaagtaagtttgacattgcaaggactgcacagtgcctccgtgatgccaacctccgagacatgccacgtttcctgccacctgtttgtgcactttcatcttcagcttcactgcagtcactcaaaaggttcataaatagtgtgaagtatctgagaaataaaaagactgacctttacatagcaaaggccgtatcaactagaaagctaaccagacattccaaaactatcacatgtgcacggtgtgactggccctggattaactgcttctctcctctctcaggataatcagccagggtgactcattatgaagcatgctgtgttgggcatgattatacctgatatagcctagcatacctttcataacataagcatcaaatagatgcaatgtttcctggtaaatgtgtcatttttaatgtttagtatataaaattagtggtccaaacagcttacacaatgtcacttttgtaaatgacttagtgaagcaatctgggttttattacaagcaaaatttcagggatcatattattttctttaaaaatcataaaacacagttattttcctaatcctagtcctgcatggggaacatttctttgttttcttttttgtttttttgtttttgttttgttttgtctttgagagtgtgtgtgtgtgtgtgtgtgtgtgtgtgtgtgtggcggcggggggctttatttgcttttgctttgtgttttttggtgactgaaatttacttaagaaataactgtgtcccctttggcttccatcaattccacaccatctccttcctcaggctgcacagggagaccagctagaagtgaaactactgcttccatgcttgcctggtccaaatctctgaaaaaaaaaaattagagaccataaatctttcaggttatttcacttcctctcaaataaacctcttattaacagatataaactttaggaactacctgtttcattaaacaaattattagcacaacccaaataatttgaattaatatgcagatcctagaatacaaaatcatctcaaatgaggagaagacaatagtaactttctacaaagtaatcttggcaaaatgactatcttcaatcagaagcatgtacaattggccctctgtctcagcgagttctgtatccacggattcaaccaaccatggattgaaactatttgggggaaaaaaaagtagggtttcatctgtactcaacatgtaaagatttttctttgttgttattccctaaacaatatggtataacaacttgtgtttatataagatttatatttattagatattataagtaatctaatgataatttaaaatatatgggaagatgtgcatagtttatatgcaaatactatgacattttgtatcagggacttcagtctgtggattttagtgttcatggaagtgagatgtgggcaggagtttggggggtggttcctggaaccaattcctgacagatactgagagacgaccatattataaagctaggcttggtcaaagaaacatatgtaaaggcttattatacagtccatagtgtttaatcactttctgatatgtgtcaataagcatttatcattaaagcagacttaattacacttaattacttccttttttttctgtctctggtgcctgaatcaggaaatcaattattttttagaaagaccaacacaatgagttcctcaaataatacctttttctatctaatcataacataaatgcaatctgaggctttatgtaccttatttcccaataacggtagactattcttcataaactgacaacactaacttcccaaacataccgctctcgcacatttatttttacagaaagtctatcagtcaaaaaaaagtagtaataaagattagtatctttacatatttcaaccacaaaagtttgacatctaaaaaatttaaatacacataaaatacaagtataaagctgtaatgaagtaattataattcttacaggaaaacccactaatacttgaaggtcattctcttttttaccttgtaatacattttacatcatcatctgctgcttggtttgatgttcccataacccagactgtcaggtattctacaatcttattcctaaagaatggcggagaaaagagaaacagccaacaatttttttgaagccacacacacacacacctttaattgtgtaagatttcttacagtgcaaataatttggcagataacccaggtgacatgacgactttataaaagagatactgatgtcacagacgtaaaagccagaagggaacaagcaacgtggatatttaacctccaacatggcccttatttatggtatcaaattggaaacagaatcaaattcttagctcaagtacagcacagttttagaaaaagggaggcttgccacaggcacaaagcttacggaaatttgaggagagacgtagagaaacacaaacgtgtaaattgctctctttttatgtcttccttcctaccaataaccagatatctactctatttctgtacttcattcaacaaattaagatttacaagaccctacattgctcttttgagaactcacctaaatttcatctcttggcaaaataagaggtcatctctccttgccatcgttacttcaaccaactgacacagtttcgtttttatttgaattgcatggaccatattcccaagcacacgaacatacctatacagacacagagacgataaaaaaattatcagatatagacaaaagagaaagcattcaaagtactttagtcatcaaataaaatgaactacatgtaagtctgaaaacaatatttatttttatgagaacatacacaccttctggttacctgactgtcacaccctagtttgtgtgcagtaaagaatggcaaattattttatcaattactaccaatatcaatgtgtaagaggtttttctgatctcttaaagtatgtttctgctacatttcagtagaacgcttacctgaccagatataacatcattggttcaatgctagcttgccctagatgttcagagctgccttcagtatgattatctagcaagttcttcattatagctatggtttgctctacaaattgagtgttggtatccgtcaataaaacctatagaaagaacaaatatattaatcatttgccatcaatgcccagaagacagacctctagagagatgcaaccgactgatctaaacacacaaacacagaagtgcacccacaggcacacagccaaacaagcatacagatacatgcagacactcatacccatacacaaggcaggtataccctcaggcacacatacacaccagagttcctaagaagcaagctgacccctacattgagatgactcttctttctgcaattttttggcaatttttaaaaactgtgagcacctaatttaaataattggaaagaaaaagccttccttatttcaaacaaggtgaaaaataaaaaagagcacactttacctgtccttgggagtcaaaaaacttgctgatggcattcttcagtttgttaaatagcatcagataaagagcaggactcaattctagacccaccaggtccttaacattggcccgtatttgaagtcccactttctcatggttacacaccattaaggacaacagctgatccatacatttgctgacaggtgtacctgcgtttccctctgaggacatcactgaaatcatggaaccctgacattcactgactggacccatgggtgggctataggttgccaggccagaattacttctctgctggaggcacactcccccaagggcacaaaggaagccagtcatgttgatccattcctgtagggagtctgtgtcagacaaatctgcgcgtcctcctccactcagatgggacattcgactcctaacaatggtcatgtgaaactttcagcagcctaaacacaaaatttttgggcaaagcatgaattaaacctacattagttgagacttgacaaattactctttatccaacatttcttccatgacaaaagtacaaaaaatgtaaaaaacacattaaaatcaaccccaaaaattaccatatacatttttaaagagccactgatttatttttgtcatacactaatataatcgcccaagtatcaaatttcttttaaaaagctttgatttcacatggatgaaccttggaaacgttatgctaagtgaaagaagctaatcacaaaagcccacatattctaaaattccatttacagaaaagatccagcagagacaaatctgcagagacagaaagtagattcaaggttgcctagggctggagaagccgggggaagagagacaagaaagtggcggggaggtggggtagggtgttagaggcagaaatagctaaaggatacaggggtttttttcctcaactgatgaaattgttctaaaacggactgtggtaatggttgcacaactctgggaatatactaaaaacagccactgaattggacactttaaatgggtgaattgtatggtatattaaacagttatccccccaaaaactttcattctaaagctacatgtcccctccaaataaagctattaggtacacaattttgcttcataaaaacataacatttttcttattgtaattaagtatgacagaaaaaaacatgggggaataaccagtttatataaattgcctaataatgggaggaatatgaacattacaaatcaattacacacaaacaccaactcatcaatttccagagtaacagataatatagtcaatagtaatagttgaatgaactgtccacattttaaaatctcatttaatctatgggttcaatcttttgcccaagacattccttaattagaatacttaacaaaatagcaaaatgaattgtttccatgttttttttctctacctctgttgctccttttctgaaaattctgtgaaacaccctgatgaagggataaagagcaagaaaaggtctctgcaacagtctctagcagtgctgcccagtatttctgtgatgatggaaacattttctctctctgctgtccagactgtcatatgtggctactgggtacttgcaatgtggctactatatgattgaggaactaaattgtatttaattttcattatgttaaaatttaaatagtcacacgtagctagtggctaccatattacgaagtacaggtctagataaaccacaactaaatatcagtcttcagacaactatatgcttactttactgagtgactcgtgagagattaccaaagagaaggacatatatttagcagatcagttaatagacaaaagtcaactttacagacttacctggctgtcatccattttggcttttggatagttaaagattagttttgttgcttgttcccattttgcatgtgtatcttcccaagcctaaaatgaaggcaattatcacttgaaagcaactttaagtctagagctaaacgtcaatcagcaatggccaagtttcaaacttgatgtataataagtactcagatattacacttctaacacgcacatatcttggatttacttcaaaagctattcctgattacacatatgtaacaataggtttccaaaattgagggtgggcgcctaggaggggtgtttctcttgctaagagcacacctcagtgtttcctgcagtgggatgctaagtgcgcctccgcagtgccatcactctttctgaagtgctgctgttcctaagcaaatacaacagccaatcaagtcactgcacttagagccctgcctgcccatggagaacctcataagccctacccaaaaggcagagtaggaggagcagagcaaatgcctcaaatgataaagccaaaaacttcctttcactaacctcacaggaaaggtacttatcttaaactctacaatgtccacagcacaaaatagctattcccacctataatttactcaaaacatatgccaatgtgcataaaacttcactatctacaacttaggtggggtaaattatatgatcacaactgatagtaacatatactgccagttatttttaaaacatatagcatattaaaaactcactgggagactatttcaaatgctttttcttttcatctttgtttcatttctttgttcagaaaaggatttcaagtaagctacttgaatctcccctgtaaacttacaaagtagtaaccttaaatacattctcacaattagatgccacgtgcttcaggcaggttgagtaaaaaaaccactattcacatttacctgttgacatcacattgctgacagaggcaaactccatgaatgtgctacagttgggcaagaggtgatgcactgacacttcatccaccccacaccaggtatctgcttcctcacagaggtggcggaaacaggacatggcaaccagaacagcttcactgtcagggttccacagaaacatgtacagcgccacacttctagtttggtctgcccttgttggcaaatcggggaagggggggcgggggcggttgcgcttcatcctgctgcactatcctgagagtcaaagttgtaagacatatatttgcaacttgggtaattttatgtataaaacccaacaatgcaataaactgcgtgtgtgtgtgtgtgtgtgtgtgtgtgtgtctcagcatacaataactcacaagagttttctcctttaatcatcacaggaatttttcaaaccctcaaatatcttgtccaaatgagaaatgagattatctggaccaacataaagctactctctgtccaatttcaaatcaaataggtattatcctattccagattccagaaacataaactgattctaacataaacaggtaaaacactgtaacataaatctgctgcagtaatgatataatgtacttaccagtcaattagaaatgacaaaaaaagaagtaggccgggcatggtggctcatgcctgtaatcctagcactttgggaggccgaggtgggcggatcacgaggttgggagatcgagaccatcctgggctaacatggtgaaaccccgtctctactaaaaacataaaaaaacaattagccggccgtggtggcgggcacctgtagtcccagttactcaggagaggctgagtcaggagaatggtgtgaacctgggaggcggaacttgcagtgagcggagatcgcgccactgcactccagcctgggcgacagagtaagactctgtctcaaaaaaaaaaaaaaaaaaaaaagaaagcctaggttttaaagaccaataaaatagtaaacgtgaacgaggaaaaaaagaaatgaggaaacagttacaaacatagatactgaaggtaattatatgataatatagaaataaaatacagcctttaattgtacaagtaaaatatataaatattatatacaactctgcactgataaaattgaaaaacatgttttgtaggaaagaacaaaccatgaaaagtgactttaaaaataatagaaattcttcaaaaaattaaaaatagaataaccatatgatccagcaattccgcttctggatgtatattcggaagaatgaaagcagggccttgaagttactggcacacccatgttcacagtagcattatttataatagtcaaaaggtggaaacaaccgaaaaatccattggcagatacatttagatcaacaaaatgttggtatatacatacgatatcattcagctttcaagaggaaggaaatcctgacatgctacaacaagatgaacactatttcagccataaagaatgaaatcctgcctttcaaggcaacatgaatggaactggaggacattatgctaagtaaaataagcccatgtcaaaaagacaaatactgtatgattccacttatgtgacatagtgaaattcagagagacagaaagtagaaggatggttgcaggagttgcaggtaggaaagaatggagagcagttgaatagacacagaatttgttttgcacgatgaaaaggttttggagattggttgcacaacaatgtgaaagatagtgctactaaactgtgtacttaaaaatggctaagatggtaaattttatgttatatgtattctaccgcataaaaaattttaaagagagacagaaaaactacatagatccataaggcagctcaaataaaaggattaaagagttattttaagtagacaatagataagctagttctagaaacagcataagaaaccagtagcagtacttgacttaggaagaaaagtataaattgaaggtcaagagggagtaggaagcttacttttccactgaattcccttcctgatgtatagtgaaaatttccattatgtcaatttatttttttctttaaaactaaaagcaaaagtcaaaggaaatcttaagagcttctaaacttgatgattttacaatgaatttctatctaatcagataatttctattacttaaattattccagaccatagaaaagagtaatagttcccaaattcatattctaatttagcacaaataagtgttagaataactactttcaaaagtgataatgcatattatgttaaatatacacatgttctaagaatcagaaagctgaaacactggaaggaaatgtttcattaagtagctacccagtacatttgccaatagccaaccaaatttacctcacgcacacacacaaatcaacatactaaaagtaaggatttccaaacatatttccactccaaatttaaagtgaaagtttaaataacatataaaccatctgactggatacaattcagccctaaagctagagttcagggccccttatcttttgttcattattaattttaaaatttttgatgtatttattagtatttatgaataacatagtaacattcccatagatttgcagagatcaaatcgaggtaattagcatatccataatctcatttatcatttctttgtgctgggaacattcaacatcctcctcctaactctttgaaactgtgtaacatattgttgttaattacagtcatcttacagtgctatacaacactagaacttgctcttcctatctagctgtaattttgaaacctttaacaaattgctttctaccatccctgcaccctatgcttcccagcctgtagtattctgttctactttttacctctatgagatcaacgtttttttagcttccacaaatgaatgagaacacacagtacttaatgttctgtccctggcttacttcacttaatatgatgtcctccagttcaatccatgtgcctcaaactacaggatttcattcttgcttatggctaaatagtattccattgtgtatgtataccatattttctttatgcattcatctgttgttagatacttaggatgattccatatcttggctattgtgaatagtgctgcaataaacacgggggtgccgatgtctcgtcaatatactgatttccttttctttggataaatgtccaataatatattgttggaccatataatagttctatttgcagttttttgaggaacctccacactgttctccatggtggctgtactagtttacatttccactagccccatttaagtgttcacttttctccacatctttgccagcatttgctattttttgtctttttgatagtagccattctaagtggggtgagatgacacctcattgtggttttgatttgcatttccctgatgactagtgatgttgagctttttaggaaaacatatttgttggtcatgtgtctgtcatcttttaagaaatatctattcaggtcatttgcccatttttcagttggattctttttttttttttttttttgctattgagatgtcaagagttccttgtatattctggatattaatcctctgctggatacatactttgcaaatattttctcccattctgtaggttgtcttttcactctgccaatttcttcctttgaattaatattaattttttaaagaaaagtatcttaaacgcttgacaatatggaattaaaaatacagtaccttcaagctgggtgcggtggtgcatgcttatagctgcagctatctgaaggctgaggcagaagaggatcgcgtaagtccagaagtttgagaccagcctgggcaacataacagcaagactcagtctctttttaaaaaatggtatattcaatttggggaacatgctacaaatcctcaaaaaacgggtacagaagaaacatactgcaacacaataaaaaccacatgagagacccccacagctagaatcatatggaatggggaaaaatggaaagcttttcctctaagatctggaacatgataaggatgcccactgtcaccactgttatttaacatagtactggaaaccctagctaaagcaatcagtgcagcccctgatatggcccccaacccaccctgcccccttgcaaccagcagtgtagcccccccgcaatagcgcacccaacacacccaaaccgccccgcctccccgaaccacgggcattgcagcaccccatagcaccctcaacctgaaaccaccacccccccgcaacagccgtgcagtgcagccctggataggacacttagcccacctcactgttgccagcaatacagtctgggatagtttccccaacaggctccccgccgggggcagtgcagccccggttagggcccccaaaccacccccgggtgcaggcagcacagccccagatagcacacctaaccagccacccaaggtgggcagtgacgcctgagatagggcccccaacccgtcccaggccaagggcagtgcagccctggatagcgcacttaccccgacgcttttctacactctggccggttgcagtgtccatcgctgccaccaaccgcagcgggcaaggcaagccagcgaggcaaggcgaggcaagccggcgaggtggtgagccagggaggccagccacagcccggtaggctgcagcctccagcatgcagtggctggcacctcctactccaagctggcaatggagcagctatgaagtcagatgccgacgaggctggaatagtgcaactctagctcttaacatgctttatataccgagattataaactacatgttctgattggatgagaggaaaacactaggcctactctgattggactttattgtcacgttctgattggttagcctaagacttgttctgatccaatcagaacatgaaaataacgtccaatcagagtaggcgtagatgtttctctcatccaatcagaacgtgaagtccgagaaccaggcctgcacaaccccccagtatataaggtatgctaagggggcgtcgcgctgttgcaggctatcgtgtgttaacctgtacttctgccgcagagtttggagaaagcggcagcagattgtgctgccgcaggctggagcctggaacctggagccctggagccttgaatggtgtgtggtggcaatggagagaggcagctggcagtgacagctgctccgtgcttggctacaggaaggaaagaaggagaaagcacctaccataggctggaggctagagcctgcaggactgcggctggcctcgctggctcgcctccctggctggcctcgctgtggttggtggcagcgacggatactgcagctggccagagtgtagaaaggcaatggggtaggtaagctatccagggctgcccgcggcgggggctggttggggtattattccaggtgtcactactttgggtgtactagagtgttattttgggcgtcactgcttttaggtgtgctatccggggctgcactgccctcagcagcgggtggggggggggttggtggggggcgggttggggtcactatcttgggctgtattgatggcagcagtagggctggttgggggcgctattgggtgctgcactgcccgcgacaggggccgggttggggctgctattgtggttgcactgccggcggcatggtggtgggagggctggttagggtgcggactggtgggggtgcttactggtcgggcttcattgccgacagcggggtggggatgctatctggggctgcactgcccatggtgggggcttgttgggggcgctatgtggggttgcaatgtccatggcaggggagaggttagaggcagtatcaggtgctacactgctggtggtggggcggggcagcggtgggtgcgggtaggtgcttggagggtgcggtttcgggcgctatcgggccagactgcccatgatagagggcaggtttgggtgcgctactaggggatacactcctcacagcaaggggcggtttgggggtgatacccggccggtggcaggcggggtggtggggtgggttgtgggcaccgttcgggggctgcactgtggtcagtggcggtggggcgagttaggtgctctatcagctgctgcactgtttgtggtgggggctgggttggtgtgctatcggggaccatatttttggcagcggtatacaggttaggggtgctgtcggaggctgcactgcccatggcggggtgcgggtggggtgcactatccagggcatcattccccctgggtgggggacagttgggggtgctatctgctatgtagggctgcactgctcgtcgtggggagggggttggggaccttaaggatccatggctgcactattgacggcatggagcaggtggccgtgctctccggggcatcactgcccgcagccgggggttagttggaggtcctatcggtggctgcatggccgacggcagacggtaggatgggggagttatctggtgctgcgacgtccgaggcagggatgggttgggggcgctattgggttttacattgcagcggcgaggggcggtgttgggggcgctatcccagagccaacatcaggcagcggattaggggcgccatcaggggctgccttgctggtggcggcagagcttgcagcaacagggtctccaaggaaggagccttcttcctctttctggatttcagactctaaaaggcgatctcctcctgctcctgctagagcgcagcgagcgcacggcgtttccgcagtaatcctgagcacggcaaggaccccttacccgccggggttcccggggccatgcccttttcgctctgtgttgcggagaccacctggcacccctaggcacgctggacacggagtggcggggacaccacggggagacagggctctgtgggtggaggcattgggatggggaaccggcatttgggtgggagggctggctgtgtctgagttcctgctgattttgttccccaaggagcgcagtcctggtgggcccagcggttcctgtggattggagccaggcagtgtgatgttaccagtcaccactccaggtcccagttcctggcccgcttgagccaaaaggagaggctggactttggagggtggatatgagtgccttcactgagactggcccctgccacccagtggccaggatgacaaggtgaggctctaacgctatcagtctctgcattctcctctaggcttttttggctgtgtgtgtccagctgttccatgccaggaggaggaggagttacatgctggaagcttgcagatagcctggggctgctgctcgccttgctgcggttggtggcagctaccgagactacctcgcaccagagcggtaggaggacggccagctgtggccatggcaggggcagggctgcggcggtggccaggtagtaggagctttgtagggtgggccagtgcattgagggcaacagcagcgatggttatagtgacatctgcgctagttgtggcagcagccgcaagtccaggggccgggaagagggagtaggagagctgcggggcctgcccggccaggcctagggtgggtaggaagcttcgggtgctgtaccacaggcctcggtggaagtggtggaggaacagccagggcaaggaggagttctcccccttctcctgcagtctctggagggcgacctcctcctactggcgcatgagcccggtgtgagtgtcagcatattatctcactctttcttccaatataatacagtcatgcactgcataacaaggtttcaccagtgatggcctgcatgtatcagggtagttctataaaattataatgaaactgaaaaatcctcattgtctactgacagcatagccgtcttaaccttgtaatacaacgcaatactcacgtgtttgtagtgatgatggcgtaaacaaacctactgagctcctggttctatgaaagtatagcgcatataggccaggcgtggtgattcacacctgtaatcccagcacttcggggggccaaggcgggcagatcacgaggtcaggagatcgacaccatcctggctaacacggtgaaaccccgtttctactaaaaatagaaaaaattagctaggggtggtggcaggcccctgtagtcccagctactcgggaggctgaggcaggagaatggggtgaacccggaaggtggagcttgcagtgagccgagatcgcgccactgcactcgagacttggcgacagagcgagactctgtctcaaaaaaaaaaaaaaagtatagcacatttaagtatacatagtacataaaagttgataatgaacaactatgttactggtttatgtgtttagtatactatgatttttgacattattttagaatgcattccttctacttacaaacaaaaaagttaactaaaatagcctgaggcaggtccttcaggagctgtttcagaagaaggcattgttaccatgggagatgacagctccatgtgtggtattgcttcggaagaccttccagtgggacgagatgtggagatggaagactgatgttgatgatcctgacccagtgtaggcctaggctagtgtgtgtgtatttgtgtgttagcttttaccaaaacgaagtttaagaaatctgtatgcttattttttgttctgaatacttaccaagatacaacttacagagaggaagcatcgaggcacctgagtgtatctttttaacgctgacattatcattgagaaaaaaattaaaacacagaaaaagctatttttcttaagaaaaagtttcagtgtttttaacaaatctatgaattgatttgcaatttcatggtatctttattggtaatgtaccttcaacaatgcaatcatgtgcacatactttactgaggaggcacttaacacaggctgaatcacctatagatatattcaactgattacctgtgcctgtgagaatacacgaggtaaactctaatgatgtatcaataagtagaaagctatgaagcaaattgagacaattatctaaatcatcctgtcagaaattccctttttatctggactactaggccaataaaatatcattaatttctggaacctgtgaagtttgcctctgttcagttaattagggaaatgagtctctaaacaaataaataatgtaaaccagcagattgtggtctccacaagagtcaaaggcaaataactgctctcaaccatttgtaaatccagtcaaggaaaaatagttttgtcataacgaagaatattttattataaaatttgttatatgatattgattatataaaatattttaacatcacgttaaattaatatgttaagggaaattagattttgaaatgttttattctcattgctctatcttaactgtatctatttgaatgttctagtagcatgtagaatctaataaaatatcaactatatagggacctgaaaatacattgtagctattacttatctttgcgttttcaatgtcagaaagttcattgtcataggtaatctagtaagcaaaagttaataatttttctgaatttaattaatttaaataattgtatcatgtgcattaaccagttcatgtaatccaagttaaattttacatgccctatggcaagaagttctaaatccctaatgtacatctctaaaagacctgatttctttccccagacttatctcatctttttatctatccatctctttcttccactaacaaaaaattctatctcaatagttgtaaatcagttgtatcactagtcccattccatctatgagaaaactccagttcagggatgttaagtgacttcattaatgccccacagctaatcagtaggaaataaccaggagtggaggctagaaaccactccagatctatagtcttaacattgcgctatgtttgctgtgtactctctgacatacaagtcataaaagtatttctcagttctctgggaaatttctacactccactcttgctcagcctgttcatataaccagagcccatcacttatgtcagccttttgagttttacaaattttgttaaaataagataccattcctggtgctttttccaattctaaatagagtgatttttatttttgtgcaattcttaaccattggatctattcccttattatgccatttgtcattatttaccagcattgtttttacatttttataggtattctcttctctactaatttaggggctctttgaagataataattaccttgctgtactttaaatacaccaaaatttgttatgattgctgaagaagtaaaaacaaagtgaaagctaccaattttattcagttcaaatagtggtatacctcagatatcgtggattcagttccaggccactgcaataaagcaagtcagacggaagtgtttggtttcccagtgcatctaaagtttatgtttatactacactgtagtctagtaggggtgcaatagtattatgtccatcgtaccatttctgtctattcaatatattggctatgggtttgtcataaatagctcttattattttgcggtgtttcaccaatacctagtttgagagtttttaacatgaagggatgttgaattttatcaaaggccttttctgcatctattgagataatcatgtggtttttgtctttggttttggttatgtgatgtattgtgtttattgatttgcaaatgttgaaccagccttgcgtcctagaatccacctggtcttgggctttttttgatcagtaggctattaattactgcctcaatttcagaacttgttattggtcgattctggaattcaacttcttcctgaattagtcttgggaaggtgtgtgtgtccaggaatttgttcatttcttctagattttctagtttatgtgcatagaggtgtttatagtattctctgatggtagtttgtatttcggtggagttaatcatttttttgtgtgtctatttgattcttccctcatttcttctttattagtctagctagtggtctattgattgtgtatttttttcaaaacacgagctcctggattcattgattttttggagagtttttatttctgcatctccttcagttctgctctgatcttagttctttttttctgttagcttttgaatttgtttgttcttgcctttccagctcttttaattgtgatgttagaatgtcagttttagatctttcccactttctgatgtgggcatttagtgctataaatttcgctcttaacactgctgtagttgtgtcccagagattctggtacattgtctctttgttctcattggtttcaaagaatttcttgacttctgccttaatttcgttatttttctaggagtcattcaggagcaggttgttcaatttccatttgatggtgtggctttgagtgaatttctcaatcttgagttctaatttggttgtgctgccgtctaagagactgtttgttatgattttaattcttttgcatttgctgaggagtgttttacttctgattacatgatcaattttaaggtgccacgtggtgatgaaaagaatgtatactctgttgttttgagctggagagctctgtaggtatctatcaggtctgcttgatccagagctgagttcaggtcctgaatatctttgttagtattctgtctcaatgatctgtctaatattgtcagtgaggtattaaagtcttccactattattgtgtgggagtctaagtctctttgtgactctttgctttatgaatctgggtgctcctatgttgggtgcatatgtagattaatagagttagctctttttgcttaattgaacccttcaccattatgtaatgcccttgtcttttctgatctttttggtttaaagtctgttttgtcagaaactaggattgcaaccccttctttgatttctatttgcttggtaaattttcctccttccctttattttgagcctatgtgtgtatttgcacgtcagatggctcttttcaaggcagcatagtgatgggtcttggccttttatccagcttgcctttctgtgtcttttaattgaggcattaagcccatttacatttaaagttagtattgttatgtgtgaatttgatcctgtcatcatgatgctagctggtcattttgcagaattgtgcatgtggttgcttcatagtgtccctggtctgtgtatttcagtgtgtttttgtagtggctggtaacaattttttctttcaattttcagtgcttctttcaggagctcttacaaggcaggcctgagggtgacaaattccctcaggatttgcttgtttgtaaaggatcttatttctctttagcttaggaagcttagtttgaccagatatgaagctctaggctggaaattattttcttcaagaatgttgaatattggcccccaatctcttctggcttggagggtttccactgagaggtccactgttactcttatggctttccctttgtaggtgacctggactttctctctggctgcccttaacattctttctttcatttcaaccttggagaatctgatcattatgtgtcctgggattgatcttctcatggagtgtcctactggagttctctgaatttcttgaatttaaatgttggcctgtcttgctaggttggggaagttctcctggatgatatcctaaagtatgttttccaactcgattccattctccccatctctttgaggtaccccaatcagtcgtaggttctgtctctttacataatcccatatttcttggagattttgtttagtcttttttattcttttatctctattgtttcctgcctgttttatttcagaaagatagtcttcaagctctgagattctctcccctacttgtctccatttttctcgggaggtattttaacaaaatttaaagaaattaccacactttttacaattactgtgtatgtttgtgtttatgtgtgcacgtgtgtgtatgatgaacccaaggaaagaatattctaaaatgaggaccagtaatgttattttctatagttttttcttagtactgaacccaaaaaaggaatatcgagaatgtttcagacagtagagtaagatagagataaatcctacaattgccacttataatctgggtaactttgggaaaattacctttcttttgaacttattttattaacttttagaatgagaataataaaaataccctcctcataggactgtggtgaagattaagagaactaattaatataaaacacagcatggggccaagcatatggtaagaccttaaggaattttatttcgttaattataaaacacacatttctccctacattttaacatctcagtagagaaaatgtcttagaatttatgttcttatagttgatgaagcaaggattcttacctaaatacatgatttataattgaaacatagttttttgtttaaaaatgttagaaatcaacactatgaaatcagataccaattctgtcagtggggatagtttgcagtgagggaaataaaatggagaattttgcaaattaggacaaaattaatatatgttctctttattttgagtttattcatatttattccacaaacatttgaatggataaccatgtgccaaattctgtgtaggacaaatttcataagatgaataacatatatttgtcttcaaagatctaacacatgttcatggaagacaacagaaccatataagtacagcatcagttataaatatctaagctaattgtttacatagaagcaagacttaattcataggagaggagagggtggggaaagacaaaatgaaagatgtgatttctgaactaagtctcaacagactggtaacatgagtcaggtgaaaggtgagaggaagtacgctctaaaaggaggaaataaaaaaggacttgggagaagaagagagaagaatctctcttaggaaactacatgatatttaatttggatgaaatatttgcagaaggagtaaaaattctaagctagaagtttaagaagggtcagcttacggaggaccttgcctggttatgctgatgggcttaaactgtggcaggagttaaatgaaaatactctggaacagtttaaaatggaggggtgatacactcacaattttatttccaaactgttgttcagaatgaattaaagtggataggattgaagacaaagaggatggttaggagcttattgtgatcatcattaacagtggtattgcacatgtagtaaaatgggcagatttgaaagattatgaaggtgatagaatctatagtacttgatgattaatggaatgtgaaatagagatagaagttaagttgtaataaccacatctcagttcaaatgataaacaaatgccatgcagatctagagcaggggccatgttcccaaacaatttgcctgagccattgtgcctaacacagtgctgagtccacaataagccaatgccaaacagttgtgcattgatatatcatccattcttctggaaattctttgaggatttcacatacagatgtccatattgaattaatacataattatcaagagaaaaatagccctgagtcaacattctagaaatgttcaattgtctagagtggattttctcattgtccttttccataacaacatagtgacttggaatataacgtggcactaaaaaatagaagaataaaaagggtctttgaagcaattcctttttatcttgctttattcttaacagcagttctctggtcttaattcttttatggttccaggagaattacatttcaaattccgtaattgcacaggagaattggagtcttgtaaaaatttagaatacttcgttcaaaggcaacttttattatgaactgaacctatgctgtgatgcagccaaagaaattgtttagagcatcattaaaataacctttttaataagaccactttctcttgaaaaagtgtagtaccctcttatttaatattaccatattacaattgactgtatgtttgctgaaagtcttagagtatggtatttagtttattgaactagcacaaaatatacatgaactttatcagttttcattttccctttaacaaacgaagaacaatattaaatgacattttatgacatttgataggtatttaaaatttgttattgcggctcttcagtgaaccataaaataacaagtgtcacaatatggctgtgctttcattatgagaaatgcaagcaggaaacatttaaatcagcatcattttccatcaatgttttgctcctgattctctgccaagttcattatctcctctgtgcctaaatttgtccatatgaaaaattaggagaaaaaagaataaattaatacttgcctctaaaatgatctgaaacccaggtatggaaaatcttacacaagtttaaaagactggtttattcactactgtcctcattcgtttgaacagaccgcaatgttctgtgggagagtagctgagagactgatgcaataatagtccttttcacaccttccatccagaaagacaatttttttatttgcagctgaagctattatatccagagcctatggctgtttgcctcttctaaagttggaaattttgaaagagaaacagcaagtaaaatgtgaaaatgtcctctgggatattattttattactacatgtcccttatttagcaaactatatgcaatataaaaaattaagtctggtgcctggttggcaaaaaatcaaataacaggtactaaagaaataatgatgagctaacctaagctctgtgtgtgtgtgtgtgtgtgtgtgtatgtgtgtgagtgcgcgcacgccataaagccaaggtggagaggtgaataaaaaagtcattagaggagagggaaaagccatatcgcttgaaaaaagcaccatggtatcatggtagaagaatgggctttagacgctggcaagcttgggtttcaattatggcattttgtagtgcgctatttatttctgagcattaatttctacaatgaaaaaatacataataccatagggtttgaaggatcaagtgagatgattgaaataaagtatgaatcaagatgtctgtcattaattctctcttttaatcatgggagctattgacaatgcaaaagtgtacccagtataacagtagaatgatagtgtatctcttgagataacgtgtcaggttgttcgctaatgcctttttcatagaaatattgttgagctgccttcacatagatagaacatctgggtcacaaccactttgcagaaaagctaccaggtacagctttttgaaattgcctgcctgggtttaaattacagtcttgtagtaactctttggtgcattttagtaactgctgaaccgtgtgatgttgagtcaatcacattgattggaaaggaaatttaacgcatcagacaagggaaagttactaaggttagttgacatagaatgctcttaagttagttcatggtaagttatgcaagtagaggagatcatagataactaaataggcaaactgcaaaaagactagcagaagttggccaggcatagtggctcacgcctgtaatcccagcactttgggaggccaaggcaggtggatcatgaggtcaggagttcaagaccagcctgtccaacttgatgaaaccctgtctctacaaaaatataaattaaccaggcatggtggctggcacctgtaatcccagctactcaggaggctgaggcaggagaattgcttgaacccaggaggcagaggttgcagtgagctgagatcgtgccactgcactccagcctaggcaacagagtgagactctgtctcaaaaaaaaaaaaaaaaaaaaagactagcagaagcacatcagttgttactattctgtagcaagttcaaccagaatgtatctctttgctgttctcacagcaaaaattataaatgtttgaggtgatggatatgctaattaccttcatttgatcattacacaatgtatacatgtattgaagcatcatattttatcccataaatatgtataattagtatgtcaattaaaattaaaaaataacgatagcaacaactattactcccttatattacactactacaagcgctttgtttatagcttatatccttgggaaccttttttctattgcatatagaatgtatgatacagtctgtgctaaatgtcatagagcttttacaagccagataaaatttgagtgtacagttaagaggtcaaaaagccatctgccacaatgtagagcccatctcaggaaattaggatataaaaattttccagcaaatgatttgtaagaagtcatgagttttatggggaataactggttagcctggtaacagatctagtgagttctgaagaatcatatatcccatctatgcccatattgaaatagtggcagtgctaggtttgttctataatgcattgtgggtagctgttgcagccttctcctactccatatctttatttcatgtggtcactgaccttatattattaagtgtgtacaatatagatttaaagggtagacattgggtcacctttgatgaaagagtcttacttcaagaatatgtaccgtattctctcaactgacagtaattaatgtcactgatatggacagtattcatatcaccataatgaagccataaaacattgtggctaaaataatttgtgaagctcattttgaagaacttgtgaaaagctaggccttggtgccaaggatagagagaaaagcaacagtaatgaggaaagcactgacacctctttggaggaaaatgtggccatattgaccaaaatttaaagtgtgcacacttaggccaggtgtggtggctcacgcctataatccctgcactttgggaggccgaggtgggtggatcacttcaggtcaggagtttgaggcccgcctggccaacatggtgaaatcccatctctactaaaaatgcaaaaatgagccgggtgtgatggcaggtgcctgtagtcccagctattcaggaggctgaggcaggagaatcgcttgaacccgggaggtggaggttgcagtgagctgaaatcatgccactgtattccagcctgggtggcagagagagactctgtctcaaaaaaaaaaaaaaaaaagtgcacagtttatgactcagcattttcactttcagaatatttctttcagatattgtgtattttgcaaatttctacataaattaataagctttcagcattatttgtcatagctgaatcttggaaacaaatacgtctattaataggtgactgaatcaataaatcatgttacatttagagaatgaaaaactacacagccattaagaattaagatagatgtatacattttgataagaagcaatatgtccaagaagtagttctaagtgaaataaagtacagaaatgtgtgattagtacgctataatttatttaaaaacgtgcttacaaagtaatgataaatgattgaggtgacagatatcccaattaccttgatttggtcactacatactatatacctgtatcaaaataacacgtgtaccttgtaaatatgtaaaactattacctgttaatattatgcattatgtaaattaaaaattaaatgcccaaagccatgtgtttatacacatatttgtaaatgcactgattatctatatgtgacttaggaatagcagttttcttttagaagaactgagggtcttgggtgggagagctatcttactgtctaaaaatactattcaatatttatttttttctatgtggctggattacttaagtaaaagaaagctttgaaggcaaagctagtgtactgtgtgtttcacttaggacatcacttaagacaaaccaatagtttaacacaggaagattgttattgatgattggaacatactaaagtaaaaaaatctgtcctcacattcttttcatttcttcctataagcaataaaagagattcttacccttttgttcaaattgaaatctcccccttcacattctgtattccatcctctaccacagttacagggagcgagtacctttgcttaccacctttctctcctttccctgctcaaccttaccttacaaaaacaaaaacataattcttccttgatctaacatcccccttcagttttcatctctctcctctcctttagccaagccccatgtctataccggttctctgtatctctcattgtcacttcactcctcagcctacagcaatctggtttccttctccacaatgtctctgaaattttgccaaagtcaccagtgatttctatgtacctaaatcaaatggttacttgtaagttcgtgaattgtttgactttttagcagtgtttgaccagactgacaactctctaaatgaaaattcaaagaaaatcccattttctttgcttattttcttctgtttttttttccctctttatttacttttcctgtttcttttttggtattttgcttctccacctatccactatatatttatttgtgcttattatggcattgctggtggcttgacgttagacactctgctcttttctcatacatatttcttaggcagtatttcttaggaagtatatacccacttcaggtccaaatgccctttctgtgctagcagcttctaatatctaatatatctattaccctctcctgagcttgagacttttctgtccaatcgctgactggttgtctttacttggatatctcagtgacacatagttgaccatgtgtacaagtgaactcattgtgttacctcaaattttcccttctggggtttgctatgtcacaaattaattactttttggaggcagatttccttactgtgatatcaagagtgagtgaaaaaagtgtctggtgaatagtagttatttcacaaatatttattgactcaaggattgaatcaattaatgataccatgtatgataaatatcatcaaatgtatagtacagaacattttgaaacatttaagatattgaaagacaagacaccgaaagtgcagattatcctaatgtggtaaaattatgctacctctctaaggatgactatgaataacaaggaaaaagagttaatcaagcattaattccctgttaaatttctttctgcttaaaatatttggagttgtttttctatcttgtactgaactctgatatgtatagcaatgtatgtgtgaaatcctgtgattcaagggtagaaactaaattaaaaaaagggaagaatcaaaatttaacaaagtagctaatctttctgagggcaagttgtcaaaattttggcaatggtgttgagtgtatgcagtgtatgcatgaccaatatccagaaaggggtatcctggaagaggttgtatatagtactcatcttcactcagtgaatttttgactgaaggaaaatttttaaaaaatttattagatacaaagtaagaacccatggtcctgtgggctttctaaggtaaaaagacaaaaggcaagaaaagatctttgcatcaaagagcttaaagtattatagttaatttaaacatatagttgttttacattcttttaataaaggtttaatcatatgcttacatgaagaacaaaggaagcttaaatgttgtagttgttactctgttcaccagtattttgtttttcctcctgagtgcatgatagaattgtacctccctgacacttggaaattaggtgtgaccaaaagactaccctgatttgcctatcgatttctgaatagatgtaatggcatgcaattttcagatggaagttgtaagagctagtgtgtgatttgcctaagaaggatggtgacattttactgcagagatagaaagtgagggcatatgggcagaaagaccagcattagcaaacccatggaagacagggattgaatttatagacatagagatacctgaaacagggcagcaaaataatattttcaagaacatgttttctatcaatatttctaatttaattttatagcatctaagaaagtgatataccactcacataaagtcttaaacgctctacattttaattaaactttaattatatcttttaatttccatggctggctttaaattaaatttaattctacttaccaggattttaagagcttctgaatttgtcctatcctcaactttctgcaactgggtttacagctgtattttctcactactgttaattgaatgctgatggtagggatagttcttactattttttccccctgtaactatgttcacttaattcaaggtcctcaggtctctgtaaacctttgcattcaaaaaactaaaaaactccacactgcttcctactgctaaaggtttttcttatttctgccccacaggttttggctcaagctaaaggaaggattgtgcttgccgtgaatgtagataggcacaagatcatatatttcaaaggaaatcatattcaaattcaaatacaacctaatggtgatcttgtggtaaatgtatccactaacactcactttctattccttcctagtaattgttcagtctccagaaattatttccgtaatttattcctgttatttcagaattgagtctttgaagggaataagcccactgaattatatgttgatacagccattcacaaattgcttttttaatacattcttcaaaatgtaaaaatgttggtttcaattggtcactttcttctccaaacaatttttttaaagtggatcaaacatgaaataagtttatttctttctttatttttttgagacggagtctcgctgtcacccaggttggagtgcagtggcgcaatcttggctcattgcaacctctgcctcctgggttcgagcaagtctcctgcctcagcctcccgagtagctgggattacaggtgtgtgccaccacacccagctaatttttgtattttttagtagagacagggttttgctatgttggccaggctggtctcgaactcctgaccttaaatgatccacacacctcggcctcccagagtgctgagattacaggcatgagccagcatgctgggccaaaagaagtttattgctcacttaaaatctgaatgggtgctcctgattggcaggttcttcaagtgctgattctggaattcaggacttctctttgacttcatcatcttcataaatgtctttcaatgtcattgtgctcaatggtatcaaaaatcatcaaggcccttatatgggtagggcctgaagtgttgcacagcagttttaattgttttctctgaactagaactcggtcacatgaccacacctaactccaaaggggacccagaaatgtgatctacacttgaaaaagaggaaatggatttgtctttttcacacaattgatatcttaacttctgggttgactaacatctaccttgtttgatctatatgtggagaaaaagagtttataagaaataaagatgggtagctctgtggatttctgggcataagatccttctggatttagtgggcaagatcttcaaactgccaattgggcaacatggatgaaaaattttgggtcttgtgaataatttaaaaagcaaagaaaaagaaacttgacattttggagacaaacctgtgtgagtgttttattggtacaaacgtatttaacactaggggttttgtacaattttttgccttttctactagaaaacaatgtaaagtgatttcacaatgtgaagagaaaaaaaaattgccgctgtgaccaaacgcacagtctgttgtgcagcaacaatgggctttgatcaactcagtcgtgattcagctgtagaaatgcttttccttcaccttgtttgagcttttcctttctttcctgttttgatttgcaaaagaaaatgtcttttttgtgtgaacttgtgttgtactctgtagaaaattacgggttttactttaatggtttaagaaaaaaagcaggaagagccctcgtcgcttttcttacctcatcacagagtttgtgtagtgaatttaaaaagagaaaaaaaattgttacatatttggagcaagggagtatgtttttcaaaagaacctccttcctttttttgtgtgtttttccttttgtcccaatggggaatctaaatctgttttaactgcacagacacatagacaaaaagtcattttttatctgccaagtgtggtacctttgtttatttgttattaaactgtttagacccagaattttttttttcttctcagtttctgagattaacaaaatttgaaggtaatggtgcctctcatggcagaaaaagtttgttagcgcaaagataatttattaagattaggagaggaaactctggaaggaatactgctatgttaacagcctgatctgtgtgtgtgtaagtgtgtgtgtgactgcacatgagcgtgtatgcatattatgtagtttttgtctccaatatgattatctctgaagatgaaacatactcaagcctgcataatgcacgttaattgcccccactggtcccaggattgagatctccagagacagagcctcagactctggaagggataagtaatgaggaatggggagatttgtggcatgttctacatctgagtaaagcctgaaaggggcctttgtaaagaaaagaatcaaaaggtgccttacttagaggctatttgactcccgggcaacatttaggatatggaattatgggcaggtggagcagtaacttttctgtatctcgaagtccactttgtttcagatgttggtataaaaaggagcataaattttcatgactattttccttcacaaacagctttattattaggcttattagacacagaattaagaaattttgtcaaatagtaattttgtccttgcagattatcttcaaaaggattatattcttagaagacaggaaaatgggagtcattgctgcctgtctaactagttcaggcttaatttgctagtcaatgaaaaacaagatgtactagaagaatgaaatgttcaaagctttatggaaacagcattttgcaagaccatttggtgcaggtttgggcaataatttggactaactctcttgtttattctctttcacacagatacagcgtagcacatattcactcattgtgtgtgacttggagagaaaactttgtaggtggtagctaatttatttcatgaaatttaacattctgattcaaaagagtcaaaagaaaaaaggactggggaatctaagagatatccaacatgacccttcagtaggctaatcttttggtacagaaaggtcctcaatgcacaattactgtgctgaaagtggatctcgcctgtgagataccccatgcagaggactatctgtggcaaatggaaagtgaaaccttgctttttttttttttttttttccttgtcctcgttctctgcctcttgggcagaatttaattacctctgtcccttccctggtatttgtttgtatgtaattgccccaggtcaagctttttacactttttccttgggctattgaaataatttccaaatttttctgctaattttattaacctgcaccaaatggtcttgaaaaatgctgttttcataaagcttcaattatttcattcttctacttaatacatcttgtttttccttgactagcaaattaagcttgaactagttagactggctggcagcaagtcctctgccatgtgattaccgtatatttataccttatgtctcacaactttttgcaagtacacttgtactattttatactcttctctgggtataattttttgtatccaaatctttctacatttttattatatgcaaataacattttcccgccatcgttatggaaaattctatattttgtcaacgttcattttcttctcaaaagccttttgttattatttccaaatgaatattatgtgtgtctcagacaaccacagaaagttttgtttttgtcacattctactgctactgtgtcaatggcagcattttgatataggtggagggacgctcacatcaaccccataatttgtgtcagcttctcctgaagttatcagaagcatacaatttaagtaaaaacagtatcttcgctatccaaatgatgttccaaggtaaatctcctcagatcccttccagtacatgtatgctccaaggcctgccctatgtagaacttttggagccatcaacgtactgcttgaggttgctttgaacaaaaggtatttgacataagctctataagatcagggactcttttttattttattcattgttctttatcttctagagcaataatttgcaaaatgactatttattgaataaactaggacggaggtgaaaaggaaagaacagctcatccttccaaggggaagagagcagtatcccaaatccaaattgaagaaaataaacatatatctattcaccagaagagatagaagggagacagggcagaatttctgtggttcttactatctctgtcacctctacaggccaaaccagtgaggaccttggagactactaatatcactggatttgtgaatgagttcatcctcttgggcttcccctgccgctgggagatccagatcctcctttttgtggtcttctctctcatctaccttctgaccctcctaggtaacacatccatcatctgtgctgtgtggtcaagccagaaactccacacacctatgtacatcctactggccaatttctccttcctggagatctgctgtgtcagttctgacgtgcccataatggcagccaatctcatctcccagacacagagcatctcctgtgctggctgcctgctccggttctacttcttctccatgtgtgctgcagagtgcttatttctgtcagtgatgtcttttgataggtttcctgccatttgtagacctttgcactatcccaccttaatgacccatcacgtttgtgctcatttttgtgatcttctgctgggtgggtggctgtctctggttattgacccctttgacactaatatctcaggtgctcttttgtggtccaaacactatcgaccattttttctgtgatctggcacctttgctggcactgtcttgtgctccaatacctggaattactctgacttgtggtatcattagcgctctcatcatctttcttaccttcttgtatatccttgggacttatttctgtgttctaagcacagtgctacaggtgccttcaggcttaggaaggcataaggctttctcaacttgtggctgtcaccttgctgtagtgtctctcttctatggttctcttatggtgatgtatgttagcccaggttctggggactatcatgggataaagaaatttgcgaccttgttctatactttgtcaactccattctttaatcctctgatctacagtttccggaacaaggatatgaaagaggcactaaagaaatttctgaggaatcgccacactgtcgattgaaccagtgtggtgattcctcagggatctagaactagaaataccatttgacccagccatcccattactgggtatatacccaaaggactataaatcatgctgctataaagacacatgcacacatatgtttatcgcagcactattcacaatagcaaagacttggaaccaacccaaatgtccaacaacgatagactagattaagaaaatgtggcacatatacaccatggaatagtatgcagccataaaaaatgatgagttcgtatcctttgtagggacatggatgaagctggaaaccatcattctcagcaaactatcgcaaggacaaaaaccaaacatcgcatgttctcactcataggtgggaattgaataatgagaacacttggacacaggaagggggacttcacacactcgggcctgttgtgggtttggggggggagggatagccaaaaaaatttatgtatgtgttatagtaggaaatttctaaaggatccaagaggcaaatttaatataattcatcattaatgtttagaaggatgaaagatgatgagaccaatgagatcatgcttttttccattttattctacttttatatattgggaagataatttgaaagaattaattggacccatggtttcagtcttaggaagttattactattatggtccagatatgtttgtaccttaaatagatttttttatttttgcaattctacttaatattttcatctatttctctaaaactgagcttctgcttactcttttggttttcagtacatactgtttggtatgtttcaacatcctcagattctgccttcattgaagcaagttgtttcattttttttgagagcatagcaatggttgaatgtattgcaactatacaaatagttttccactgatccttcaaattaccagattaaaacacacacacacatacacacccccaaaactctcaacaattcagggacaattttaagctctgcctttttattctttataatttgaagtataacttctggggctaacaagggccttcaataatattatgttgacttgattgacacctcacattttgccaatgctaacactttggcatatgtagacacaagaaggtcaggtgatgcccagtgcaaaccaaagagccatagaatctgtgagatcgctgacaatctaggcctactaagcacttttttgtgtgtgtagttcttcattaaactctggaaaagtgttcctcgggtaagttctaccctctaatttatttttttgagtagcaatttattaatttgcagtactgcactccatgaggaaatcttgtgctaaatcttgattctggggtaactccagcactgactttactaccaaagtgtagttaaatatttgcagcattctgctggatatttttacatgacgatctatttcaaattcaaatgtctaatcctaaatttgttaatctccttttaaattagctctagccatccttattttctcatggatctgttgatttatagcatgaacttgaaatcttgacagtagaattccttaccatctcattcccacttctaatctgtcattaaacagattaggcatcttccctgggatcatttgtcatctttacgctcgtcttttctgtgcaggttcctagcactccatatctgtgatggcataatcacttcataaatggtctgtctctgttatctcccatgtcaaattccagaattatgttcttgaacctccatcacttattttctctctacctaaacacaggaaaaaatcccaaattctttagcttgtaaatgtttttaggttctgaatttcttcttaaactttatttttaccttaatatatgtctcatcactcccatttgactcactctctctaattcacagagtataatcttagttttacaacctgagcttaaaattgttctattcataccttgcccatgtttagatgcctcatacgaaactttccttgcccactgcagtatatcataatgttattttctaagttcattgccttttgagttttgccaaatatttactcaaaattggtctgccttttgggtatctattacagcattgtttgtgctattttttactttcctaccagttagaatataagtttctttagggcaggaaatatgatctttttactgctcctgaatggcttctgcaatagtaatagctcaattattgagttaacaaggttattcgacaaacatttattgagctcctattatgtattaggcattatctgagcactgaagctatagcagtgatacctattcccatgcagtttatattacagtatgggaagacagggatcaagaaatagagaaataaatatgtaggatacaatatttcctgtggtgatacattctttgaagaagggcaaagcagatgatgggaatagatactagtgagagtggggatgctcttttaaatagaatagtctgggaaggcttcatttaagctaaattttgaggagacctataggaagtgagggagttctgtccttcctatttcaagtttacggtgagcaggaaagcaaggcaatcatcaaaatgagtgtggaaatgctctaacaagtacacttagagatccaaatccaaatggtggctattaagaaaggcaagaagtttggtttaaaaatgtgcctgaagatgcaccattgaaaaatggcagcagtgtgcagggacaatgccacctaacccgcgttcagagcgaagccacctggtcggccaccggcagcttggggaagaagggcatgtggcgcgcccactccaccttgctgaagagcagccgtgaaatttttaataatatttttatttaacccaactcacccaaaatagtatttcaacatggaattagtataaacactattaatgagatgtttacattctttcatcccaccaagtgttcaaaactggtatttgattttatacttggagcacatcttaattaggactagtcactttgcaggtgctcagtaaccacatgtgggtcgtggctattgtattggacagtacaggttaaagagaggtctaaggactaaatacagacctcaaataatattgaggttaaacaaatactaaattgactttatttttcagaatgaagtttctttgcctggagagaacaagcatgctcttatttcacgtattttcctaattgaaatcctgattttggcaggggaaagaacccactgagtgtgctacatgttggaactagtgaccttacacatccatgctccatctcctgggaaagtctttcctgaagaattgtatcttcagtctgtttgtcctgatttgtcccaaactgacagaagtacctgcagagctggctaaaatttccctttcagacattgctgtttaggtgagagtacagagtggttgggagggtcaatcagttgtagaacaatacttaggtataatccaatttatatacccactcaaaacccagagattttgcttctatatgtacagaaagaggacttagaaatacatccaccaaactaaacacgttgctgaggaggcatgtgtgtgtgtagaggtgtggagatgtgaaaattttcactattttatagtttttttctttacaacgactattcactataaaatatatgatttatttgtataattaaaaagtagacaaaatggaatacaattcatttcagtgtagctaagcaagccccagttagtaaaacttttatgtttttatgtacacatttagactaaaaacatactttaaaatatttcaattttatatatgaacatctttttcaagcacaatgagagcttagatacaagtgaggattttagttattcagttaattatggttcgttggccccctcccccaagtctaagaatttttggcttaaagagaaagagtaagtgaagaatcctctatatccattcttcactagttctaagaaagatgaaaggcaagtgcacaacactaaatctcactgcagcttacagagattttccagatgataatttatttacctttagtttaactttttctctcagaactccagataatgcagtagtaacttataagcagcacagtatcttctaacagcattcatcatgagatagacaagtcctcaactacccgagacagtgttttaccccttactcatcctgctcccctttcactgctgttgcataggtggataatttgatttccaccctgtgtaatctctagaggaaacatagctcagagatatggaatagtcaaaatgaatgggttgtttgagttatttctctctctctctcgctctgtgtgtgtgtgtgtgtgtgtgtgtgtgtgtgtgtgtgtgtgtgtttgctgtccagtatctccatccctttttatgtttgaggtaatcccaatattatcaggcttggagcttctatttatgtaattgttgtttatattgccagatattagctctcctagcttcccttgcacttaaagttgtaggaatgtactcttgcctttaccagatacagctataccaggctttgaatcaagaagcagaagtaggaagagcaacaatgttgaaatattggcataagaaatgacaatgaacaggctgggcgcagtggctcgcgcctgtaatcccagcactttgggaggccaaggtgggcggatcacgaagtcaagagaccaagaccatcctggctaacacggcgaaaccccgtctctagtaaaaatacaaaaaaattagccgggcgtggtggctggcacctgtagtcccagctactcaggaggctgaggcaggagaaaggtgtgaactgggaggcggagcttgcagtgagccgagatcgcaccgctgcactccagcctgagacggagcaagactccgtctcaattaaaaaaaaaaaaaaaagacaagaaggtagcacacttattgcagaaaagacaagttcctagaacagaatgacagtggtgctcatgtagcatcttggtggcctatagcacagccatgactgcagtcatgatttttcatcatcagttctgcatggtggtttgcatatgtatctttgaatttgagcctcaactctggctctttagctttcattggttctgtgagattcctgctactccatcaataagtcctttttcatttacataatcagctagagtcagcttttattggatgtaagtgagaacactggcagaattatactctaatagagttatctcaggtgggtatagtctctacaatctgcagagggcaagaagaactaacgctttggcattgcaggttgctctgaattctcccttagctccacagtggtctatgaagctttatcccttaacgtattttattgaagaaaatattccaaaagtcaaaataacttggaagaggattttaagatgtctgtgtgtgtctggatttttttcacttagcataatgttctacaggttcatccacatcgtcactaatggaagaatttctctattttttaagggccaaatagtattccactgtgtgtatatatcacattttgtgtatctactcatctgatgacaaatacctaggttgcttccgtgtcttggttattgtgaataatgctgcaatgaatttggaagtacagatatctctttgacatattgatttcaatttctttggatatatgcccagaagggaaattgcttaatcatatggtaattctattttaagtgttttgtggaacttctatactgttttccacggttatattaatttacatttccaccaacagtgcacaaatgtttacttttctctgcaccctcagcaatacttatctttcatctttttggtgatagccattctaacagatatgaggtgatacttcattcagttgaactcttaaaagtagagagtagaatggtggttaactaaggctggagggaagaggtggctgaggggaggagagatgttgatcaaaggatacaacaattcagtttgatggaaggaataagatttagtgatctgtttcatagaatgtgactataataaataataatgcaccacatatttagaaactactaaaagcgtggatttcaaatgttttaaccacaaaaaataagtataggagatgatgaatttattaattagcttgatttaatcatttcacaatgtaaatgattatcaaaacatcacattgtatcccataaatatataattatcatgtgttcattagaaataaaatttaacaaataataaaagaggtatatgttcacagaaaaaacttgaatatgaagtctaatgtagactggatgtttttagtcaaatcattaactttctcttcaacatattggagacaacatcacaaacacctctctttcctatccccctaatttttgtgccttagttaaaaatatgaaaatttcagagtgttggcaggtgatcaggttaagtaaagaagtttatgttaagtggtgactttttttaattttttatttatttttatttatatgtattttttattatactttaagttctagggtacatgtgcacaatgtgcaggtttgttacatatgtatgcatgtgccatgttggtgtgctgcacccattaactcgtcatttacattaggtatatatcctaaagctatccctccctcctctccccaccccacaacaggccccggtgtgtgatgttccccttcctgtgtccaagtgttctcattgttcaattcccacctatgagtgagaacatgcggtgtttgtttttttgtccttgagatagtttgctgagaatgatggtttccagcttcatccatgtccctacaaaggacatgaactcaaacattttttatggctgcatagtattccatggtgtatatgcaccacattttcttaatccaggtggtgactgctttaaggtagcttatattttggttgatagagttgattccctggtatcctatgtttattttctgtaacggtagatgtttcttcactataagctcagaaagtatagaagcccaggtttgagtaagaaatatttaattatttggcatatttgaatgtatgcatgcccttctatgcattctcttcagagctggaacaggaatttcccttaagaatctataccatttctagtttttatttgctgcgcaccatgaacaccttaccaagacttagtaataaggaaaatacaaattaaaaaacattcttgtttcagtgacggattctcgttctttgatattatagataaagcaatttaatttttgtgagtacagtgagtagatgctgtttttcattatagaaaaacctatagttggcaaggaaaaaacagttgataaatttaaaacacatttaagatgcataaagttgcattaggataaagccaaaatacaaattagaaacatgggtcttagctttgtacataccaactgaattacatatagttttaggacttaaaaaatctccaaaatggaaaaatgatacatagatgaataaaaattgtacagatcttacctacgatgaaacttaggactttgtatactttttgctttgagataggatcagggctctttgtgtgtaatgagtcacgcttttatgagtaagaagccaagtgctcagacatcaccagaaaatagttttttttaaaatgagagaaattttgcatttcttatggaataattgtagaagaatgtatatcatttcagtgtgttccaagatatttcttttgatggcactcccagcacttttttaagggcatctgtcatatctttgttccagagactgtaggtcaggggattaaagaatggggttgctgtgcagtaaaacaatgtcacaaatttctgtgtcccagggcggctcctggagcctggactcacatacatcaccatgactgagccatagaagaaagaaacaaccaagaaatgggaagcacatgtagagaaagctttgttcctgcctgagccagctgggacccacagaacagctcgcaaaactaagatatgggacccaagaatgtagaggaaggtgatgaagatgatgagagagcttactgtagcacaagtcagagtagttttgggaactggggcacaggacagtgccagcaatggtcccaggttacagaaaaaatggtcagtgatgttagggccacagaaaggcactcgggacataagcactgcaggcatcagtatggatagaaaaccacctgccctgcagaaggccactaatcagacacacaggtggtgagtcatgactgtgggataatgcaaaggtcgacagatggtaaggaaccgatcaaaggacatcacagacagaaagtagccttctgcagcacacatggagaagtagaagaactggagcaggcagccagcataggagatgctcttgatatgggagatgagattggccaacattttgggacatcagaactaatgcagcagatctccaggaaagagaaattagccaagaggatgtacataggtgtgtggagtttctggcttgaccacacagcgcagatgatggatgtgttacccatgagggtcagaaggtagatgagggagaagaccacaaagaggaggatcttggtctccctgcagcaggcaggggaagcccaggaggataaattcactcacaggcccagaaatgttattggcttctacgacactcattcttctaatctatgaaggaaatgaacgatagggaccactacaatagccattttctctctcttaaagtgttatatttatttcttttgactccaagacaatcttttaatgcacttttgtgaaaagttccatatagttctcaattcaataactcacctcccatctttgtcttagttcaatgaaatcagggttatgggagaatgtggctcaacatgttactacgtgatcccacagcctccactatatcatatctctgtttttcagagtgtaagtttcattgacatcacataacatagggtccaaacgactttctctatttgcatttaaattaattctgctttgatgtaatgttttgtaatacacatattcaaatatttatacatataatttctccctattagaaaattttgtattgtattttgaaaaattctaagaaaaatcagtttaaacataatctaaaattgaattaggtcagtacaaaaagagaacctcattatgttgtcaataaattatgtttttaggagatctgtcctggatagttctgttgactgaagtagggtactgaggatgctgccacagatttcatgctagcacgtgtttgtttgctccgtatagtggcatttaacttctatttgctgagcaacagctaatttgacacagaaaagttgccttcaaccctttactaggaagatcttgctctatgatagaaaaacagcaagaggcagatggaaaaacatctatttccttagctcagatgccttctcatcttgttactatactggtgatgaattatcttatattaaaaaataaaccataaatttaactttaaaaatgtgagaggaatacaccagtgtagaatgttagtgtcagaaaggacctctagtcttattaagctcaatttcctcgtatcacagaaactgagaccagagaggttagaatgatccaaagttatgttggctgttagaagaaagaggcctaaaacttaggtgttcatatattcagttcagactttttctcataagcctctgctattgtgggaccctgctttttttgtcagctcagatggttgcaaaagtatattgtgtatgtattatactgttccttcctttgaattagatccctatttataataaaggaggacattaaccaggttactaaccaaagctgacaattgctacatcatatcccctattcacctttgacctgccctttgccctaattcttggcaccatttatggcataaatctacttttggacactttctttaaagaacatttgacttctaagatagtaagcataacaacaaccactgtcatgtattaaatgtttattgtgacagttacataatgttcattatctcattaaatcctcctcccctctcctctccagttttagagtagaaaaacactctcacatgtttaaatgtaccatttgaattctattgtgcttctaaatacattgaatctaaaattcaagtttttattctgtccagctttcagctatgtatataatgtgctagctgttttctctcattgcatctgattccatttgttcacatgtaacttgcttctatctaatttttgcttgtgaatttgaaagatttgcctctggacatctgtgttaggaactgaggttatatatcataggaaaatattatttacatatttcttatagattatgtagtttacattagatacatcacctgaggccaggtttgtgtccttcccttccatgcagcgagtcctccaggccccaggtaggtctagaggtgttttctggtacccagggactggagtcaaaaaccttagacgtctacctggtgttctattatactgcaactgagctggccctcaagccacaagacacagcccttcccactcttccctcttccttccacaggcagaggagaatgaccctgtggccaccaccatcacaggcctatggtgagtaactgccacactcccacctgtgtgtacttaaggcccagaggctcttcagtcagcttgtggtgaatgctgctatgcctgggaatcacctttcatggacatgggctcccctctggcccagagaagctccagaaatgccataaaagagccatgggctagaatagggaacctcaagagcccccttgatgcactatgcccatttgactgtgctggtacttaaggtacaagacaaagtccccttgacctttctctttgcttctctcaagcagaaggagtctgtcactgtagtcaccacagctgggaatgtgctaggtctcacctgaagctagtatgtcttgagtctcacccaaggcatatggcatactatttgggtgttgcttctcattattcagggcccaagggctctttagtcaataggtgatgggtcttgccaggactggttctttccttcaaggcagcaggttcccttctagcccagggtgtgtctagaaatgtcatctcggagctagggcctggaatggtgcctcatgacggaccaatattctttcttactgtaatgagctgggatctaagatgcaagacaaagatcatctttactcttcgctttcttttattcaagcagaagtaaaggatctcttttggagccacgagctgtgctgctggggttaggggaggtgtgggcaaggactctcttagctgccccagctgttgtttcagtaagtcatgtgttcccaagtccattggctccaagcccagctcagcaccaggacttgctgtccttgtggcctagactgcctgtcaaatttatttaggaccctagagtacgccagctcatggcggcaaggcttgccagaactcaagctccatctgctggagtgggcaaattgccctctggctggaccttgtctaaaggctccctctgtgggtctgtgtcagctgagttcagcacagttttgctttccactgtgatagggcagcactgagttcaatgcaaagtctcacgattgctgcactttccctctcccaaacacacatttctctgtgccatgtggctgctgtagtggggatgagggagagttggcatcaacaattcacggctctctttctgactctctttagtgcctctttcaatgatacggagataaaaccaggtattgtgagtgctcatattatttttggttcttatgaaggtgctgtgtttgtgtagacagttggtacatttggtgttcctgtgggaggacaattgatggagccttctattccaccattttgctccagccacttccaaatgctttttctttttcttatttatttatttttgagatggagtctcactctgtcacgaggctggagtgcagtggtgcaatctccgctcactgcatcctccacctcccaggttcaagcaattctcttgccttagcctcctgagtagctggggttacaggtgcacaccaccacacccagccaatttttgtatttttattagacatggcgtttcaccatgttggccaggatggtctcgatctcttgacatcgtgatctgcccactttggcctcccaaagtgctgagattacaggcgtgaaccactgcacccggccccaaatgctttttctgaatctatggagattatatgtttttagtatttttgttaatgtggtgtactacatttattgatttgcatatgttgaatcatccctgcatctcaaggataaatctctcttgatcatgaggtgtgatacttttaatgtgctgttgaattctgtttgtgagtatttaagtttgttgagaatttttgcatctttattcatcaagaatattgacctgtaattttcttatcttataaagtctttggctttgatatcacagaaatactagcctcatttaatgagtttggaaatgtggtttttcttcaataatttggaagagtatataaagaactggtatttttaaaaaatgtttggtggcatttattaacaaagccatctcttcctgagcttctttgctgagaggtttttaatcagttttttattggtgatgcaatcttcttattcactattggtctgtttaaatttttggtttcttcatgattcagtcatagtagggtgtatatttccagaaatttatcatttcttcttggccttccaatttattgtcaaataattgtttatagtaatcccttatgatcatttgtatttttatggcatgagttgtattgtttcttctttcatttctgattttatttatttgagtcttctctattttttcttggttagtctagctaagatttgccaacattattttatatttcatcgattatttctattgttttcctattctgtatttgatttatttaatttctgttctaatctctgttatttaattcctttggtaaatttgggcttaatttgttcctttttacttccttgaagtttaaagtaaggtgggtttgtttttggacatttttcttatgtttagagtagatgtttattgctatactgcctcaataccactttagctgcatccataagttttgttattttgcgtttttggtctttttttataggtagatacattctaatttccctcgatatctttttgacataatggtttttcaagagtgtattgatttccacatatttgtgaattttctagttttgcttgttattgattttagttttatatcattatagatagaaaagatacttttcctacttacataatttctatattcttaaatttacttgtgcttgttatgtggcctaacagatgacctatcctgaaaaatgttatatagtcacttgagaagaatgtgtattctgctgtcactggatagttctgtacatgtctatgaggtccttttgttttataggatgtttaagattgctatttccctactggttttctgctagagattcattcccattattgaaagtggcgtaatgttgtgtctcattgttattttattgctgtctatttctcccttcaaatctgtcaatgtttgccttatatatagttaggtactctgatcttgggtgcctatacatttatagttgttctaacatcctgataattgacctttttatcattatataatgaccttttttatttcatgtgactgtttttaacctaaagtctatttggcctggtataaatttagccactcctgctgtcttttcgttatgatttgcatggaatatttttttccctcccttcactttcagcctttgggcatccttgaatctatagtctcttgttgacagcctatagtttgattttattttttaatgcatttggacgttctttgtcttttgactggggaatttttaatccatttacagtcagctggatgtaggttccacatccacagagtcaaccaaccatgcataaaaaaaatcacacacccccataaaaataacaatgataaaaaatggaataataaaagtaatgcaaactagatggtgtaacaggtatttatatactgtttacattctattagatatgataagtaatctagagaaggtttaaagtataggggatggtgtgcatgggttatatgcaaatactatatcacttaatataaaggactttagcatccataaattttggtatccacaggcgatcttgaaacccatctttcatggatactgtgggacaactgtatttacaaagttgtattaataagtaaggacttgctatggcacttcattttattttttctgtctgtgttataattcttctttcttttttctcttgctgttttcttttgtgttcattgatatttttgtattgatatgtatttatttcctttttcttttgtatattttctgtagtattttatttttttggttaccttggggcttatgtaaaacatcatatatatggaggcaaagtttattctaagctaataacaactcaactttaatcacataaaaaattctgcacttctcccactttgttattgatgtcacaattacatcttttatatgtgtatatctactattatacttctgtagttatagtaatttctactttgttgtcttttgactttcatattagaaaaaggtgcaccaccattacaatgttgcacaattttgtatttgtttaaataattagcttttccagtaagttttatattttaatatgcttagttatgcttagttttgctatttagtattattttgtttgagttaaagagctcacctgtcatttattttatgacaaatctagtggtgatgaagttgtttctctcagcttttgcttgagaaagtctttatctattcttcatttttgaagaaattttttttccagaaattgcattcttggttgagaatttctctctttcagcattgtcttgcttcttcaaaattcactctttttgacttttgacatataattataatatgtctttgtgtggacttcccttgaatttgttttatttcagttgcatttggcctcatgtatctgtatgtcctttttcttctacagatttggcaagcttttagccagcactgtactttccttcttatttttctcttctccatctggaacttttgtgatcagtatattatttcactttatgatgtaccttaagtccgtaggttcattggctcttttttattcttttttcttttgctcctttgtctatgtaatttgaaatgactggtgtctggattagctgattccttcttctgtttgatcaagtctacttgtgaacaccccctagtgattttttttatttccgtcatagaattcttagctccagaatttctaattgtttcttcttgtaaaatttctatatctttacttcaatatttttatcttgctcatctatcattgttgtgatttcatttaattgtgtctcagtgttctcttgtggcatgctgaattatcatggagccccagagctctcctttcctcatgtgtgctgcttctttcatatgtgataactataatgaactttaacaaatctcaaattcgagtacattcccaatcaccttctaaaagtaacctcctaacctccactgattcctcagatgtggtagtttgaaagttgttcccatagatttcaactacaggccaaccagaggggacccatggccactagaatggtccagtgacctttatacttcagtgtgtgtaagaatcacctgggatcctatttaacattcaagtttctgagccttcccctagccagtagattttatatacaaaatgtgagggaaccattacccttttcaagtgattaaaaaaaaatcagaggtgaagcaattagatttggctacatttaatttgatgttttatctttcaagagattgggatggttctagtgaaaattatagctaatctgaatacggcttctaactgttactgggtgtttatgtcatttctttactctgatcaacaatattgggcaggtgtagtggctcacgcccataatctcagcactttgagaagccaaggcgggaggttcacttgagcccaggagtttgagaccagcctggacaacctggggagacctccatctctgcaaaataaaacaaacaaacagacagacataaaaacacctagctgggcgtgttggtatacacctttggtcccagctacttgggaagctgaggtaggaggattgcttgagccacaaggtcaatgctccagtgagccgtgattgtgtcactgcactctagcctggaaaacagagcaagaccctgtctcaaaaaacaaacagcatacgtcttattgttttgttcgcttatttctgaaataatctcgttagtaaagcactatacttgataaacagtctgatttaatgaataaggatttaaactttagattttggagagacaagattaactaaccgttgatcacaaggagcacactgtgcaacaagctactctgataggacaaaagtcctaggagggctatataagcaaaatctcactcaaggactgaactttaagccctattcacttttagctaatcaagtgatgggcaagttgacatctatagggaagagagaagaggatgtgtttctgagctttccttcttcagtcaggcaactctgtgattcattaatttcctcccttcctcctccacaccctggcatgttggcccatagccacaaggtggcaggataaccagtaacattttattcaagccaactgaagccctgcgggggctttgaagttcacacacactgtccaccttccacatactgatgctgggagcaatttagagcaaacatcatccagagtcatattactagatgactggattgcttcttttgtccctcaatcctgctctcctttcagtgctaactcaaggaaacactaagtttacactttgcaggagcccctggaatagttaaagctttaaaccatttcacatccaactcaatgatctgttacaaaaaatacctgttgattttctgtcattttaatggatacctagcttccttttataaattggcattacaatagtctggtattagtattgatctggaatctatgtgcttccagatcagtcccattccttttacttttagaataagacaaaatgtagctcagacaccattcttccatgaaaccacatctctctaagaagatgctggaaagtcagtctttctcaaaaagtagttttcccctcaagtttcaacacattactccactgtaagtttagacagtataaatatgtataaaatatatatatataatatatatatattttagtataatattatgcttcagcttttcctgcatgtttttctttcttttctcttacacccttctctgtgatctcatctgacaatcactaccatggcaaccaagcctctgtgacgttccagcaagctcattgtcttctcttcactaaactttagttagtagttggtcccagtcagtaacactctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggtaagaataggttgaaataacctggctggttgtgggacaggccccctctgtgagtggtgcagttaaggacacccagactgccctttcactctgctttccctggggtaatgtgtatggctcctagtctttcacgttctcttctgtaattcgggaggaggaagagaagatactcactgcacatattgtgtcagttaatactaatctgagagcaataatttacgatcttttgaggtgaggtttgatttttaccactgtgctgttcctgtctcctaatatgttgtatcagattgtaactaagttgaggtgagaattaattgaggactatatatttgagcctccttagaatctcacccacctttgagataacttcatgttttaggttttctcaagtcagagtgttgagtccttaaatcagtatatgctgggcagtgaaaaaacactggtacactttgattgcctaagcttagtgaacagcaggggcggtgggaggcaggcctttttaacacctgtctttgctgagtttcatgctgaaaaagccttgaggctcagactcagcccacaggtctctgcagtccctccatctcccttctgccctttccatgcatagccttcacagcagttttttgtgaattatttatttttttgagctctctcttaaggttaatttttcttaagaagtatttactctcaatattataaaggtgtagaagtttattgtagagaaatgtgggaaaacatattggcaaaaagaatataaggataaaaccatttaaggtttccccttccatctatacttatatttatagttgggctctaatggcatttaaatgcaaaatgtaatatacatgtttatttatatttttaaaatattaataattgattagttaattcaacaataataattgttaacattccagacactactataaatactcatgaatacagcagtgaacaaaatggataaaaattcctgacttgtggaagttatattgtaatgggggaagacggggtaaataaactatgtggcatgcttggggggcgatgagtaaagatggagaaaaattagaaggttcaggtcaataggaagtgtgtgttggaggtgacaggtggcaggtgtacatttttccctcagcttaattaaggtttaatttgaaaacattgtatatatttatggtatacaaggtgatattttgatatatgtgtacattgcaaaatgattaaatcaaactgattaacatatctgtcacctcacatgcttgccattttattgttgtgagaacatttaagatcaactctcttagcaattttcaagtattcttttggcccttagtatctgtggttctgcatctgcagattcaatcaatcacagatggaaaatatttagaaaaaaataaaaataacaatatgacaaaaaataattcaaatatatagtataacaactatttacgtagcatttacattgtcttagctactataagaaatgtagacattatttaaactacatggaaggatgtgtgtaagttatatgcaaatactgcaccattttatatgaggcggttgagcatctgctgattttgttgtctccagggtgagctggaactagtctcccctagatataaagagacaactgaacaatatgttattattaattacagtcaccatgctatacagtacatctccagatcttattgatcttgtttagctgagactttgaaccctttaaccaatatctccccatccccactgggtgtaattttcaatagctagtcagggaaggcctcactgagaaggtgatatttgagaaaagacttgaaggaagtgttggggcaagaaatataaatatctagcaaaagagcattacaggcagaggagatggtatgtataggcgccacaaggcagggggatggctggcatgcttaacacacagcaagaaagcctcatctcttcttcatgcctgcctcacattcaatatatttaaatatggttccttccccatcataaccctgcaatggccattgcagaaatcaccaataacattcatgtgtctaagtcttatggacatttttttttcaagatgtatctcttctcagcagaattcagcactgctgttccaacacatttttcctttgtggcttcagtgtcaactctattctactttgcctcctgattgcccagaaaactcccacatttctggctacaactcctctatttgatttgtgggcttcttttcctttatttggccattaaattctgaagctctgtgaggctgagttccaggccttcacatctttcaatgctatactattgtctaggtcattttcttctccaaagctttggttattacttatttgccaatgagtatatcaaattgttaatacaaattgcatcctcagagttccagatgacaactgctacatggtattaatatttgactgctggatgatagttttacttgaatgtttcaggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttggtaggtatcataatctctggtaggagaactgggaagtggggcaaagacccttataaagagtgaactatgaagcagttaccagaatggataactgtggattaaacttggaataactctgagatccagtgtagataactcatctcagaaacatgctgagagataaagggtattcgtacaacagtttctgatagtcattagttatggactgtctcctagcggcattgattcctcagcatgcccaacctgcagcagggacagcaaaagcggcttctgtgatcagagaaagccctcaggtaaggaaatgcaggggtgaatgctggaagtcaggctggcatgcactgaagtattagggtgaggcgccatggcaaggtatctgaccatctttctaaccgttcacctccatttccaatctttaaatacattttacttcccaaatatgtaataatatgcatttccttcaatttctaccaccacctctactgactgcctccatctttttcaaatatacttgcctcattcagcacattcacattgtgcaaccaccacctcttttgagctccaaaacactgccatcaccccatagaaaaccccagtcctcttcccctccatccatggccgccacctggagtgtgtttggcccatggaggacactgcacattgttggtgggcatgattaaatagttgctgcttttctgcagtcatcactgtattttgagtgaaagtttcataattttcagtgttttatctgggttgataggatccaattttagtttttgagtttcttttttgagcaactataacaattttaaggattaacatgtcatgacatttattctttactagaggtcttccaaagaacaaagataaatttacttattttaaaaacagaataaaattcatcctgtcttgcaaaaatacacaaaaatacaaaaacaaatatacttgcctcataattagtttcacatttacccttgtccttctctaaactcttcactaccgtggccacagttactgtttcaaaaagggagatgaaatcatgtcatattctattctctgtgcctgaaatccacttttcaccctcatctccctttatttaaagtatgttattcatttttctagggtctcaactcaagcattcctttctcaagaagccttttatggtatgaagagtgagacagagttccctgcgccacctccattgaatcatgttaggccttaatgtacctttcctttataacacttactgaatgattaatttggcatttatttacctggctattttattcagtgtttaggatttatactagattgtaagctcctcaagagtgttccaggtctagtttaggtcaccatgtatccctgattagtaccacacatcccagtgcaccatggttctcaacaaataacatgttatataaatcaataaatgacaggaacaaagatgtttttcaatttgtattacaatgttttctactatctggcagaatcttagtaggatttaatagaaatcaggcaatgtctactccttaacctgactttgagagagaaacactgatttttaagaatcactcccaattctgactttttctcatcattatgtgggtgaggtagagatatttctgaggcttttttgttccggaacttgtctccttggacattttaactaggtcatcactagatcattgctacatgaggtatggtctattgaccagcaacatcagtgtcagctggagacttttagaaatgcagaatctccattctgactggtgtgagatgatagctcattgtggttttgatttgcatttctctaatgaccagtgacgatgagcttttttttcatgtttgttggctgcataaatgtcttctttgagaagtgtccattcgcatcctttgcccattttttgatggggttgtttgtttttttcttgtaaatctgtttaagttttttgtagattctggatattagtcctttgtcagatggatagattgcaaaaattttctcccattctgtaggttgcctgttcactctgatgatagtttcttttgctgtgcagaagctctttagtttaataagatcccatttgtctattttgacttctgttgccattgcttttggtgttttagtcatgaagtctttgcccatgccaatgtcctgaatggcatcgcctaggttttcttttagggtttgtatgggcttaggtcttacacttaagtttttaatctatcttgagttaatttttgtgtaagatgtaaggaagggatccagtttcagctttctgcatatgtgatcactaaaaagtcagaaaacaacagatgctggagaggatgtggagaaataggaatgcttttacactgttggtgggagtgtaaattagttccaccattgtggaagacagtgtggtgattcctcaaggatctagaactagaaataccatttgacccagtgatcccattactgggtatacacccaaaggattatacatcattctactataaagacacatgcacaagtatgtttattgcagcactgttcaaaatagcaaagacttggaactaaaccaaatgcccatcaatgatagactgaatacagaaaatgtggcacatatacaccatggaatactatgcagccataaaaaaggatgagttcatgtccttttcagggacatagatgaggctggaaaccatcattctcagcaaactaacacaagaacaaaaaaccaaacaccgcatgttggctcactcatcagtgggagttgaacaatgagaacacatggacacatggagggcaacattgcacactgggggcttttcaggggtggggggctaggggagggatagcattgggagaaatacctaatgtagatgattggttgatgggtgcagcaaatcaccatggcacgtgtatacctatgtaacaaacctgcacgttctgcacatgtatcccagaacctaaagtatatatatctataaaaagaaatgcagaatctcatgcccctctgactcaataagcattttaaaaagtctatcagtattttgcatcactttgttcctccaagccttggcccaacacctagcacataagatgaagttttgggtgatgaatgaatatgctaaaaaataagagtgaaggaatatatgaaaggagggaaagaacaccatgggaaagtgaaaatatatcatactatgatatttgagtattagatcctgacaatttagtttcaacacttttggttttgtatgatatgaggaaatagtgttcactttgtcggtattaagctcataggtgttaaagcaaactaaatatggcctgagaaggacttgtacttccatatttgaatccttgtggatgaactgtaacctagcttaataggcagacaaaattgaaaacctaacttacgagtatgcacctgcaacaaatagctaagtcttagccaatctcagtggccatacttcaatcattaatacactgatgaggcaaatgccaatctgtaaccaatgcagctgttcctgtaactcactgctgatttctgtatgtcatttcccttttgtttgtctataaatttaccaccacatggctgtgctggagcctctgtgaatctgctgtgattctgggggctgcctgatttgtgaatcattcattgctcaattcaactcctttaaatttaattcagctgaagttttttcttttatcatatgtctggaaaaatcctataagagtaatgtaaacagcatttggtttccagggtgggatgcagttccaggagaaaggataccattcatttcttctgaacgccttcaagagacatgtgaatgataaatgtgcctgataacatctcaggcacgtttgtgttatgagaggaaactaaggaaaatctgaaagtttcttgggtgtataaatagagatggctggaagaagatgggggaaagtgaaagccataactgttgagaaaattaagcttgttgaaatatgcaaattgggtctcggctccatacacggtgctgatagttaggacactgagactgtctcaagaagacaaccttaaaggcctgagaatccagtctgtttccctcttctagggcacctccttcccagaaatgacaccattaacactttttagcacttatgtaaaggtctggatcatttgaagttacatgccactgtaggacattttctctctgagttgttggtagacatttatactgtagagaaaattttgcacaatttaactatttagaaaatgaaacaaaaaatggacaaatatgaaaaatatagaaaaattattaatggcacagttcatttacatcaaattgttactaatactttgctgcattactattttttctactttgaatcatattatgactaattttgaattctactttttattctatttttatcactttaatagcctatcttaagtctttacccatattttgggataatctttaaaaatatttactttaatacggggaagcattctatcatgtacacatactacagttcttaacaataatctactggtggatgtttcatttatttacatattccattcattctccagggcttatttttcaatgaggaagcttgaagaattgagatagataagaggaaatgtaaatgtacaaagtagagtatgtctgagggaggagtacgaaaccaagaagctgaaactcttgtcacactttatttatgtgatgattttagagcattggtcctattggaaggacactggcagggtccctaaaacagcacatgctgcactgaagagaaccttgtttcttaaatgagctctaggcaacaagtacttttccttagaacatttatagaaaatatgagatacaacgaatgtcttcgtgtacctatgtattgtttttatctttaacgattaggtatgcctatcacgcaatgttttttacagattttgctgtcaaaggctcctcagtggctgcttcagccagcagctaggacttcaggtcaaagtcctgttatgctgatgcagcttcatttcctgaagcaagatccctcccacttcactctgatgggagagtcttctttctttacaactattaagctaagatttttgagttaacattttaaaaatatatttttccttttatttttagttgacatgtaataattatatttatgagatatagagtactagtccaatacacatagacaatacgggatgatcaaatcaaggtaattagcacatcgcctcatgcatttagcacttctttgtcttgtgaacattcaaaatcctctcttctagctttgtaaaaatgcacaataaattatagttaactatattcaccttacagtactacagaaacatttaaaacattatttcttgagatcttggttctttaggtgactgttgtggtggtgattaatcagtatcatgaaaatacttatgttgtctatcatggtatttcagaagactacagttatagagctgggtgcatacaattaccaaccacaatgatatgcatttacatatttcaccttttgacctatttcttcatgaatatagttcatctgtttataactcttatacttgtgtgactgttgatagaaggcctgaatgtttatgcttgcaaaaatgtgtgttatcgcttattttattgtgtaaggtgatctttgaagtgttctgttgtgtttttatttttgtgtttttatatgttactcaaataaataccttttaaaaatgtaaataaatatatcttaaagaatttttaaaattattttttccagaattaaattttcaggatttcagtcttttgggatggcgatttttggaattttagactttaaggattttgttcttttgattttcaacattcgattatggtgtttggaactgtgtctttcaagattgtgattgattccaaatgcaacacagggttaaaggaaagtggaaaagacatgaaaaaaatctgagctgtgccttacctgaagctgttgtgtgagaattatagaaacatgtagagagtagacatctaaagttaggttactgtctgctggaatacatgagtcaacctcatcctccttggtctcccatttgagaaagtgttcagcaaagaggaacacagtggcgctcacatccaaaatttcttagaaggcctttaaaagggtcagtgttggaaggtaacattatcaagtacagcagttatttggagcccacccaataaccatattgtggttacaagcagatgtaaagggcactgcagtctttcctgatttaggaagcaccgattacacctgactctttaggagagtatgtagcagacacattttgagccatggctatcataccctggacagctcctcttggaggagtggtgactaagagcacgctgtgtgtacgctcagtcttcactgctgacctccagtctccacctgcttcatttttaaataaatgtgccaaggtttatttttgacccttctggatcatccaacatttccaagtggactcatctagggataacagtgagaaagttttgggaagatctcaaaaagtgtttctttaactgagatcttaattggttcagccttcagggaaaaagggaaagatgatgaggcctgggtctaatctgaataatcagttgaccttaagcctgaatcagaatatcaaatataattggaagccttgatatatgtttttatactaacatagctatgttttcccacaaaatagatgatactggatttaggactgaaaatgtaagagaaaggggttctatgaagtccaaggatataaagacagaagtcagttatggcaaagaatttacaaaacgcttcaaaggcttatctatctcttcccttctttctacaattctgcacatgtgccagccccaaggattctgtacttatgttgagatttttggatcaatatctgttttagtggcacttaactttaaactatttgcccacttgtttcatgaatttgtcattttagtttcacttaagaagtacattgtcaaactatagtgaatttggcgaagaacaactagaggggacttagaagtacggaaaatgagtaacagtagaaggaattgggatatttaaattggagaacaaaaagttttcttgaaacaaatgaagggtaattaataaagcaattgaatttgtcccatttaatctctaaagtacagaattactataattctatagggtgacacattttaattcatcatggagacttactttttaacagagaaatatatgcaatgatggaacgagctgaagaacaatactttctatcagttgcttttgtcagatataggttgggaaagtgggagagggtatctaagcatcagatgcaaatttctttcaatcttgaaattccatgatacgatctaagatatttcaagaaaaaaaccattcaggttgatttcaacaacataaaaaactgtaatggaaaatattaaggctaattagaacgtgaagttttattaacattgataataataatattttctaaggaacactagttgacagcagacaaagggaggggggatgaaatactggaattgtggtcagcaaagccccagggttatgccacaggactacaagtactccaactctattaaggaagaaattgctaatttttttttttcccctgaagcaatgtgtgtggaagtctttcactttctgagccaaaacttgaggagctgaccctgaggtggcagttttcctgggggagctgcttagatagcttttcatgcagggatagtccctcaatgcattacctttcagaggctatggcatcaggcctctatccagaaggggaggaggactagagagcgctcaggggagagggcgataagagagagatttgcttgtctaggtgatgttgctgagtagcccagtgtggactctgtgtcagagagctccaaagtacagcagcaacttggggtctttacagccccagaatttatcttatctatggcatttgagttaacaggattcagcttactgtaaagaagtaaacaccctagggggctatataaagaagccctctttggcccatttgtctaacagatggtctctgaaattgtttgcagtgactttttaccttttttttttttgctgtgtttttccagatttagacatttatactttctctcaagctcatgtcatgccaacaaaaagtagagaattaaactaattagtctacactaaggtttccatttacaaaagagaatttattttaatattatgaaaacaacatgtgcttattttagaaaaaaataataacacaggaaagtataggaagtttaaatcatccacaataccatttctaagaccatttctagcctcctctgtttctctgtatttcgtatattagatatctatgtaattattttcaaaattggaatcgtagtgcatgcagttttgttaatacttttgtttaatatatcatgtgtctttccccatagcactacgtgttctttgaaacatgattcttaatgagaacattatagtccatttttatcaatgtactttatccttctgtctgggggcacttataattttatgcaaaatctctgtaaatttgtgaaaatattctcagaaatagataacgtgtgtgtatttttaagatgtttacctcgtttttgcccatttaactccatagcaaggtaagctgtcatcagttggaggtaagcagaagacagtagagagtacagagccctggactgtgactcagaggatgagcaccagatccagtttgctgtgccacagtggtaagtcacctaacctttatgtgcttggattcctcatatgtaatacaggatcacaactattgttctcactcatgcaatactactattgtgagaacctcatgaattagagaaactctgaatttgcaatttagctttagaacactgacaagtagctcattgattcttgcctcattcctctggaataaagtagctttttatcaaacaagtgaacacattgctttcagtggaggcagaaggaattcattttgaaaaatgcacatagcattctccaacccatttttgcatattcttttttaagggaatgccttgtgtgagaggactagcagggtatcagaactgttttttgaaagaactttgtttgcaggtgctttcaaatatgttgtcttcaactatcattttcagtgtaaaaagcgggcttggagtaagcactgcctgcagaccacttttgtgagccctcctttcagtgatgtgatggcaatccaggcccctgctgggagagatttctgcctggttaaacctctcacagcttctaatcctctctttctcatctggctttccttagccttctccaaagtcactcacagaaggcatcccactcaacctcaccttggggtaaatcaaaatagtcctccttctgaagctaccgggtaaaacggtggtagctgtgcagctgctgctgatcaacaggctccagaaacagcagcaggaggtgagcagtccctgcgttggccaccaagtggtaggtggccagccctacctccaagttgcactgtttacttattcatctttcatggtaaagcctccagttgcctattatgaaatcagcaataatcatgtgtcccctgtctgggtccctgaaaagatggaaagaggcagatcaggctggtgctctgagaatgacagacatcaaacaagaatgaaaagtgtcaccctccttggacttattcagtaactcatgcccttgagcaaaggaggattttctatcaaaggacatggatttctgtgtctttctcttgagataacattgctgggtgaccacagaaagctggctctggaagcacagaagctgcctttccttgagtaataatgtctcttcaaagggagctggagcatgagtagtgtacatgcctcagatttcagtgaaaagttcagaggaggcctgagaagaaggtcctgggaatgaatcatctagatgactcaaccttgcaaagccatccacctcattgtggatatcattcaatacatttggtgctccatcatcctatttccatggctatttcctcacatttttcaaagtctgtttcttgagccctgactgtgtcaaatagcatgccctgttattcttgggcttccctctctgttctagtattcagggagatttcagaggctggggtaaatctcagaccaagaagacgcaatggttttgaggtagagatcctaggaatatagaattctgagctatgcagtggtcctttgctttcaggaaatcaagtttgatagtatcacctgaagcatacttacattatccacaaatgacagctccttacttgagcagttaaattgtggcaagtcttaacacacagattcctcttaaatgccacctaatccctgcctggcttcaagcctctggcttcccttggagaggggcagagtctctctgtgtgagagattcttcatttctgctttctgccctgtcagtttctacttacttgctcttccaccttgtccacaaggcttatctagcggctgtttacctctgagcagagaaaatggaagtcagcagagacaaggttgaaatttctcaggaaggattttttttttccactttatcgtgcagcaagagtaaagcctttttttcggtgattctttcctccacaatggccattggctgccctctgtcacacacaggtgtgactcccttgttattaactgtcaggtgggaatttctagggaagaaggagagtgctttgttaacctcttaacatctccccaaattgcatcatattctctccctttcccctcccagttaccttttctatttttgatttcccctttttcagtctgatttggggatttcagttcccactaactttgtataatatcctcctatctctgaaagaacaagttccatctccattttccaggagagtttttttccttgcagtaagagcaccccatcatctctccatttctacctccccatcccagtgctccctttatggcagtacaattgaagagggacccacagtcttgctgaaggaacatgaccttcctactgaagttgggattacggaatagagggagaagaggaaagatggatgtttatctgaatggtcggatcttgttttccagaggacacaggccaatgggaaacttttgggaaggaagtcaaaaaatcaaagccagaactgggttttggtaatttaatctcccaaagagagaaaagtccccatactctaattcatattttgtttgacttgactgaagcccttttgaatattttttctgcttctgttctgttcttgcaataacaatgacataagtttgcctttggagacattaaaatagttttctcatctcttgttccaagcatttattttattttatttttttggcgtatttatttatttatttatttattattactgtactttaagttttagggtacatgtgcacaatgtgcaggttagttacatatgtatacatgtgccatgctggtgcgctgcacccactaactcgtcatctagcattaggtatatctcccaatgctatccctccccgctcccccaacccacaacagtcccccgagtgtgatgttccccttcctgtgtccatttgttctcattgttctcacctatgagtgaaaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgtgtgtgtctttatagtagcatgatttatagtcctttgggtatatacccggtaatgggatggctgggtcaaatggtatttctagttctagatccctgaggaatcgccacactgacttccacaatggttgaattagtttacagtcccaccaacagtgtaaaaatgttcctatttctccatatcctctccagcacctgttgtttcctgactttttaatgattgccattctaactggtatgagatggtatctcattgtggttttgatttgcatttctctgatggccagtgatggtgagcattttttcatgtgttttttggctgcataaatgtcttcttttgagaagtgtctattcatgtccttcacccactttttgatggggttgttagtttttttcttgtaaatttgtttgagttcattgtagattctggatattagccctttgtcagatgagtagattgtgaaaattttctcccattttgtatgttgcctgttcactctgatggtagtttcttttgctgagcagaagctctttagtttaattagatcccatttgtcaattttgtcttttgttgccattgcttttggtgttttagacatgaagtccttgcccatgcctgtgtcctgagtggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccattccaagcatttatttttcaagcaccgtatgtgggccttttgttctgtggagaataggggaaataaatttaaatttatttttttccatacacatttgcaagagtttttgtagtgtctttttttttttttttggcttatcaacatttttgttttttaaaaacttttctatccaccaactctgtctcttttgcagttcatttgggtataaagttttgcttaagaggtgtatcaacctcctagagtgaggcttttgagaagaggggctacttctaaacttctatcacttatgtccattttcttaattttatacccaatacatgtgtggcaaagtttgttagctacatatttaacacccaattttattatcttcctaactaatacaacctcaattttattcaatttgagaatgtgcccagtttaaaaaattagatgttgcagtctcttctgtttatggtgattatcatttgacatgcttatgttccgatatataaacggaatatagttttgccgctgtctgacacttcagcagccatcttcaggtaataaggtgaacttaaggaaagaaacacatactacaaaagatttgtcaaaaaggcagggaagcctaggtccctgatgatatcttggcactgcccacctctggactgcagtggactgattatctttagaagcacgcatgagagaagaaaactaaacctttatgttgcataaattactgtagcttgagtttctattatatgcagctgaatctaagtctactatgtgcagcaaatttgagtccctggatagatcttgagtttccaacacttaagtaaaatgtggagtaattgaactacttaataaaaagtaataattatttattccaaccatagatactttgcttctttggccatagttgaattattatcttttaaaaatggttctgtttttattaagatgactagtagtatatacttttgatagataaatggcttatgttctttaaaagagatgagtgcccagtttgctcataataaaaactcggaagagataaacgtttaaaatatgttcttataataaacacagataaataaaacgtaggtatccatggtgtacatgtgccacattttcttaatccagtctatcattattggccatttgggttggttccaagtctttgctattgtgaatagtgctgcagtaaacatacatgtgcatgtgtctttatagcagcatgatttataatcctttgagtatataaccagtaatgcgatggctgggtcaaatggtaattctagttctagatccctgaggaatcgccacactgacttccacaatgattcaactagtttacagtcccaccaacagtgtaaaagtgttcccatttctccacatcctctccagcacctgttgtttcctgactttttaatgatcgccattctaactggtgtgagatggtatctcattgtggctttgatttgcatttctctgatggccagtgatgatgagcatgttttcatgtttcttttggctgcataaatgtcttcttttgagaagtgtctgttcatatcctttgcccactttttgatggggttgttagtttttttcttgtaaatttgtttgagttcatgtggcacatatacaccatggaatactatgcagccataaaaaatgatgagttcatgtcctttgtagagacatggatgaagctggaaaccatcattctcagcaaactatcgcaaggacaaaaaaaccaaacaccgcatgttctcactcataggtgggaattgaacaatgagaacacatggacacaggaaggggaacatcacacaccggggcctgttgtggggtggggggagtggggagggatagcattaggagatatacctaatgctaaatgacaagttaatgggtgcagcacaccaacatggcacatgtatacatatggaacacacctgcaggttgtgcacatgtaccctaaaacaaagtataataaaaaaaaggtaggtatcaaaaacataacaattcaaaccctcttttaattaaagttggttcttgtattagtagtaagcagggagcttggggggagagatgtgtacaagtgtagatgggaggttcccaggtaaagttcttgattgggaaggttcatttgattgtatgacatgttcctccattctctctgtctctgtcttttgtttttgttgttgttgttctaagcatctagaatgaaaaccacaaggccagggtttgctatcaaggaccactctttccttttcagaaaaagctggttctgagtgaaatagaaggactagggtgccaaattaactcctctccacaaagtgaccccacatggaaaagtacttgagaagctctgtaaagacatggtaaaagcttaccaaagacagtagcattatcctttcccttacacacaaagtggaggggaagtgtgggtaagtggtgtgtctaaaagcattgctttaaattatgcatccatttgtaaacactaattttttgttaactccatgttgtttgtaaattgaacaaaaaatgcatatttgtcatggaaaaattaggaaataaagatattagcataaaagaggaaacaacgaatcttaattacccataatcccatgacttcatgtttgtgtaagattatataatactattgtttcatgatctgccattttcactcagtgacatattttgcacgtgaaatacgttttacataaatatttgtataatttgactagttattaccttaaaactactggaaagaaatcccttagttcttctacttcactcatttcttctctacagtattcatttctggggtaaatccagctctttggcttgcatggccatgtagttctgaagttagctacacaggacttagccacatttcccagaataggatgtatggtacagcagaattcttactgaacttgaagtcagaagaactggttccttcacttactatgggtgaccttggacagtatacttgatttctttgaatctcatcagtgaaatgagtatgggaatgtctaccttaactgtgtgatgacagaatttgtgaggatgaactgaacaactatataaaagtgtttgggaaatgctgaagagccctacaaatgaaagacattaataatattaactgaaatagattccataaatactatgtgtaagatcctaccttgatttaccgcatttaatcatcaaatccactgtctgacaaaagtattatcattagttctattttatagtctaaacaaatctaggcagaaaggtcaaataatttgcataagctcacacaatcagtgacttagatttgatccaatctatttcattcgatagtgttggtcttttcccctaatagtagtaaaaactgtgggctccattgttagcctgcctgagatcagatgccatctccaactaggcaagttaccttttctgcctgtttcactcttcaaaaattagagatacaataataccaacccaatttctttgggtttcataagtaggaaataaaataatacatagaaaagacttggaacattgcctgacacaaaataggtgtcttaaaacgttaattattattattttcaatgttgccaagacagcgaaccctgtggtggtgaatttgcatgtgaaaacctgttaaactgatacacactctttcttttctcctaatattgtcgcacttgcaccttatgtcctaagttttctagtaatcttgaatgtacataatgtttagttgtgaaataaattttgctttgtgagggaattagttgtaattgagggtagaatcaaagtttgttcagcgaattccatctattcagttgtaaaggcagcgaataaacaccatgacttgtatttgaaagtagaaaataccgactttcaattgtcatttcccccgaggaaaccattaaccagcacaattgtttttaaatatcaacctgaaataacactgtatttttactgctattctttctctctccttctctctctttgggatacagtttggctttgaaaaaatatggtatatatgcggtgtttggtcaaataatttagcactatggaaaaggttgtgaaccagtcatagtatttgaggttgtaagaagaaacctttgaaaaggtagtggctgcacaaatgtattaacttagtaccacaaagtagggagttctgaaactgtggtggaaatattgcctgccttgactacctgttcttcctgagtccatttgctgatcagaactcaggtaacttaaaagtcatataccctggaaaggagtatggaaacaggaaagatcctcagcggctatacaagtgagagatatggcagagttctaataagattgactaaaagcttgatactgtcttacatcaaaggagcaaataattgttctacctggaatgtccaggccccaattcacaaatgcattcctaccttttgaactgaataatgatctctttcccaataaactgttataagacaaaaaatctgaaaggaaaattgttgcacatacatcatattcttatattctgtattttctgggacagtctgtttcagattagatgatgagtcctaattcaggtttgcaaaatattatcaaggcaaatctttatggagattttattgagatattattttataacaaaaaatgggataactgtaatgttcatcaaaaaaattggtggtagaaggaaggaaggtgttggagtgttcagtaaccttaccccagaatgccacagtacaaattctgtgagaagtcattcttgtgtagtagaggcattcatttttctcctaatatcccttctgaaaattcccttttgctagtcagctcttagcttcttggaaagaaggcccttcgtctaggacaatgttcatctccccacataaaaattcacaattcatggcatgttagttcaataaaatattatgctttctaagaatgataattatgaaaacttgctataaatgggagcaagttcaacattaaatcacatgaaacagacatattaacaaaaatagatacattagagcaattgaactataaatgcttttttcctttaaaaattttccttcatgttattttcacattcttttagcaacaaatgacaatgaactgccattgattttattttttgaacttaagcagtgtatccacaagtacaccattgccctgtccaatttttagggggagatattctattatctaaaactcaataaattgacccatcacgtttttggtgataccttatttaggtaaaaatattaggcatttagaagaatgcatttgtgaatattttgactgatattactatagatggaattagaatctgccctttaggggctcagaaggaagtaatgtttggatgtcattaggctaaaatattttatttattttatttatcagggtagaatattgctcttgaaccactttggaaggaattttaccaggtacttttaaccacaacacagcagtgaaattgcagaaagtcaatagttgggttcatatttataaactgtaacctaaaaataaatccctaaaacccaccactgattaaatagtccatctcttggcctagggaaccccctaaaaatctaaaaactttttccaaccatgactaaacaagagatcagacacgcctcgttatacctactcccctttgtggtttagtcacagcagtgaccaacactcatgttaaaatagagatcttaagactgacagaagagtggcagtaagatgtcaaattataaacaagacctaaggccttgccaggcaaggattttgccactcacttctacacttaaaagataaactatgttttaactgccaataggttattccttttctctagtggctcagtaagcactggcactgagacaagcactatgaagacaattgcagcccatcccctgatgaactgaccccctgttccacaagccataaccccagctttgattgaacatttgctatcaggatctttttcctgatcagaggccactgaccatggcctggctctggccgtttacagaatgtgcaccctgagtgcctttgtgtctctgcttctgctatttgcacatagggcctgactgtaatggatttaaatgctaagtcaccactggtgagtgaacagggctcataagcttcatgtgtgtttgttcagtatgcgtgtgtcaggacaacctccatgaacatccatagcacctcctgtaacctgttgattaagtctgtttaaccaaacagttcagcataaagcttctgcccaaccccttcttcttgggagtgcctgtctctcatttttaccaaatctatgctttccagtgtataggatggctgtaacccttgataaaaatatagtctcagtttcctaatttgtagattgtggtatttttaaatatttaatacaactgaatattaaattcagaacttcatctaattattagactactttagtaaagtatgacaaactgtggatatcctataataatttttatataccctataagggcctgtgatattttgaagcaggaagctgacctgagaccttcagaataaactgatcactgtggataatgaaaaggccccacccaggacattgattgagcacccctgcctgtctcattccttcttctctttctttttattatgtgcttaccataataaaaatttttattgtctttagatctgtttgcttttcacacatagtggactcttatctctctttttcactcattttcttaaactgctagggagaataaagtgtcaggtcctattttggtgctcactgctgatgaattaaggtttattcttcttcttccttgtcccccacatatgggaaatctagtaagaaatcgtagaagctcccttatctgatgccagtgtgaggtttaaatcacacaagctccttctcctgagtagaaacgtgcccctacccccaaccccaccaccaaatcattataaagccctgagccagcctcctttcctgttccattgaagaaattccagtttggaatttcttgagaggcctgtgctgctctcagcagacaataatagagttggtaaatcttttcataaccacctgaggtgtgagtgtggcactatcagacctgacatccacactaacaattggtgggctctctcttcttttgcatggggtcacctacaattggaactatgggtttggagtcctgacagtgaccaccacggggcctttcttcttttgcactggatgctaactccctctgccccagtgcccagcatgcactttatcctgcctgctgctcactgacccttggagttctgttgagctgggctgcagtgttgagttaaacaccacaccttttatagatttagctgattgaattcagaagcattgataatttattcacattgagaaacaggagtgattgtaggtgactctgcctttggtgcatgtgagaaaatttttctcttgtcaccacaaatgtttcttcttcaggaagaacaggataaggaatccagagaagtgccccagaggaaactgtttcatggagaggaagccacagggctgacaggaaaccagaccttagcctccctctgcacctgccctgaggctggcttttgtgctcagtgggtcctgagtgcccccagctggtcctgttccctcttcagggaggcttgtttctgggctcatactgacattttttctaattgtgttccccaaaatggagacagagtaaaccgtgaatccatgcatctcagagaacagagaacagcagaattacacccactgatcccccccacacacatttaggtaaatcttattaaaactgctgaaaaggaaagacaaatagaaatatacgcaggcaagtggaggtgagcagagggggcattccttccaaaagaacagaaaagatgatgacagcattcttctggttaaaaccttacaagcaagaggaaagttgatggtatctgtaaagtgttggatgaaaagtcaacccattattttataacgcatgggtgttctctaaaaagtgaaaaaaaattctatttctctttgacagcatgagggtttcagtgaatccaggccctcatgagaccagtgaaaattattttgaaaaattacagggtttggaaaggctctaacaacataaagcaagtgaagaaatatttattcaagaaaatctagaaaactcagtaaggccagtcatcatacttgatctaagatgctcttccttccttccacatcccagctcagcatgatgtaaactccactgcggacagatgcagccaagaagacaggtcaccttctaccaactcccaccagaggaaactcttccccaggacccagtacgttggccctctgaccctgcacacagcacatgatgctgaggttcagtgctgaacaagagctactgagagccagagattcacttcttccatggagccccactcatggatggaggctctgtcccgggtccagtgccactgggaacactgggtctctggtttctagctctgtcctatggcagaggttccaccccacaataaccgaagtgctgagaaggtgggaagctcctgcccgaccctccactgagagctcagctcctaggctgaggaataaaacagctcaactttgtctacacctgcagaaccttgtttaggagctctgtcccaggagagagggggcaatggaattcagtcataaaatatgatccttaattagtcctaaaaatcctaacttcagtaacagcagattgtggacaaattgaaagcctgccagtgctctcaaaaacagtggatggtgtggtggaaagcccttggaaggagacgggtggatgcatgggagatgcaggctacactgcagggctgctggcttgcaggagagaaccgaggacaagggagagctggggaaagttctcttgtggttgaaataaatgccagacactcttcaatggagcccatgtttgtttggttcagtctgtgaagtaattcaaacctcagtgcatgattgaaaatagtacaattttccatctgcaagtggcagagctcaacatctgggtctggtcaggagagagacagagagagcccagcccaaaccactgacacctggggttgacagtgctgcttacagatgtgttcctttgatctttgagactggtttctctcacttagcataatgcctggagttcaactgtaatggtttgtgaatcgatcatttgatattttttattgctgatggattcaatttatagatgcttcctagttttttcacctactcaaattttgagacatttatgttatttttcatttctaacacacacacatgtaatatcttgaatatttgaatagaggttttgtgtgaaaataagattgtatttctctgaagcaaaattcaagagtgggatatttaggtcatgtgttaagggcatgtttgattgcagaaaaaactaaaaattattttcccgagtagctgtttcattttgcattcccattaacaatgtcgtagacactaggaacttggtatgctcatcagcattggtattacctgtatttcttcttaatttcagccattctaaaaagtgtatagtggtgtctcattgtgggcttgatttgaattcctttaatggaaaatcctgttaacagcctgtttatatgcttatgtgtcatctgcacatctcatttgatgaaatgtctgcacaaacctttgcctattttatccatgggttgtttctttcttatttctttttcacagttgagtcttgagagttcttattctaattaaattggtggttatgtgatttgaaaatagtttcccatctgaaacttgacattcatgttcttatagttacttgagtagaaaacgtctttaaatttaatgagtttcaactgatagtaatttcatttattgatcattttttacatattatattatattatattattttattttattttatttgagatggcgtcttgctgtgtcacccagactagagtgcagtggcacgatcttggctcattgcaaactctgcctcctgggttcaagcaattctcctgcctcagcctcccgagtagctgggattacaggtgcctgccaccacatctggttaatttttgtatttttagtagatggggtttcaccatgttggccaggctggtctcaaactcctgacctcatgatccatctgcttcgacctcccaaagtgctgggattacaagcgtgagacactatgcccggtctaaattttaattttaagatcattggtcaactgttaattattttatatttttaacttttttgtgtgtacatttatttgataaatttaagggctatgagtgcaacttttgcacatggatatattccatagtggtcttggcttttagtgtaatatcacccaaataatgtacattgtacccactaggtaatgtctcctcatgctcccaccttccacctcccatccttctaagtctccggtgtccatcatttctctctccatatccttgtggacacattgttacctcccacttacaaataataacgtgtggcatatgactttctgtttgtgagttagttcactaattatattgtccccagttctaggcatcttgctgcaaaagacacagtttcatttcttattgtggttgactagtattgaattgtgcatatgtgctgtgttcttttataaaatcatctgttggtggacactcaggttgacatgtgtgttattaagaatagttttgtggtaaacatagaagcatggatatctttttgaagtaatgatttattttcctttgggtagttaccccgtagtcggattgctggatcaaatggcagttctatttccagtgttttgggaagactccataccattttccatagaggttgtcctagtccacatcctcatctacagtgtcgatgagttcctgttactttccatcctcaccaacatctgatacttttgagtttttaataatagtcactgtggcttttgtaagataatatcttactgtagttttaatttgcatttccctgatggttagtgatgttgagcattgtttatatatttattatccatttgtatgtgttctttggaaatgtctactcacgtcctttgctcattttaatagggttatttggttcttcttcctgttgttgtatagtttaattccttgtaaattcttcatgttagttccttgtcacaggcaaggtgtgcgaaaattttctgtcattctgcaacttgcctgttcagtctgttgctgtgaaatacctctatagtttaattctcacttgtctatttttttcttgggtgtgttttgtggtgttagtcataaattcttcacctcgcccagtgcccagaagagttgtcctcgtattttctttgagtacatttatagtttgaggtctcatatctaagtctttaattcattttgtgttgagtatgtatgtgttgagggtaggggtctagttttgttcttctgcatgttcatttccaatttccccagcaccatttattgaatggggtgtcctttttctggtgtatgtttttgttaagtttgtcaaagatcatttggctatagattgtgtggctcaattctgggttctgtaaaatgtaccctagagccttgattctcctgaggcctcagtagtgacctgctcacagttagaactctgttgactcagtggtgtttctatgagtgtagtgattcgtggtcatggggtggttttcctaaaattgtggacaattctgttttgatgttcaagcatgtgctaaaaatttcacaataaatgtgtctgtgaattatccatttcatttccacattactccttggacttactgagatgtgtttgtgatgtcaagatgaggtgtttttctttccaggtgttggattttttacctatctgggtatttatgggctccctgggtggaaataagccgcatccatcacacctaccttatggaatttttagaaatttatttgtgcactgccactgtgagacactccatgatgatgacacatttcatttatgttattgtttcataaaattactagtgtaccttccactctagaagagaagatgctgtctggattttcataattcctcctgctctcttatctccacattcttctttgacaccatatctgcagcttaagaatgacatacgctactgacatttgtatttggtcccttaaagtgatatgaacctaaggaactggtggccgcatatcagtgatgcatctggctcaggtaataggaacctttcgtgctgaatcttgtcaaactggatacagtctcggctgtgtcctgttgagttaggcatagaatagacagcttcattgccaaagaaaaaaagtagggggtaaaatgggtggtatgtctccagcaaatacaatgcataggaaaacaaattgccatatgctttaaggctccgctgcaatcatctctgaaacaatctttttccttctcagcttatttgggtggcagagtcagctccaaggctgcaggcagaggcaccgctcctgaagcactgctaggcccagctcccatgtcaaaggcctcatgcagccctacacacagggctggctggttgctcccaagcccaagcctctgttgggtggtttcttcctcaagattttagaaacaggctttctggtctgttgaaataaaggcagtggtctgatagtttctaaataaatttaaagcttattttttctcccttccagaagtatcatgtacatttgctgccaagtagctctattattccaggccattaaatctgaaaaatctaacagttttcatcagatttgtctcaggtcaattctcattctttaaaacctgaaatatttcttttcatagagtatcttaggcttcttactgagtgatatttcagtcatatactcagtgttctttgtagaatacagtttctgattttggcaatatggataggttgagaattttctaagtgctcaggttttttattctttttcatttatatttttttctgattttaatttatctacctcacttgttataagcactcaggaggaaccaagcaaaatatcttcaacactttacttagaactattctcagctactcacaagttctcactactcgcaacttctctttcactaaatattgtatcactgtccagccaagatttttttaaaaactttatgataaggatgactattgctccattttccaaaaccactctactcatttctgtctatcagcatgaccctcaacatacaaatttcttcatatatgtcaaaggtacccatccttttacacataacccaattccaagctactttcacaattttcaaataattgtaacatcagatttccacttcctaaccccaaattttcttttgtcagtttaagatgccattacaaactatcatatttggtgactcatgcaacattaattttatttcatttatcagtgctgtgaactccaagatcaagatgctgacaagataggttttattttgaggcttccacttttggctcagagcagccatcatattgttactttttcatatgatcatttcattgtagggcatgtgtgtgtgtgtgcatgtgtgtgagagagagagagagagaaatagagagagagagaggctgtctggtgtctttacttatgaggtcagtaatttcattctgatgtttcaccctcatcatctcctttaaaattcagtactttctttcttatagaaagcagcccgacagaaatttgcaaacttcctttgtgatttttattattattattttttagctcatcagctatttttagtgttagtgtattttatgtgtggcccaagtcaattgttctttcaatgtagcccagggaagccaaaagattggacaccctgctctacagctacagtagtttaatattaatataaagatataggcagaacaactgaacagaataaagactagaaaaatatctaaacatattactaattatctaaacatattactgattttcagtaatgaaaatcaattaaccactgacatgtattacctatatgaatctcacaaacaatgttgaatgaaagactcaaggcagaggttgtacattccatttcaaaatttcaaaaacagcaatcaagaccagtgtcaaaagttagcatagtgattacttctgaatactgttagaagataaactcagataactaggagattaatgagaaaaacaaccaaaaatggcagtaagcattgaatctaattacctataggaggccaagactaatatagggattttgatttgaaaattaaatgttggagttgtaaaccttgataataggatagatacataactatctatatgtagagaggctgaggtatgagaatcacttgaacctgggaggcagaggctgtggtgagccgaaattgtgccgctgcactccagccagggtgacagagcaagagtctgtctcaaaaaaaaagttatgaataactgtgcaccaggtaacagagcatcagcattcacagagaagagctataggggaaacaagaaaaaatatagaaaacacagcatcttaattatttaattcatgtgttttagttcattaaacatcaagaggaccaaaattaagcaagactaaaaaatacctaaatatcgtaattgataaggtagaaatatgtgtgtgtatgtctgaacataacaactcattcttttttaagtggcaatgaaacattcataaaataaaaaaagaaatttcttaattgctataaaagtattcctggggatgagtaatttataaaaaatctaatttggctgacggttttgaaggctgtacaggaagtgtggttctgccatctgcttctggtgagggcttcaaaaaccttatatttatggtaaaaggcacaggggaagaaggagtgtcacatggtgagcagggggaagaaggaaagggggagatccaagtctctcttaaaaaatcagatcctgagtgatctaactatgtgagaactcactcattaccaagtggatggcactaagccattcgtgaggaatctggattctggattcccatggggtgatgagaggagagcagaggggaggaggggcagggttgggtcctgggtaaggcggtgctcgggctggggtccctggagagaagttctgggttcctgggggccaatcaggcaggcgtcttttctgtccacaccccgagggtcccagccggagccaggtggggaaccataaggagagggcttgtgtcctgtcctccccagtcctctagacagggtgggggctgaggggtccaccccagggcagggccaggcagtgactctgatgtggggcctggttttcgtggactggcctggggggtgcggggtgcagagcaggagggggcagattctgttgggggatggtgcagtcatccctgtgttcaggccatttcctgccctggtcacctgcagtgaaccctggcaaggagggggtggcctcccagacagcagcctgcctgggatctgctctggccctggaactggggatggagccattctggaggtcagcagctgcctaggacagcaggggaccaggccagcccctagcaggggaggcagtggggattttggcaaggaccgaattgtttgggagccagtgccccactaggcacagtgacagacaccccagcagtatgtcctgtccccaccagactgcccaccctatcttaggtgtagcatgtgagggtgccgtgcccctggcaggcccagcccttgaccttccatgcagtcatgaggccctgggaagctgagaacagacctcccactgagggaaccctccccacagagggcagagtgcagacaacagtgaccttgagagcaccaggagaagcaggtgagctggaggcctggggctgcatggcagtggctcatctacttggcctggttgctgctatgggtggccccactgtggtaatcgtagacactatatccaccacagtctgacaccccctgacaataaccacacctggaactggaggcggggctgtcaggaggagcttcccagggagcaaggagggtccagacagctgtgccaggggcccccaggactggggacgtggggggctgctcagggaccagacatgcacagtgtccccctggagaggcctctgcagcctcctgggctctgggacgggcctccagtcagcaggaggctgggtgctccccgacatgtgctctcctgccctcactggtgagctcctatgtggcccagtgcaggcccagctccagcgtccgctcctgtcagcctggccgagggtctgggcagaactgggcatggctccttcttagatccctcggggactgtctctacagctgtacctggggctgggggctccatgagtggtctttgccatatggggacgtcaaaggcaggtgtttctctagtggcaggtgagggagactgtccagggcctggccctacgaaacatagtggcctctcagaggagggtgtgtgggagtcctgcctattgggagcctggcggatgctgccctcttgattccagccaggatgggaatccaggcaattggcaggaggtgctggaacaaggctggtgtctacagcaattcccggccctaggaattggctgttggaactgtggcagctgttgggacagggttcggtgcagctggcaggcacctgtggtcatgagtgaggtcacctcagagccctctgaagcccttgtttgaaggcagatgaagtgtggggcaccagcccatgggctttcatggccaaggtgtccctagaggccgagggtctgggcagaaatccttgggcctggctcttcttatcctggagaactctgagccgagaagtgtgcataaaccctgggagtccggtcagtttttgctgctgggttcatcactgtggtagttagcaccatagtcacatagcaggagggccttcacaaaaagcccctcagtgagcccagaggcatttcccacgcaggtgctggtccaggcgtctggggcccccattgacagtggtgctgcatcctggggatctcagaccggtctgaatcttccccgcctgccgtcgagggcaggagggtctgactcaccctccagggctcctgtcccctccaggaggggctgaggtgacatccggtcagagcatgtgcaggagtcaggcctcctggatttttagtcctggggtaggtgcagggggtgggacaccttttaggggtctgggaagggctgggctgtggggctgtccccatgggccatcttgtgttctgggtgccgtcctgatccagatgtgggttcccgatgtgatatcactgaggactgtcctggaagagggtgcccactggggagagagacagggatttctggaaggttctttgtctctgactgtgagaggtgagtcctctgttggcttcccgggtgaggtttggaaaggagcaggactcaggacggccaggcaggatgagcgactcccagctccggctgtcccgggaatgccttctgtcttggaaatgacccaggagaggctcaggtgtcagagccaggcaggccagggaccacaggggcagggacagtgcacaggaccagccccgccctcctgcccctactcggacctggggggttctcagggtccacacatgtggctcagccttgagggaggggcttccgggactgctgggtgcctgtccccatctggactggtactagagggcagcagcgatgcagacctgttggactcaggtctggctgacctatgggataatcctggccatctgtttcatggtctccggggctggcgggcaggagctcagggtggtcactcttgggcttgtccattgtgcctgctgccctgtgtgtttgggacacaggttgcactgctgtggtagccactacacccatggtgctgtggcctcgatcaaaatcctaacgcggcatgtggtggtccactgtggggagggctatggcagaaggctcccagggatgggtttttgatggactctgtgacactgtgggtataataaccagtccaaaaatcataataccacagtgacacagacctcaccccaaacctactgccaggtccggggaaactcgggatgtccagggctgacctgaggaggtagcagggcaccgaggggaggctgtgggcccagcgctctcaggtctgctgcggggacactcgggtctgcccctcgcttaggtggacagtgtctgtgcccacctgtgtcctgaggctccatttcaggctgatatctgtctgtactgtccctacccattccatagccatgtccttttgggtttataaattgcccccaaatcacgcaggcatcactcaggctttttatattccctgggccaccaggtgcctccacccagaaaggtgagatgtgggagagttccagagtcattctgcaaccctggatgagcccttgcagcctcagtgctactgaggttccagcaacacctggagcaggtgcaggtgaggcccgaggccaggtgaagcccaggccaggtgagatccaggccagtgatgcccaggtcagatgaggcccaggtcaggtgaagcccaggtcaggtgaaacccaggtcaggtgaggcccagatcatgtgagctcgggacaggcaaggtccaagtcaggtgaggccgaggtcaggtgaagcccagaggtgaggtccaggccaggtgaggcttaggccaggtgaggtccaggccaagtgaggtccaggtcaggtgtggcccaggtcaggcaaggctgaggtagatgtatgagacttctgtaattttcagtcggtgccaaccctgcctggtgtccctgcccctcctcccagcccacgctctgtgcctgccagatggcagcccctgcacaggtggtgctggctgtggaggagctgggctctgcttccctgtgcatgggcgtccctctcgggctctggcctgggagtgtggctcagttgcttctctctggaatgtgccgactgtgccatccttgggggtatatgttctcggggggatacggctctgtgcctgctccacatctggccccaggagctgccagcaggtaccggcctgccctgccacacagtgagcctgcagcctgtccggggatgcccagggagatgagtgctaccacacatcaggccttttctctttaaagtcatttctttggggatacatcatcgatgtctcatatactgaatgtatgtctgtatcactgtgcaattgcctgtgtcatcgtttatttatccaacctgggttaatgtctttgctattatgaacagtgccggagtgagaattttctaaacacagctgtgtacattttcctcttcttgcgatttagaagtttaactgctgttttcaaggtactgtaatgtatttgttctgttcttgttaggagacttgccaaacctgtgtgtctctgttcacaccctcttccttccccagtagaagtaaccacaactgtgtttatgtgatcatcgttttcttgattttccttatagtttttctagtggaaagtttatcccttaagaagatagttcattttgccgggtgtaaattttatttagaagaaatcatattgaaagtattttttggagtttcctttgttactccaattactcagcattgtcatgaactcaaccacagagttgcccgtaaccctgtactgttgtcctcgtggctgtctgggtttgcatttcatgaacctgccatcgtttatttgcctgttttccttcagatggatgtttgcttcattctcagtttagggctatgacaaacatatgttctgcacatctttgcccatgaggttctcagggagggctctggggctggcattgcctgcagggctctgctttgttgcagggagttcctgccagggcttttcagagtgtctgtgcccagcagcaatgcctgaaggtacacactgtactttgcccttgcatcaggcactttctgtttgcttgcttctgtgtggctccacattctggagaatttattcagatctgtgctgcaaatccttctcactgattctctctttagctgtgtctacatcagctgttaagcatcccatgatgcagcagtgtgggcacagggcaaactttcgaaagatgacagtgtgggatagaggctgctcctccttccctgtgcccttcccacactgtcctcctgggctcactcccagccatttatctcgaacaccagtttatggaattctctgcccaggaaagcagaaacagtaaaaggccctgctcaggctctgcctgcatcttctcttgcacacccaccaaagctctttccttggggcctgtgccagcttccccagcttgcttctcattttctgtttactctgctcgctggctggtgggggtgatgtctggggggaagtctggtgtgttttggcattggtggacacccctaggccctacttcccagacgctccccctcagctccagaagtggaagcatttacagcagggctttgggactgggggctgtgtcactgtgggcatagaaagtagtactattacaatattctcacagtgacacaagcccccacaaaatcctcctgtccccatgggtgtcacggagtccccccttgctgtctctggccagttctcctgctgatactgtgatttccagggggtttttgtctgaaactcagggtgtcttggagaggactctgagcccagtgctgtacagggggctcctcctttgtcctgggggagttgcgtggaccctgtgtttggttaagggaagcatttgctggtgagggagacctcccctcctctctttctcaggagcctcctctgatgattttgcctggtgtttcttggggctggtgctcggggctcagcagtctccgccctggtccagctgggaatgtgggtccgtcctgtttccatgagttttctggggccaccagtgaggggctcgggatgtcagcggctggtctcggtccctatggtctgggctccggctcactgctcccctgccctccaggtcagtcactgactcagttactatgcagcgggctccatggctgtttggtggtggctgcaggtctcttcccaggagaggcctgcaagagggttgggatgtctgggagccctgcattctcccgtgatgttgctgcctggatccctcatctttaaagggagtgccgagcctccctgcaggtgtgggcagtgagagacacaggcggatgtgcatcagggcgctggaggccgatttctttcattgccttctgcctgtggaagagctgagctccctgcttctgtgcacaggagatttccctgtaaatggggagtgagggcaagggtctgtgtggggaagacttgggtgagccttcgtcctggaaataccagggccatgtccaagaggggagtggagccaaagtgtccaggaggaaggtgagggcagtgtgtgggtgggagtgcacggtcagtgccatggctcagaggccccaggagaggaagagctcaagttgtgggcaggaggaggcagtgggtaggcacaggggggagaaactgaggctctggcagcagaagaggggagggcctgcatgtgcagggttggcctgggaggggtgtctggagggagagacaggggtctgggtggagaccagggtggtgactgcagggacaggaccccaggattgtctgggtgggcggcaagagcagcagggcagaaagggcccaaggcagggtccagtcttctcagggtgtgggctgcagggatgggaccccagggttgtctggatgggcaggaagagcagcggggtagaaagggctggaggcagggttgggcgtccccagggtgtggggtgcagggaggggctgcacaggctgtccccctgaaggagggaggagggaaggagcacagaggtgctgggagcaaatggagagggaagtggcagcgacctgcatgccaggcggtcccggtttggggttgatctgtgtggaatagctccctggcccatgtgtaagtggtcaggggagacatggaggtctggagctacaagcggtggcaggaaggcaagtcctggtcttgggggtctggagcttatcttcttcctgtgaactgagtgtgggcggcacctatgggtggtgccctggacctgtggtctggtggagtccaggcctcccagggatagcagggcagccagggctagaggagcctgaggggccaggtcagggtagccctggggacactgcctccacctttgaccagcgctgctgcggggatctggtcatgagaccccttcacccaggaggggaggcacgtgagtgtgaccctaagtctgtaccctatggggggctctgaccctcctgcatagggcctggacaggggtgggtggctgtgtgcaggtggggagtggggagcccagactctcccagacacagcctgctctgctccagaatgtgggcttggggactgcaggctggctgggtctgggctgcctggtgtgcctgtggtggctgcattcccatatctgggactgaggcctagtgagtaccaggaggagcctgaagggagctccatggaggacctgcctcggatgacacccctattttaggaaggacatggtgtgttccagctgggaggaagggaagtgggccacctcctgggggtcttccacccccaccacctcagcctggggcttctgtgcttcctccctgcgcagaccccaaagtctgtgccgccacagggcaggaaggaagggcctgtgtcctggtcgaggttggggccacagtggtgttccctaagccccagtctgctctcagggcccgccccgcagcaggtcctgagtgagggacagagacggggaggggtttctgatcctggtggactctggggtggattccagtggggagtcatcagggtcggtgtcccccagggtattggggtgaatgtgctcctggagtctgctctggatgtggggtttatgcctgtgctgcctggggttgatgttgggaggtgccagtgacccgtttccctgagggactcttgtcggtggtagggtcagttctggccaggggcactggcgccatagcagtaggatggggtccagccccttccatgaccccctggagccctggtccccatcctcaccattcaatggggactccgttgtgctctggctgctgggggtcatgtgagctgagcaggacctaggttcggggcggctgttcccctctctggcatggcctccggcagtggccaggagacggttttggacaaagcttttctcacagtggttgttccagttatacccactgtgactcggggctgttcagaatctgcccaggtgccctgagctctggggcctcctgggtgggggctgggcttgtgggcaggatctcctttgggggctctggaggctgtggctcactttggttgtggggtgagcactggaagccccagctagcagaacacccacagagactggggcctgcacacattccgccccagtgtgtggggtgggcccaggcccctctgcgcaggtcagcttcaatggggagggtgctcaggtcctgcttgttttcctctgggttaatgggattcatctcctggccccagatcctcacaggctgcccctgtccctccagcaatgcaggacatggcaggtcaccctggagggaggcatgttctggtctgggtgtcaggtgtggcacctcagattttccatgcatgctgtgggctgagcaggacagcagatgaccccgggcccccaccctgtctatggacattttttgctgcggcaactgtgggagctgacagtgttcacagccacgccacggtcatcatcgtagtcaagtctttctaagagtttcattgtgacgaagcctcctattaaacggcacctcggccctgcttcctgagggttactgctgagtcccggatttcccacagaggcgaagagaggagagcaaagggaggaagaggcagatgagctgggccctgcagaagggggtgcttgggttggggtctgtggagcaaagatctgggctcctaggggccacgcagacaaccatcctccctgttcacaccttgaagatcccaacaggagccaggtggggagactgtgaggagagggcctgtgtcttgtcttccttgggccatgggacagggtggaggttgagggcttctttcccaggggatcacagaacagcacctctgctgtggggggcatctagcatggggggctgggctgtggggtgcagggcaggagggggcatgcatgggaggggtgtggcccagtcattcctgcattcacaatctttcttgtcctgggcacctgcactagaccctggcctggaggggcggcttcctagccttcagcatccctggagtctgctctgactctggacctggggacaggagccaggcaggaggtcagcagcctcctaggacagcaggagggcccaggccagtgcctagcagacttccacgggagaggggtcccaggggcggggagataatgatttctagaagggtctgtgtctctgagtgtgcaagtttgtccaaactgtccaccagctgtgatcaggtaaacacaggcagacctgagttcaggcggaggaaacagttttgtcattaactctctaccgactctaggggaatgagccaagctccattgtcgtctgtgcagaggccacagccttgaaaagggagggggtagagggagcagggagggtgctcggggctcagtcgtcggggaagggaaaatttgcccagtgctggtcagcgtccctgggatggggcccgctgtgtccgtgctggccactgttgaggtcaggattctgtcctcccagagcctggagacacaggccccatccttcccaatggggacacttcagggagtggctctcaggtcccgagaaagaccttcctggccacaggagacacacagacatcaggaagggacagaggaaggatgtgcagttgcagcctttacagcagatgctctgagaatgggaggtcgagagttggagcaaacggtcagttctggtgcattgagctttctcaggcaggtgttgatggggctggggtcagcctaggggtgtgacctgaagccactggaagccttgctggggtctggctctctcttggtgcagtggggtggagggagccctgacaatagagcactggggggcctccaggagaccatccctgcagcagccgggccatgctctgaggatgtgggaagaggacccccactgtctctgagtatagggtggtgacttctttgcacagactggccaggggtcccacaggggcacagtacaggtgtccctgggctgcagggctgggggacatcagagctgctctctgggcttggcagccacctcatgtgggatcagaaggggggggcagtgcctggtgcttcccctccaggcctctctccatggtgtccagggtagcttctggggctttggtgccaatttctgaggccagggtcctacccttcctgatgccgtgatgcttggtggctctggaggaagccccagctttggccactcctgcactgcctggggctccagtcctgctgcgccttgaggggaacccagggccccaggcttggccctgtaaggtcagatgggggctgggctccagcatcctgccgctaggtttaattcctaaatgacagggaggcagactctggctgagctcaagacctgttcccaggctctgtgccagagcagggtcccccagcagaggctgtgtggagctgggcagggttcgcactttgtggggagttccctggacctggagactcaaccctcagcctccttgatgatgaatgattcatcctgtgactgtcttggcccagacaatcaggtggcctcctcacctacccctcttcagacagggcctcagacctaaggcaggagcaccccctacaccagacctcctgggtcacaggaaatgcacagacatcgggaagggacggaggatggacggaggaaggacgtgcagttgcagctctttctgcagatgccctgagagaggaggtaggagcacgcttgctgtggtttgaatgcttctctcctccaaaactcatgttgaaatttcattgccattgtaacagtatgaagagtgattaggtcataaggtccccacctcatgggtgggattggcgctgttataaaagggtgagttcggccccctcttgctctctttcttgccttctgccatatgatgacacagcaagaaggtccttgccagatgctcctggacttgctttggactttcccttgctcttggacttgctctggcaccttgctcttggacttcacagcctctagaactgtgagaaataaatttccgttcagtataaacttcccagtcttgggtgttctattacaacatcacaaaacagtctaagacaaccccgtattcagacctaaggtgagataacccctacccatatctaaggatcccctgctccagatcttagtggtgaggtcaatacaggactccctctgagggaagccctgacagcagtgcctgggaaggcatctgtagggcccagtgggccggggaggcccaggacacacctacatcatctctcataatccctccattctgttataacaggagcatatgcttatagcatactttaaaaatcagcccaaaactgaaggtaagcatcagttaattgatggactccttttcacggtttggtctttgtatttacaccacagtcatctcacagtgtgtgttgagctttgcacccttttatcaaatgaggtcaccccatgaatgctggctgtcacgttatcacagatatgtgacaagtataattgggaatgtttgcagaatagtcccattaatgtatgcaccataatttcttcaggcactatcttgctttcaactattttataattataaataatggtctgaagaatgtctgttcacaaagtgttttcctcatgtgtgctagccacttgttttcttttggaaattgtgttatatcctttgctgatttcttaagggatttgttctttttcttattagcttatgtatgttgtttgcctaataatggtacaagacctttacatattagattaatattatttgagtttattatttactgttaagttttgatgatttttaaatgtaaagaatctgtaaaggtgttacctagcttcatgatttgggtatgcggtgaagcctgcccaactttgggcagctgtctgggcctgtgtttccagagcttgaaggagtctctgcttccctctggagggctggtgtgatagtgttctctctccaggcctgggtgccctcctgggtctgggcttgggctgggctcttagatgtctcagaggaattgagactctattaatcaagtgagtctttccatttctggtgagatgatcatgggtcatcattggcctgagtggtgggatgagctataaatagttcttaattcccggtgtaagtccttgttcaatgagatggacagaatttggccttctaggatgtcatttataacatttggctctttgccaaaatgcaagtaacccatgttttactctggagactgtggagtgtgatcccgttcatagacttttccatgtttctccaaatcctggagcagttcttatgggaactgattagttttgtgaaagtctaaacttcacccataaagccatcttggcctgaagtcatctgtgagggcaattatttaataatcttaatgctttcttgaggattattgttccaactacgatttccatttcttcttgagtcagttttaagttttattgctagaaaagaaaaatgccaacttgccgtcatctctgccgtcactattttgtgttcaacaattgccttctgtatctgctgtgtcttccccagcacagaagctgtaatgttattaaacaaagcaatgtatccagatcactcagaatctatgcctgtcacggggagcaggagatgagggtgaatgaagagccagagcatggcaggggagccactgcaaggatgctgaaactcatgtgaacagagttgctgtaggcaggccaccatggaaccttgcgggggaagcactgcctcttaggaatggcagtgaaaatgggagaagagggtggtattgcctccagatagaagatgcagtgctttgccttgctccttggtgcatggagagggaaagggatgctgctataaagttcctggctggactttggcttgataaggcatgggtacctttgggagtatgagggcgggtgggtttgtgcacatcttccacgaggagctgttagtattggggcagacgtttcaagtatggcaaacaaaggatgttctgcatggggaaatgtggtgacatccatttcacaaggacagctcacatagattgagtgctcaggaaggaccagcatcatacccagtgcctgatgtgtatcatctcaattagtccttgcctcaaatgcaaaaggaagccattgccatcttcatcaccaccatcatcatcatcctcctgtgcagatggaaaagctgaggcatagagaggtgacggagtctgcccaagactgcaagcctgctggtggcagagccagattccaatggaatgaaggttgtcatcctcagatggcagggtaggcaggtggctagagctcacttgggagaaggggaaaggacactgacattggctagggatggagcagggcttgggctggctttccatgcacgggcagtgggcctggctcatggctgtgctccagccccgggtgtggacattgaatcttccaggtctaccctaggctatgggtttggacagcactgtgatggaaagaagacgctctatgtcctgcagtctgtgaccaatgatgtgactgtgggaatggcgctggcatctggctgccactctgggacgggtggccagctgccatcaggccctgggatgggaccaccatacgacttcttccctcgctcctccaggtcatgtccacagcccaggaggaccagcaaagcctctcaagccgatggcagctcacgttctgccttgtcagctactcctctcctgggcaacattggctgcttgctgtggctctccctggggtacgtgactgcctctgtgctgggcgcctggcctgggctttccttctgggcctgggcagctgggctcagcttggacccaggcagcagccacagaggggcccatggaggtgacagagttgcttctatgatggtgaacgggcagctgtgacaggggggaggcgaccactccttagtttccaagtgctgcggtcagggccagggccagcaaagtccctcccatattcaaagagtgggtttgggtttgtcccaggaggacatagtcaggagcccatgctgggacatgcctcctccaaagttcagcctggaccccagcctctgccaacggccccgctccttagctaacccagcttactcctgggttccacagcagagtcagatgtttctgggtactttcacctttgtgccttaaagcatgttgaggactttaaggaattgtggagaaatagggctgtgccaaaggcaagtgacaaccgggaacaatgatcccacagaggctgctgaggcctgggccccaggggcgtgagttcatccttctgcctgggctttggtgagaggggcagactctgtggtctgagacacaaaaaaaccccaaaacatacttgtgtacagacacacagcagaggcacacacacacttgggcccatgcacacactcacaggaggcccgtggactccgcacagtgaagaaactcctccggttgacagtggaaggtgctgcagcagggacccacccccaagccctgcctgcctcccattgcccacctggccctggcttgatgggctcatctcatgctgtggctggggcctcttgcttcctgcaaccccttgctggcctggggcctgggcctctcctgggctgtgcctagggtttgtaacccagggcctgtgctggcgtgcacagagcatctctccctgggaggctcagggctgcctcctcgagttctgtgggcctgcaccggctggtgagcctgtggtgtgcatttttaggctgtatccttctacttcctgagtccaggggtcccaggtaccctgcagctgtctcctcagccaccctgtggggccccgagaccttgccctcacttcagtgcccgggtgctccagctctgcccaggtgccaggcgaaggtgtgagcatgagcctatcggacacacctggcaacgtataccgggtgtcccacccctgccaccacggggcctcccaatacggcaaccgccacggacctgtggggaccaatgaggaaagagagacgcaggtctgggccaggctcacagggactccgccatagcagaccctgccccagcaggcccccttgtccttcctgggccctggtccttcatgaggaactagcccatccctggtggggctcccaccccacttctagtgggctccatgcttgtcttgtctgagtcacccctcaggcagtggcaggatcctctcctttagacccactgtgccttccgggcctcctgggcttctgctggggacagaagaaatgcctccccaggtctgtctctggaggctctgagggagatgggcttgggggctctaggaggaggcagggattccagggtgttaggaaggcaggggtgcaaggtcccacccagtgaagtaacaagccgtgggtggtgacagtgacccagcgccctcgctgcccagccctgcctgtccccagccagcactgcagggaacccagtgaagtaacaaaccgtgggtggtgacagtgacccagtgccctcactgcccaaccctgcctgtcctcagccagtgctgcagggatcccaggcccagactctgcaggccttcactgatcctggccacccagaaaggctgcagcctgcgggcaccagccgggccacatgcccagtgccagctagggcccaccgcccatccttcacacagggctgctgggtaggtgcccctcacacccccaggatgtcagtgctcacctcgagcaaagtgccccagcttggccttgggaggcggtcatgtcccggggcatgatggagagctgtccaactgagagaaagggagggagggaaggagggagggaaagagacagagagagagagagagagagaggaggtgtgggctctaaggctgccttagtggagttgtgcgtggcctgcacctcaccaagcctagccactctcaccgctctgagtggctcacaggcttgtgagggccccgtcgctgcctgctgggtccccaccagggctccctctaggaatgcgccatggctgctatgacaatttgcacagcccagtggcttaaacaccacacatttataccacaggtccagatgaatcctacagggccaaggtctaggtgtgctggaggccatgctccctccaggcttgcggggagaacttccctgcctcttctagtctctgcatccctgagctctcggctcctcctccgtcttcagggccagggcgtagcatctgctctctcagcctctgcctctgcttccgacctcatctggcttctgtctatgtcagtctccctctgccatcctcctagaaggacacctgtgattatattagggctcacctctttaatccaggagcacctctccacttcatgattttcagctaacttccttctgcaaagaccccctttccctataagggcacacattcactggtcccggggctaaggaccttgctccaagtccctccacccatgatgttgtgccttccagaaacctgtcctctgcagttcggtcttgaccccaagcctgctggtgacctgaacatcacagggttatccccttgggccgtgtgcagcatgatgcaatttcttggcctgaatgtcatgctccctggggcaggaccttgagcctgcagcacacactaggccacctgcagcctcacaggccatgccctgggtagacagggatgtgctcaaccccagctcgggtcctctagtctgcctggctaccatgcttctcattctcctgcatctgcagaccctgggttgccatgtgaggtaggggtggggtggggctgagggcgtggctttggtccctggctgtccggatgaagcaccagagtgatgccacagcccatcccggtgacatgctcacccccaacccccatgtccgggaccccggtcttgtgtggtccctgatgtggagtcctcagtccttaagatacatccagaaagtcctggccatgaattgggggtgcagagtcctgcagagccgctgggctgggctggtgcccccaggagatggagggtctggtggatgccctcctccctcagagctggggcagctgcctcccaggggtgggaccgtgggctcagagagaggcccttgagctgcagctcaggggagtgtgaggcttcatggagtgtgtcctggtccatgtggtccacgtgtctccatctccaaggagaggctcctcagtgtgcatccccatatccgtcctctctgccggcccccggcgtctgagcagtcattccctgtcagcacctctgcagcctgctgggcctcaggttcgctgtgagggacctccccggccttccgcggaggtggagtaagctccgtcaaggcaggtggcttcgtcccttcctgtgagtgacaccagtgatgaaatggacccctccacacaggcatcctcagggcacagggccctgggggcaccttcctcctttcttatttgttgagaaaaaaaagtggcattgggctcacaccaggatgctggtgcagagctgacatgctcgggaaaggtcagaggtcactgggggtgggaaggtcatccagtccagactcagcacctcgtgggctggtaaactgaggctcaaagtgctggtgccaggcctaaggcctcgtggtgactgctgtctctggttcccagcacctgcctgagacctgccccaggcacccataacctggaattccgtttccttgtccagggcctgaggaaatggctccccaggtctgtctctggaggctctgagggagacgggcttggaggctctaggaggaggcagggattccagggtgtcaggaaggcaggggtgccaggtcccacccagtgaaataacaaaccgtgggtggcatttcggcctccctgccttccccactgggtgtgctggtgctggtgctgctgggtcagggctgcccgtgaccccagacaccactgtccgtcctgtgaggctcctgtctgggcatgtcctgggtggattcctcctttctgttaagtagctacatgaggcaggggctcctggatccaaaaaaaatgacaggaattccagagccaggtgcatccactcaggacagccagtgttcgtggagctgcctctccacaagtgaaagtcagccctcccctctcatgagaaaagaacctgtggatacctctcagcctccagcgttgcaagtgcaaggccagtggagttaatctgcaacgtgcatgagggcatgtgtcagtggctgtgtgcaggagcgtgagtgagcaagagtgagagcgcatggctcctgctgtacctcaaagtgtgggctcctggtggctgctcagcgttcccaggggtgagaggcctcatgcatcctaggctgtctatatatagacacagattttcttctctgtggtctggagcgccgcctggtggtcttgtgcttccctgcagggaggtttgtgtctgggctcacactgaggtacccattctgtctcccacgggaatgtgtggccctgcccttggccatcacggagctcagctgcagggataactgggccttggatgtgtctctgcagatggacagttggcccagaagggtgggctgaagtgtgtgctgcccctggagctgaggtgccccagtgccttcccagagtgctgctgggtccaggcccagaggtctgtgaggacctcaccagccctgggcatgactctagtagctgcacttgatgcaggacactcagggccaagaagcaaagacatgagtcgcaaacggacaccacagcccacagccccagttctgaaatctctgagacactcacatggaagtatagccatcaggcagaggacgacgcagagagatctcatattttcctcaacaaggggcacgactttcccagtggcctctccaggacagaacaagaaaaaataactggctctctctagcctgaggttgcatttcgccgagtctctgggatggaaatgtgtcttgtgtcttcaggagtctgcagggcagccgctgctgtgactcaggtagaaacttctctcccctgatgtcctggccccttgttatccctgccacggtggaatcagactgggcaccgctttagggagaaacggaggacatggagtgagggctggttagtggagactattgaaaggagtcaaaactctccaggggaagagacgcctccaggaacccttggcattgttttcttcacttcgcaggagtaggaaggagctgagagtctagagagagcctcagatgcacaaccctaatttggcatatcagggagcaatctcatcagcccaggagaaggcccaggagaagggtcagctctttgtgcctctgcagagaagcggcagggactgggagggctttttccctgcccagcaggtggtgctgcctccttgttccctgcttggcacagcctcggggtgcagctgctggctttcccagggcctgtggagagcgtcttcttggtacttccttaacgtcaaataaagtgaacgccttctcaatgcacatcttaattcatcattggaaaggccaaaacacacacacacacacacacccctatatttttttctgacaagagctagagacaattgataagtatgttatctgactatagctcaccttaaggaggaaaaaactattaagaaatttcttaagtgtaaattgtgcctaatcatgtgtaaattagtaacagaagcaaaaaataataactgcagtcaacttatacactttaaaagaatactctgtgaaacaatgacatgttatcaaaaaagggatacttaatttgttatgtgtggtgacggtcaatgagcagacttgtgttcttgctggagaagtcacagcatccccacaggtggacttcctgcagcaatcttgcatgcctcacacttctgtccaaagcacgtaagggaggagctcagtgcgcacaggaacctgacgcctgccacccaagggatgcgtgagcttccgtataagcagaagaagatggaaacttcagcacctgcaacagaagaggctttctgctttggggacccaaacagttccatctatggtggaggtgtaggctcattcctacatcaacgtcaacaagccattgaacacaacaacatttaggagtagtcgagcccaccttctccaatgtggcctgcacagcccaggctgcagggtgggagaggttgattctggagaaaagtcattcctgctcccctggtacactctcctcccccactgcttcatacagagaccaatgtgatgatgccatcatgatgttgaagcacacactgaaccctgtaatcaattaaagggttttcccatccacccatccacacacacatccacccatccactcacccatccatccatccatcacttatccatgcatccatccacccacccagccatgcattcatccagccatcccacaatccacccacccacccacacatccaaacatccatccactaattcatgcatctgtccacccatccagccatctgttagcaggagcgaatccatacaggtctgcagcaacttgattctcgcctccttggaggaaagaatttggccaaggggcatgcagaagagtgagagacccaagcaagttttagagcaggagtaaatgtttattaaagttttagagtgggaacgaaaggaagtaaagtacacttggaagatggctaagtgggtgacttgagagatctaagtgctctgcctggcccttgacttggggttttatacattggcatggttctgggatttgtatttcttctcccttgatttttcctttggggtgggatgtccacatgtacagtggcctgccagtgcttcggaggggccgcgtacacaatgggtttaatgaaatgtgcacatgctcatttgaggtgtttttctcttacttttagagtgttcctagaggaagattatgtgccagttaaactctgccactttgcctcttagtgcatatgcttgagcccactcatccaactcctgagatcttatcgggaagctgctgatgaccagtttcgggtgttttctatctattgggagactgccttttcttggtgcccgctgagatcaattattattatttattattattattattatttgagacagggctttgctctaccaccaggctggagtgtggtggcgcaatctcagctcactgcagcctctgcctcccaggttcaagcaattctcctgcctcagcctcccgagtagctggaactatagatgcacgccaccacgcccagctaatttttgtatttttagtaaagacagggtttcgccatgttggccaggatggtttcgatctcttgaccttgtgatccacccgcctcagcctcccaaagtgttggtattacaggcgtgagccaccatgtccagccgagaccaattattattttagagaggcagtttaacaatcacttgactatcagctcatgcctgcctaactacccactctaatacatccatcccttcacatacccattcatccatccatccatccatccaaccatccactcacttatctatccaagtactcatccatgcatgtagccacccacctacccactcattcatccacccacccatgcatccatcaacctacccatccacccatacatgcatccatctatctttccactcttccatccacacacctactcagccattcatccatccatccatccatccatccatccatccatccatccactaatccatggttgggtccatctgtctgtgcggcaaacatgcaaggataagttccatgtgacaagtctgaactcagtgttggaatcatgggaggggcaaggtggaacaggctggcttcctcaccactattaacactgtggggagaaggccgatggcaaactcacttccatgttaagtttcctgaaagaggaaggggagtgtaatgctagagagtaatggaagctcccactgttgacacagaggtaataaatgcctgtctgatgagctaagacctgcaggaacagaaacagccacatgaaaacaaggcaggaaagaggcctatggcagaagagcagctgctgaaagttcccttaggttgggcaaaactgctatgttttgaggaacttagaacagtccaagggcaagctaccgccctgtgtttctcctcttcccccgtgtctgtctgtgttccacagtgattgtgcaaactctaaatacattgatgactcaccattgcctttatgttagaataaacaaaacagaaaacaaatccctgatgaccccacaggttgccctctttcactttgtatctctcatttctgcctctctctctctctctctgtctcccttcatctggcccatctctctgtatatctttttgtcttattatttcaacaaagtctcttagggtccatctactgtgctggaaactttcttctcaccaaccattgtaagttggagaatgttttctccaccttattacaaaatgttatagctaattctcttactgcagaataatctttaatatgggtgccctgtttttagaatttaaaattagtatcaattgccattttttcacaattacaattagtattttacaaatgagttttgtaacagggcagggcattaatgaattaaattactctgtaataggaatgagaaattttattttaatatttttgagacagagtcttactttgtctctcaggctggagtgcggtgatgtgatcttagctcactgcaacctacacctcttgggttcaaacgattatcctgcctcagccccccaagtagctcggactacaggtgcacgccaccacgcccagctaatttttgtatttttggtagagacagggtttcaccatgttggccaggctggttttgaacttctgacctcaggtgatccacctgcctcagccttccaaagtgccgggatacaggcatgagccatcatgcccagccaagaaattttatttttaatggaccctcttagatagttattaataatggcagtatcaaaatacatgcaattatgcatatggaagtagcttttttcctgcaaactcaagaatatttcaaatcatcttctctttattcttttgaattacatgtgtgagaaacagattataagtatttcatgtcattttcccagacatcactataagcatcaagtaactattcacatgtgtgccagcgatttatcatcatactcatgagggttttctatttctagaagttgcccattttttgatctcttctttgctttttccttcttgtaaatgttggacttcttaattcttttctaatgctgcagatcctcctagggaaggattctctacagtactacatgtgttagaatgttgggtgaaaaattatacatggtttaaataatgaatgagccccaaaaaaagagctggatgttgccaggtgctaggaatagacaaaattaaaaagggcatttgaattgagaatgaaacctgaatgccccttgcatttctgaggtaggtttaacatacacaggacaggagcagccttgtgtgtcttctgggactggagctgaggtttctgctttagtagagaggttttttttttaataattagtttctcttttgattgacacataaaaatgacctatatttattctgtacagcataatgttttgtaacatgtctacataggggagtggctccactgagctaattaacatctgtatcactcacatactccccatacggctagagaggttctaagttggcttcagccatgacgtcaggtgagaaacattccccatgaagagcagccctggacatggtagaaaagcaaaccccaagccctcgctgttcacaaagtggtcctagtgtctcacccaccatctggagctgcaacactgagctaggaaatcaccgccgtggagtgccactggcagcgcacaggtcccagcagcccggaataaggcgccatccacagatgcctgctcccggcggaccacagctcctgtggtgaggtctcatacatagaaaccatgtgatgagcatgggaaaagcctgttatggcattctgaagaccacaaagagggaggtaaacctctagagatgacagatacttcaagttactttctgatttttctaaaattataaaatagatcaacaaaaagctagagaagaatgaataattcaagaacagattttaagaaagaagaactttctgatgtgtgaaagtacccaatatgcattatcataattgtaggcattgagctctcaatgaaagaatgacctcacacttgacactcagaaggggataaataatgttggacagattgccaaagtgctctaggaagaaaataatccatctttaattttacaataccactctttctacaatgatagcaaaaaaaaatccagatacaaatggcaggaaagtggagcatacagtttcttgctgaagctgctgttgatgaatgtgcttcacttgcacgatctcagctgtgcatagtgtgtggccagtggggagcagtgcttgtgggtggctgaataatgcatcccccaaatgtttacattcaaactcccagaacatgtggatttgtgacctcatatggcacgaggaactttgtagatgtgattaaattaatctcgagaggggagaatatgaccctgcattttctgggtgggtatgacataatcacaagggtgcttataagtggaagcaggagagccagagtcaggggaagggtgatgtgatgatggacacagaaatgagaggatggcctttgaagatggaagaaggggacacagagcaaggaatatgggttctagaatctggaaaaggcatgaaaacagaatctccctcccagggttcagaaggaaccagctctgccaacactttgcctatagactaataaaaccgcaggacaaccaagaaactgctctttcttacatagaacacagtcagtatgctcacatgacatgggtgggtttgagagttaaaggagactgcaaggcctctgggtgaaacagggcaggaatcaggtggagcaagagggtgggtgggcaggacctgattttcaggagtgtaaatgtgaggcactgatgagatttccaggtggagacagagggaggagttatgtgttcaggtctagagtggagctggtagcttggtctgagcctgagaaaggagggcatcctctagggattgagagtaggaaaaaggaagagtggattagtgctaagaactaagtgggagatttctggaggtttcagctcacagagccagcaatggcttatggttggggtttgtaaccccagtcactgaaagtgtcctcccagcctttctttgcatatgcccctgggactgagttcctgcgttgggtggtcacttaccattccctaagaggccctaagcacctcctgcagcccagcaactcctggaccctctggagaggaagtttgtgtttgtgtttgcttacggagcccggctgcagagaaaacaagttttgttttttattttttcgaaaggatctcactctgcctgccacccacactgaagtgaggtggtgccatcatagctcagtgcaacctcaacctcctggcctcaagccaccctcccaccttggcctcccaaagtgttgcatttacaggtgtgtgccaaggtgcccagtcaaaaacgggttcttggctgggcactgtggctcaagcctgtaatcccagcaccttgggggtcaaggtgggtggatcacttgagcccaggatttgagaccagtctgagcaacagactgtgacatgaccatttagcctatgcaaatgtggggctggttaaatggtctatgtggggctgtcgccttgtctttgcatctgtcactgaggccagaagtcagcagggcatacatttcggaaggaaagacagtgggcaagctgaggtggacagaggcatccacagggatgggttgggacacatgaaggcaggtgaaaccatgttgtctctcacaccctttcaagggtctcagagacttgatttagaattttgatttttgagaacatttgttatagatgctaaaaggctcaaaatatttgatcaaaacagaatcacaggccattgtaaaatgatagttactaatttaaccaaagtggtaattaaaaagactttggaggtgagtcaagatggctgactagatgcagccaggaggaacatctgccatggagggagtgagacatcaggaagactggtgctttccaagcagatctttaaagggaaggcattgagagtggactgagagatgccgggctgaaggtggaggaagatgggaaccctgcatggggatgccgagcaccaggactcattcctggctcccagcaactcctggggaaaggttgagttgaacaggtgaggagtggcctgctgttgccatgggcctccagaatcctagcagcaggagaccccatgacccccatggacacttgtgctggcagggacagctgcttagagggataccaagggtaggactccagtctgtgtaaagcccagagtgtttgacatgagaatggctgtagtggagcacagccaggtgacacccatcccccaaggctcaccaacctcctctaggagattttaaccttagagtgactattggagctgaatatagcagggtggtcttgtccatgggacagggcccatctgaaatgagcatttccttgccttctggcctctcctggggccccaggctggctgtgcctgcttgcagtacagccttggaagcccaaccagggtgtttcctgggggccctcatcatagctcctttgccagcagaccatgcctaaccattggggacctccagcaagccagcctctgctgatgtgcaccagtccacccatagcacctcccaactgctttgctggcatgagtgcacagcggatcacaactccctctaccaccagcaagcatgtgcatgtgcaccccgccaccctgtccctgccaacacacaggcacctcactgtcctgtgactgccagcaggaacctatgtagggatgctgccaccctgctcctgccagtacccccaccccagcagaggcatgtgcaccctgccatgacaccacaactgctggcacctatgagtgagaatggatcccactgccaccactctaatgaagtgctttggccggcaccacctactatagtgttgtggccagtggactgggaaaaactcagcccctccaatgcagcaagtttctaaactcaaggggccagagaataaagccaggggcccagtcccagagcagagaacacaccacaagagtgctgaggtcagcctggaccccctaagattttcaagaaacacagctaactgaacccactttataccacaatcaaacctgcaagagtatcaaagaagataagagcaaaaaacaaacaaatgaacaaacaaacaaaaacacacaccaaaaaacaacaaaaaagaaaaaaacatccaaaggacagccacttcaaagattaaagaaacagcccacaaagatgagaaagaattaatgcaagaaactctgcaactctaaaatccagagtgtcttcttacctccaaacgaccacactggtttcccagcaatggttcttaacctgactgaaatggctgaaatgacagacatagaattcagaatatggataggaaagaagataactgagattcaggagaatgttgaaacccaatccaagggagctaagaaataaagtaaaatgatacagaagctgaaagatgaagtggccattttaagaaagaatcaaaatgatttgatagagctaaaaaactcacttcaagaatttcagaatacaactacaagtattaaccgcagaatagaccaagctgaggaaagaatcacagagcttaaaaactgattctctgaattaactcagtcagacaaaaataaaggaaaagagaacaaaaaagaaggcataaaacctcagagaaatgggtgattatgtaaaaagatcagatctatgacacattggtatcccttaaaaagagaaagagaaacaaagcaacttgaaaaacatttcaggctatcctccatgaaaatttctccaacctcaccagagaggccaacattcaaattcaagaaatgcaaagaacctctgcaagatattatacatgacaaccatccctaagacatatagccatcagactcttaaaggttgaaaggaaaaaaaatgttagaggcagctagaaagaaggttcaggtcgcatacaaagggaacccaatgaggctaacagtggatgtttcaccagaaactgtacaatccagaagagattaggggcctatattcagcattcttaaagaaaagaaattccaagcaagaatttcatatctagccaaactaagcttcacaagtgaaggagaaataagatccttttcagacaagcaaatgctaagggtattcatcaccactatatttcccttacaagaggtccttaagggattgctaaatatgataatggaagaatgttactgaccaccacaaaaacacacttaagtacataacgattgccactataaatcaactatacaatcaaatctgcatattgagcagctaacaacatgataacaggatgaaatatgcacatatcaatattaatcttgaatgtaaatggactaaatgccccaattaaagggcacagaattgccaagttggataaagaagcaagacccaaatgtatgctgtcttcaagagacccatctcacatgcagtgacatccacaggctcaaagtaaaaaaatggagaaaaatcaacaaagcaaatggaaaacaggaaaaagcaggtgtttctttttttttaatttttttattatactttaagttttagggtacatgtgcacaacgtgcaggtttgttacatatgtatatatgtgccatgtttgtgtgctacacccattaactcatcatttaacattaggtatatctcctaatgctatccctcccccctccccccaccccacaacaggccccggtgtatgatgttccccttcctgtgtccaagtgttctcattgttcaattcccaccaatgagtgagaacatgtggtgtttgctttttgtccttgcgatagttcggtgagaatgatggtttccagcttcatccatgtccctacaaaggacatgaactcatccttttttatggctgtgtagtattccatggtgtatatgtgccacagtttcttaatccagtctatcattgttggacatatgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctacacatcttctccagcacctgttgtttcctgactttttaatgattgccattctaactggtgtgagatggtatctcattgcggttttgatttgcatttctctgatggctagtgatgatgagcattttttcatgtgtcttttggctgcataaatgtcttcttttgagaagtgtctattcatatcctttgcccacttttaatggggttgtttgtttttcttgtaaatttgtttgagttcattgtagattctggatattagccctttgtcagatgagtagattgcaaaaattttctcccattctgtaggttgcctgtttactctgatggtagtttcttttgctgtgcagaagctctttagtttaattagatcccatttgtcaattttggctttggttgtcattgcttttggtgttttagacatgaagtccttgcccatgcctatgtcctgaatgataatgcctaggttttcttctagggttttcatggttttaggcctaacatttaagtctttaatccatcgtgaattaatttttgtataaggtgtaaggaagggatccagtttcagctttctacatatggctagcctgttttcccagcaccatttattaaatagctaatcatttccccatttcttatttttgtcaggtttgtcaaaaatcagatagttgtagatatgcggcattatttctgagggctctgttctgttccattggtctatatctctgttttggtaccagtaccatgctgttttggttactgtagctttgtagtatagtttgaagtcaggtagcttgatgcctccagctttgttcttttggcttaggattgacttggcaatgtgggctctttttgggttccatatgaactttaaaataattttttccaattctgtgaagaaagtcattggtagcttgatggggatggcaatgaatctataaattacattgggcagtatggccattttcaggatattgatccttcctacccataatcatggaatgtttttccatttgtttgtatcctcttatttcattgagcagtggtttgtagttctccttgaagaggtccttcacgtcccttgtaagttggattccaaggtattttattctctttgaagcaattgtgaatgggagttcactcctgatttggctttctgtttttctgttattgggttatagaaatgcttgtgatttttgcacattgattttgtatcctgagactttgctgaagttgcttatcagcttaaggagattttgggctgagacgatggggttttctagatatacaatcatgttatctgcaaacagcgacaatttgacttcctcttttccgaattgaataccctttatttccttctcctgtttgattgccctggccagaacttccaacactatgttgaataggagtggtgagagagggtgtcgctgtgttgtgccagctttcaaagggaatgcttgtagtttttgcccattcagtatgatattggctgtgggtttgtcatagatagctgttattattttgagatacatcccatcaatacctaatttattgagagtttttagcatgaagcgttgttgaattttgtcaaaggccttttctgcatctattgagatatcatgtgttttttgttgttggttctgtttatacgctggattacgtttattgatttgtgtatgttgaaccagccttgcatcccaggtatgaagcccacttgatcatggtggataagctttttgatgtgctgctggattcagtttgccagtattttattgaggatttttgcatctatgttcatcagggttattcgtctaaaattctcttttttttgttgtgtctctgccaggctttggtatcaggatgatgctggcctcataaaatgagttagggaggattccctctttttctattgattggaatagtttcagaaggagtggtaccagctcctccttgtacctctggtagaattcggctgtgaatccatctggtcctggactttttttggttggtaagctattaattactgcctcaatttcagagcctgttattggtctattcagagattcaacttcttcctggtttagtcttgggatggtgaatgtgtcgaggaatttatccatttcttccatattttctagtttatttgcatagaggtgtttatagtattctctgatggtagtttgtatttctgtgggatcagtggtgatatcccctttatcattttttattgcatctatttgattcttctctcttttcttctttattagtcttgctagcggtctatcaattttgttgatcttttaaaaaaaaccaactcctggattcattgattttttgaagggtgttttgtgtctctgtttctttcagttctgctctgatcttagttatttcttgccttctgcgggcttttgaatgtgtttgctcttgcttctgtagctcttttaattgtgatgttagggtgtcaattttagatctttcctgctttctcttgtgggcatttagtgctataaatttccctctacacactgctttgaatgtgtctcagatattctagtatgttgtgtctttgttctcattggtttcaaagaacatctttatttctgccttcatttcgttgtgtacccagtagtcattcaggagcaggttgttcagtttccatgtagttgagccgttttgagtgagtttcttaatcctgagttctagtttgattgcactgtggtctgagagacagtttgttataatttctattcttttacatttgctgaggagtgctttacttccaactatgtggtcaattttggaataggtgtggtgtggtgctgaaaagaatgtatattctgttgatttggcgtggagagttctgtagatgtctattaggtctgcttggtgcagagccgagttcagttcctggatatccttgttaactttctgtctcgttgatctgtctaatgttgacagtggggtgttaaagtctcctatgattattgtgtgggagtctaagtctctttgtagatctctaaggacttgctttatgaatctgggcgctcctgtattgggtgcatatatatttaggatagttagctcttcttgttgaatttatccctttaccattatgtaatggtcttccttgtctcttttgatctttgttggtttgaagtctgttttatcagagactaggattgcatctcctgcctatttttgttttccatttgcttggtagatcttcctccatccctttattttgagcctatgtgtgtctctgcatgtgagatcggtctcctgaaaacagcacgctgatgggtcttgactctttatccaatttgccagtctgtgtcttttaattggagcatttagcccatttacatttaacgttaatattgttatgtgtgaatttgatcctgtcattatgatgttagttggtcatttggctcattagttgatgcagtttcttcctagccttggtggtctttacaatttggcatgtttttgcagtggctggtacaagttgttcctttccacttttagtgcttccttcaggagctcctgtagggcaggcctggtgatgacaaagtgtatcagcatttgtttgtctgtaaaggattttatttctccttcacttatgaagcttagtttggctggatatgaaattctgggttgaaatttcttttctttaagaatgttggatattggcccccattctcttctggcttgtagagtttctgctgagagatcagctattagtctgatgggcctccctttgtgggtaacccaacctttctctctggctgcccttaatatttttttttcatttcaactttggtgaatctgacaattatgtgtcttggagttgctcttctcgaggagtatctttgtgacattctctgtatttcctgaatttgaatgttggcctgtcttgctaggttggggaagttctcctggataatatcctgcagagtgttttccaaattggttccattctccctgtcactttcaggtacaccaatcagacatagatttggtcttttcacatagtctgatatttcttggagggtttgtttctttctttttactcttttttctctaaacttctcttctcccttcatttctttcatttgatcttcaatcactgataccctttctcccagttgatcgaatcagctactgaagcttgtgcattcatcacgtagttcttgtgccatggttttcagctccatcaggtcatttaaggacttctctacactggttattctagttagctattcatctgatcttttttcaaggtttttagcttctttgcaatgggttccaacttcctcctttagctcggagtagtttgatcatctgaagccttcttctctcaactcgtcaaagtctttctccatccagctttgttccattgcgggcgaggagctgcgttcctttggagggggaaaggcactttgatttttagaattttcagcttttctgctctgtttttcccccatctttgtggttttatctacctttggtctttgatgatggtgacgtacagatggggttttcatgtggatgtcctttctgtttgttagttttccttctaacagtcaggaccctcagctgcaggtctgttggagtttgctggagctctactgcagaccctattttgctgggtatcagcagcagaggctgcagaacagcgagtattgctgaacagcaaatgttgctgcctgataattcctctggaagcttcatctcagagaggcacccggccgtgtgaggtgtcagtctgcccctactggagggtgcctcccagttaggctacttgggtgtcagggacccacttgagacagtctgtccattctcagatctcaaagtccatgtgggagaaccactactctcttcaaagctgtcagacagggacctttaagtctgcagaggtttctgctgccttttgttcagctatgccctgcccccagaggtggagtctacagaggcagacaggcctccttgagctgcagtggactccacccagtttgagcttctgggccactttgtttacctactcaagcctcagcaatgatgggcacccctcccccagcctcgctgccaccttgcagtttgatctcagactgctgtgctagcaatgagcgaggctctgtgggtgtgggaccctccaagacaggcatgggatataatctcctggtgtgccgtttgctaagaccattggaaaagtgcagtattagggtgggagtgactggattttccaggtgccgtccatcaccacttcccttggctaggaatgggaattccctgaccccttgcacttcctgggttaggcaatgcctcaccctgcttcagctcactcttggtggtctgcacacactgtcctgcccccactgtccaacaagcccccatgagatgaacccagaacctcagttggaaatgcagaaatcacccgtcttctgcatagctcatgctgggagctgcagactggagctgttcctattcagccatcttggaactgccccctcatagattcttgatattagacctttgtcacatgctgatgtggttttgctctgtgtcattaaacaaatctcatctcaaatagtaatcctcggccgggcgcggtggctcacgcctgtaatcccggcactttgggaggctgaggcgggcggatcacgaggtcaggagatcgagaccatcccggctaaaacggtgaaaccccgtctctactaaaaatacaaaaaattagccgggcgtactggcgggcgcctgtagtcccagctacttgggaggctgaggcaggagaatggcgtgaacccgggaggcggagcttgcagtgagccgagatcccgccactgcactccagcctgggcgtcagagcgagactccatctcaaaaaaaaaaaaaaaatagtaatcctcatgtgtcaagggatggacctggtgggaggtgacttggtcatgggggtgatttcccccatgctgtcctcatggtctcctgatagtgagtgagtgctcatgtgatctgatggttttatcaatgtatggtggttcctccttcattccctctctctctctttctctctctctctctgtctctcacctgctgccatgtgtcacatgcctgcttccacttccaccatgattgcaagtttcctgagcccccgaccctaaccacacagaactgtgagtcaattaaacctcttttctttacaaattatccacttttgggcagttctttatagcactgtgaaaacagactaatatagtaaattggtaccaggagtggggaactgttataaagataactgaaaatctggaagcaactttggaaccgggtacctcctgacagaggttggaacagtttggagaacttgaaagaagaggggaagatgtgggaaagtttggaacttcctagagacttattgagtggttttgactaaaatgctgatagtgacatgaacagcgaagtccaagctgagctggtcttagatggtgaggactaaactctgattttttttttatcttgcccaaattcctatctaaagagtctggggaggcatgctctacaaatcataaattctcatcagataggttttatttaaacctatatatcatgatttactttccaaactgactctggcataacattatgagacaaataagaaaatcaaaatattttaccccaaaacatgtttctttgccatactctgagatggccctgcaggccgggcatggtggctcatgcctgtaatcccagcactttgagaggctgaggtgggcggatcacctgaggttgggagttcgagaccagcctcaccaacatggagaaaccctgtgtctactgaaaatacagaattagccgggtgtggtggtgcatgcctgtaatcgtagctactcaggagactgaggcaggagaattgcttgaacccaggcagtggaggttgtggtgagacaagatcgtgccattgtactccagcctgggcaacaagagcaaaactccctctaaaaagaaagaaagaaagagagagagagagagagagaaggaaggaaggaaggaaggaaggaaggaaggaaggaaggaaggaaggaaggaaggaaggaaagagaaagaaaagaaagaaagaaagaaagaaagaaagaaagaaagaaagaaagaaagaaagggccctgcaaagctgttctttgtgggggaaaatttgcatctgtaaagaatctctattaacatggctagatctttttcttctagaacctcccaatcctaaagagttgaactaagatctgaataggaaacatttgtcacctattatctctaagggcagccactataagacttcaaaagaactttggactctagaatctttatcttaacctgaacattacctttctatctatcccaggtctttagacaaactcaaccaattgtcaaccagaaaatgtttaaattcaccaatagcctggaagccctcgctttgagttgttccacctttctggaccaaaccaatgtatctcttaaatgtatttgattgatgtctcatgcctgtataaaaccaagcttgatggaatttttccctgccctagaaatctgtggaactttgcccttgagagagatgatctgaaataggaacttatgtttaaaagggaaacagagcataaaagtttggaaagtttgcagcctggccatgtggtagtaaagaaaaacacatttgctagggagaaattcaagttggctgcagaaatttgcataaataatgaagagatgaatattaataaccaagacaatggggaaaatgtttccaggccatgtcagagatctttgcagcagcccttccaatcacaggcctggaggcctatcagggaaaaatggtttcatgggctgggtccagggcccagctgctctttggagccttgggacttggtgccctgtgtcccagctgctccaggtctagctgtggctaaaaaagtccaatgtacagctcaggccattgcttcagaaagccccaatcattggtggcttctacatgatgttgggcctatgggtgtgcagaagagaagagttcagctttgtgatcctctgcctagatctcagaggatttatagaaatgactggatgtccagccagaagtctgtgccaggggcaaagccctcatggagagcctctgctagggcagtgcagaagggaaatgtggggttggaacccccacacagagtccccaccggagacagtgactaatggggttgtgagaagagggccaccatccttcagaccccagaatggtagatctattaacagcttgcactgtgcacctggaaaagctgcaggcactcaatgagagcagccaggagggctgaactctgcaaagcccatgagagcagccatgggatcagagctgcaaagccacagggtgagagcttcccaaggttgtgggagcccccactttgcataagcatgccctgaatgtgaggaatggagtcaaaggagattattttgaagctttaagatttcatgactgccccactggagtttgggcttgcatgtgacctgtagcccctttattctggcccatttctcccaactgaaatgggagcatgtatctaatgcctgtacccccattttgtcttggaagtaactgacttgtttttcattttacaggttcatagatgaaagggacttgccttgtctccaatgtgactttggatttggacttttgagttaatgctgaaatgagttaagatgttgggggactgttgggaaggcacgattggttttgaaatgcaaagaggacatgagatttgggaggggttggggtggcgtgatctggtttggctgtgggtctctacccaaatgacaccattcctcagggtgatcagcgagctacctgatggcaggttggattatattggacctcttccatcctggaaagggcagaggtttgtcctcactgaaatagacacttactgcagatatgcatgcaatgcttctgccaagactaccatctgtggagtcatggaatgccttatccactgtcacagtattccatatagcattgcctctgaccaaggcactccctttacggctaaagaagtgtggcagtgggctcatgctcatgggattcacttgtcttaccatgttccccatcatcctgaagcagctggattgatagaagaatggaatggcctttcaaaatcacaattacaatgccaactaggctccaatactttgcagagctggggcaaagctatccaaaaggccatgtatgctccaaattagcatccaacatatggtactgtttctcccatagccataattcatggatccaggaatcaaggggtgggagtggaaatggcaccattcaccatcacccctagtgatcccctagcaaaatttttgcttcctggtcccatgacattacattctgttggcctagaggtcttaattccagtgggaataatgctgccatcaggagaaacaacaacaattccattaaactggaagttaagatttccacctggccactttgggccgctcctaccttcaagtccacaggctaagaagggagttacagtgttgactgggctgattgacctgaactatcaagatgcaatcagtctattactccacaatggaggtaaggaagaatatgtatggaatacaggagatccattagggcatctcttaacattaccctgccctgtcattaaggtcaacgggaaactacaacagcccaatccaggcaggactacaaatggcccagacccttcaggaatgaaggtttgcatcactccactaggagaaaaaactctacctgctgtgatgcttgctgaaggcaaagggaatacagaatcggtagtagaagaagtagtcatcaataccagctacaaccacgtgatctgttgcagaaatgaggactgtaattgtcatcagtatttccttcttcttttgttaaaaacatgtttgtgcatgtacacacttgtactaagaaaattccttcattttatttcttttttcctttatcatgtgacataaaatttattgacttcatatcagcatttaagtgttcttaactttacataatagcacttgggttggggattggtgcatttctggttgtacaaaagatagttgtattacattaggtgtaattatgaccttattattgtctttatttgaagattatgtatgatctcaggagattcgtatgggttcaagttgacaagggttggacttgtgatggttaatacagagtgtcaacttgattggattgaagcatgcaaagtattgatcctgggtgtgtctgtgagggtgttgccaaaggagattaacatttgagccagtgagctgggaaaggcagacctacccttaatcttggtgggcaccatctaatcagctgccagtgtggccagggtataaagcaggcagaaaacatgaaaagactagactggcttagcctcccagcctacatctttctcctgtgctggatgcttcctgccctcgaacatcagacttcaaattcttcagctttgggattcggactggcttccttgctcctcagcttgcaggtggcctactgtgggaccttgcagttgtgtgagtttaatactcctcaataaactcctacatatatataatatataatacatattatatattatatatatacatactagggttctctagagggacagcactagatatatatatatatagtttccatagtctgtggtgtaaactatgtgaaatggtctttacaacctcctgaagggtaacacccagactgtcacctgaactccctgaaatcctgtgccctggggattggagaaaccttaaaaccaaagccagtgttaagttagctcagtctttgattaaacatggcaatctccctatacttggcttccaggggtgggtgagggagaattcctgcctggaacaaggtcgcattacaaagaatcttcacaatgctcatgagacatcttggaccttccatcagaagcattcaggatggcaggagactggccatgatgagcaaacatggggagaggaggaaggaaacagagaatggaaggaggtgacagctgacaaggccttgtgttcccagatgctgagtgtgaaatgaagcgtttatgatgaaggaaacagaacagatgtacggtacaatattaaatataaaacagtaaattacagcaggtggcttcacagcagcttagacacagcagaagagaagaggatggaattggaagatcgatgctcaggacggatgcagagtgaagccgaggacccggcaaagaggatttgggagttgcaggctctggcagaggacccaccccagaaagagagaaggagggggtgggaggaagaaggaatgtttgaaagtgctccatagagaaccaggacagccccttgggccaagcaacccacgacccttgcagcttcagaagtccagactccagcctggcctcacatgctggttggtcttatccctgccaggccagaaccctcttcagaacccagagcccccacagctctccctcaccctattcccaggacatgtctcctgtgtactcttccctggcccacaggtgggagtttacacctgcttgggtagcctcggcatccacaccaacaacccggtagcagttgtcctgctccctccacctggcacagctcgaatctcccacagtgcaggccccgtgtataggagtgattaggacacacaggagggcaggtcaggacaacaggtgctgaggcaggcagatttcgaggatttaagtgctgatgctcttggaagaccatttccatggggttaattgtggtttttcttggtgaactgttggcttgtttttgatattgttgttgctctaaatagtgtttacctggcttcaatacaaactctattggtcatgttctttgttaaaatatgtatcattctaaaagttcacatggcattagattttttgctcaaactacctataatatttctccaacagagtgcacatttgccttccttctgcacataccaccgccccctgcgctgagcagtgtcccagtgggtccatctgtttagggggtgaggaaggggacacaggccctgacacaatgtggggctgtgccaagcttggtggtcttgcacgggcactgagtgggtgggccctggagagaggggaggtcattcccccagggaaccccccaggccacagggaagaggtcagctgggtgcatgaggtggagggtggagatgcataaagggtgggacggggcctgctgttctatcagcaaaacccctcacacccgaaggacacacagggcgagggcattgtattcactgacctcacacttcactgtccattagcgttcacccacaaaataatagaacaccctgagagaggcacaggaatgcattactcgcatttttatgacagctgaatggaggaaatttctaagcaggttcagagaaaggatatcaagctgtgtttggagaaaggggtgggaattctaaacaatatctgtggaagcaggacatctagaaccacagatgtattcagaaaaatgctagatctcagtactactctagaataccagcagttttctgttgatggtatgggaagggtgatatcttccgttggtgggctttgcctttgacattctctgtgacatatctacactgcattttaaacgtcaatattattgtgaattgtaagttaaaataaaatgttatctcattcagttatttatacatttaacttccattttcctttacaacaacttagcgacacacctagccctgttttccacccagaccagcctgtgctgctacaagcctggtttctcttcctcatcatgacttactcagcttcccttcctgtttcagttcaagaaaatgtgggggcaagaagaaagggggcagctgccactcacagagctcacactaaatgacagacagcttgccctcacgtctacctatttttctagttgaatttcattgcttgcagcaatcaacctgagggattcattttcccacatacgggaagctcggccccaggtagggggatttgcttggtgggggatttgaacccaagtccctctcactgcaaagcccacagcacccctgtaaggaacagacagggaacagggagtagccctggatcaccctaaactgacttcgggtttagagaaggactgattacctggggaatgaggaagcttattgctctggagctctcttctggagaaatgtcatgaacgtgccctgtaaggagctggtggcaacttccgttaattccgggaccagcgacctcaggtcaagagccagatgctcattcatgtctctccaggccagaggttctggccaagtttgggctcccagaggagtctaagaaaatgtggaaggcaccaatgtgtgtttttgaagatttatttcagagtgaacatcagcgacctacaagaacctgggatagaagccaatgcctcccctttccctgtgacgtgagacaggaccatgtgcctcctgtggacttcaagaaatgtggacttgagctttgccatcccttcgcctgatcctatttcatagattttgctgttatattctctgtatctttacagggatcgggaggctgaattagtcttattcagggttagtaactgtctcttcctaaccggtggtggtcctgataagtttgcacatttgtggctgtcccaaagagcagtgcaattatgaaggcgtaaatacgaccaaagaccactctcagatacatctctgattgttggctttgtctgagagaacatgttctttttggaggtggcccgctgtcgacactcccaccagcacctcttcttaggcacagtggaggatcccagcctatatggcaatggcagttccttctgttgttgcagacccctctatgactgcacttctcaaggcgacagtcgtagcccagtgaagtgatagttgcattgcaccgggtgttattacagaagtttccatgaacacaaggagtgccatctatcacacgcccaacatcagtcatgtctgttgcatggtgttcatccagtctaaaacactgaaaccctcctctcactgagtgatggaatgaaacatgttcctgcagctggggaagatgggtcacattggtacactgcagtcctccacaaaacttatctattcctgtacaagcctggtagctgagatatgtttgttgtctaatacaatgtccaaatcggtagctttcaagatttatgtcatagcagaccttaggagcatcctcagcactgacaccaaacatcgccttgcagagcacattgcggtcagtgcagttcccatgataacagtagccttcttccatgcacagggttccatcttgcatataaaagtttgctgggcatgtcacggtggtcccgtgacagtactctggaaggtcacatatattttggataggtctgcagagagtccctggtggggagaagctgaagtttgtacagcactctcctatatgacaggtgctccccggtgttaagtgacagtcactttggcagcaataactggcataacactgcttgaaggagccacagtcacattcctccctcccctccactatgaggtttccacagcgaaccgttgtcatggtttcattatacacaggagaaagtgttttgaaaacacaccggcctggacgtataaaacaatttcgtgcatgtccataagaacagttactgaatgcatctgtcatcccaggaaatctctgcataatgcaggaggcccttctctaacatgtgcagtagttatcatcatactccagaccaatacttctcatctgtgtctgggttattatgatggctaccaataaataatgtctgcctagagtaccaatgtgtaataggcctaaatgtgtacagaagctatacctttcaggttcatagttggattcatgtggtgcgtctttaataagtagtgtggatgaatgaacatgaaaagtatcaaaaaaggttgttttaaaataggtaaacattgcactctgaattcgatattgattcacaggggctgggtcacgattattatatatggtcaaaagataaatatagtaccacagatcaatattttgaacaatgctgtcaatgagactgaacatctggaccacctctttggaacaggtggtaatattgccatatatatgataatatgaattggaacattgaacgtggccctttatattgcctctatgagaactatacagcgaattagatatcctgggattcatgctgttatttgcttcagagaacagggggtctgtctcctcattgtcaccatctctaaatgtgggcaccgttgcattgggctcagccactatctgagaaacaacatgttcaaacctgcgggaatcctggaggggtttgatttcgtaggcaaggtcgtccagcttcatgatgcctctgaggcccccatagcacgtgtcgatggtgaccatggactgaggcacctcctccaggtagccgaggtagtagcagtctggtggaatgtaggggccatccatcggcaaggctccttggtcatcctgagttgtcaccagcagatgtctgggccaaagaaggtgtttcctccgcatgtgaatgacgtgtctttgacccccaaaacgcaggctgtgggacagccagccgggaaactgaaggcctttgccgtggtgcgtctccttcctgggaatcaccacctcggaggaggcgtagtgccacaagggacggccttgagaacaccggactggagccaggagcgcccagagccccagcaggaagaggggggccctaagggtgacccgcacctctgcctgcctcatgtcccagcccagcaataattacccaacgacaatgggaaaggaaaggactgtcctcggtgaagccaggccccaaccagctgcggtggctgcgtccctcccagggagaccctgacagagaacaaagggcctccccaggctcccgcaccaaaccgcggggcacctggactctgggagggaatgaggtaacagtcccagggaggggcaggaggtgggtctggacaggacggcagctgctgcactgcgggatgaggctgagggtcacggctgtgagggctcattgggaagggaaaagggagagggaagcagggctgtctcttttaccaccgtcaatcttttctgttgctttctgaatctacaaaatgcaatgatgtgtgttcaatgccctcgcatcacccgtgttattctcggtcactctgtgggttaatatgctcctttctgtggcttacactgcttactcctttgtcatgtggaggtgggcactgccaatattttccttggggactgaatgtttttctactcttaataagtacccatgtcttattctttttgttgttgtattgttttgttgtggctttgaagttttgtttgaagttaccagattgtgaaaggaaaatatcttgggccccatcaagctgagaaccactcagggcaaatctgcctcccagtctatttaaagttgtccctctgctcacagagacagatgaatattctcatgacctcctttgcaaacacttatcagaaactcaaaagaatgcaaccatctgtctctcacctacctgtgacctggaagccctaagtggggaggacttgctttgagttgtctcagcctttctggatggaactagtgtccttcttacttatattgattgatgtctcatgtgtccctgaaatgcctaaatcaagatgtgcccgaccaccttgaatccagagttcctggattcacaagatcaacagttgatatagggtaactttttcttctgtgctatgtaaaacccttgtgaattatgatactttttacttagtccatctattgggagcagacactattcctgaccccatgagagccccaggtgctgtccctccgatgcttctgtgtggttctctcctggtctttggtcatttcttcagatgcaggagctgatcagctctcagggaaggacagagggggccctctccgggtgtctcatgtctgagaactaatgtttcacatatttctgctgattctgtcattgcttatgaggggagggaaaatccaatgccagatcataatcagaaacacaaattactgtttcctcaaaagtgtaaatatttccctttcctggcgaatgtggtcactccatttaaacttaacatgaccatagtgtgtttcgaaggctgcgttgtgtggcactttgtgttccaatgccccgtactcccatcttccaccgcttcaaatcctgcctttttaccacaaatgtacgattactaatgaagctggtttcccctctacgagcgtgcaggttggacgccctttccctacccctttagggttttcacagggagcgaaggaaaatatttgacatccctgaaggaggctgttagggtagactgtgtccctcctaaatttttgtgctgaagtcccaacccttggtccttcagaatgaaatcatacttggatcagtgtcttttaaagaggtgaataagttaaagtgagattcctggagtggggccctaatgcaatctgactgttgttataagaaggggaagcaggagggagggtgcacacgccctgagggacggccatgttaccacagaacagcgagaaggcgccatctgcacaccagggagtgagacttcagaggaaacccacccagctggcagcttgatcttaggctttcatcctccataagtgtgaggaaattggttttgtattgtaagccatccaatctgtggtatttcattataaaagccctataaaatgaatacagtaggtaataggagatcttctaaaaattgaaaaagtcggatggccagacaaacctagacactcctgttcagacctgagcagggtgatggacctgctatgggacaggagaggggaagagatgaacccagcacccagacccagctgagcccattcctcagcaggctgtccctgggccggagcttgcactggtgtgaaagagtgtgtcttggtcttcgggggctcatggagttggacagagaatggtgtaaactcttgcttacacaaaagaacaagtcatcggtgtgcccgtgtttatgtgaatgggatgtgtttctagggtgtgctcatccccaaagaaaaattaatcaggtctcttgggctagaaagaggttgtggcatttgtgtgtattaataactgcggtcggacagtaaattatgttaaaatgcttatgggaaggcacaatggaaagaaacagtttgttacagaaggaaaaaaatggtgattatttaaatgagatgcctttgaaagtcaccatgccaagaaagctgatcacatgatagtgttgggtttcatgttcaggagatcaggagggtccatttgctggcttttacgatacctagacagagctgagagtataatgtgtgaatggaggggacgtggagaaaggggaggccaaatgtttgatgggaatggagggtcactattggagccattaggaaatacacaagcatgatttgtgctgaagcacagaacagtgttcctggggaatattgtgttgctttggcagctgctgaacatacagaagtttcactgttcttagttctcaaattctctagactctcttggcagcccagttttaaatattgggaatataggtaagacacattcgttattaaaaattattaagagaagatgtaggaagaagtttaaagtaatccatttaggttatgaaaatttagttgcggcgaactgtgatgtccatttcttacttggaataatggaatgtaagtcattagtcatctcaatggttcatttttccataaccatcaattacaaaactgctgcgtaatttcctgaattgcccgccatagaagctgacctcacattttctcagtgagaaactgccagtcccgttgatccagcctcgttcttcccataggggattttgtatctctgtggacatgtggtacaatgctgcatatccatcggcatatggcctcgggaaaggttccagcctatccatgcacgatgaagcttacttaagggatgaagccggaatgctgggtgtgccagtgccgacagccgaaagaatcaactgcctggtgtatgatgcttttatgaaaacaagcccagggcctcttgctttcttctgtattagattctctggtgaatatttttattcatctctgccagaaattgccacatataattacctagaagcattacaataaactgatttggaagttaactgacttcctggtgaggttaaaatgagtgtcaggtgcatagtgagacagaccggagacatgggtgcatagcaaacttgtgctcaccatggtttctatcttagttagggaaacttctgtaccttccttagatgttcaggcactccattgaggaccctgacataacattatttattgacagaccatagcccaaagtatagaactggatattaccaaggaggatatactattactattttatctttatcttaaaatacactcttccaactgaggtgaaaattaatccagatggtagaacttattgcagttactacagcattttaggaaatcaaaagctgcagaacaaacatatggacagatggcaggtatgtttttggaatcataaacaacttcgtggtgattgtaaaaccaaggggtgtctcacaagggctggaaacctctcaaaatgaaacaacacactgaggatctttgagaagtactctgacctccaagtgagctggctgatatggaggctgagctacatgtagaaagccaaaggaatttctgcaggacatcatcatgccaagcacagccgtaacctgggttccagcccttttcacacgctcaacggttggatcttgggagggaatcaaagaagccattgtaaaatatcaaaatttaaaccctgattttgaatttaaaaagtgttaaaatatggttgtggcctacactcagaaaatctgtgtccttcagatggtttctcggtggcaccagatggtttcaagtggctattcattaggtttctcagtgaaattaccagatatagaataaataaattgtcactgtcttaaatcaacccatgggaaaggaaaactgtataaagacagcagagaggaaacattgtccacaccaaggaaaaaacaatctccagaaactgttgttgaagaaacagaggcatcacacttactagaaaaatatattgtatttcatatattatgggcatacaacgtgatgttttgatatatgcgtgcattgtgaaattattaaatcaagtaaataaacatgtctgtcacctcacatactgctttttttatggtgtaaatgtgtaaaatctactctcttatcagttttcaagtatatatagtacattagtatcactgaggtctgaccatggtgtgcaatagatcttcaaacgaattccttctgtctaaccaaaactctgtaccctttcaccagggcctcagcttttacatcctcctaacgccagctcctggtaggcaacattctactctctacttctctgagttcaacatttttagattgcatgtgtaagtgagatcatggagtaatttttataccaggcttatttcactcaacataaagacatttaaacgctcaacatcactcactaatcatcagggaaatgcaaattaaaactgggatgagatatcacctcacacatcttacaatggcttagtctgagtctgtttttgtgttgctataacagaataccagagactgggcatttcttttttttgagacagagcctcgctctgtttcccaggctgaaggtcagtggcatgatctccgttcactgccagctccgtctcccgggttcaccccattctcctgcctcagcctcccgagtagctgggactacaggcacccacaacatggagactgggcaatttttaaagaaaaggaatttatacttaacggtacttgagtcagagaagcccaatatcaaggggctggcatctgaaaaaggccttctcactgcatcatctaacagcagaggaggatgagcaagagaccacttgtctgtgagaaaaaaagaggccatcttttattagaaactcgctcctgtaataactagcccactcccatgatagtgacagtaatccattcatgaggacagagacttcatgacctgatcacataataaagtcccacctctcaacactgttgcattaaagattttttccaaatcataaactttgggtgacacatttaaaccatagcattccattcctaatactaaaatgtatgtcccaattacaatgtaaactacatacattccatcccaactgtcttcaaagtcttaactcatccagcatcaatgcaaaagtatgaagtccaaagtctcatctaaatcagatatgagtgacactgaaggcacaatttagtctgatataaattgtttccatctgtgagcctataaaatcaaaataagttatctactttcaaatacagtgaatgatgaggcaggtatgggatagaaattcccatttcaaagctcagagagaggcaaggagaaggggtgcatagtccaaaacccaacatgggaaacaacattaagccttaaagctggaaaaaatcctccttgactgcatcctgtgcacactggggagggggatgggcccccaaggcctccggcagtcttgcctctatggattttctgggttcagtccactcagcctctctcacaggtgggactgtcaagcctctagctctcctaggtggactggataccctttgtggtgcctccaaacccatatttctgcttggcattgtgctgagggctcagtgtggtgactctgtctctgcaacaactcactgcccgagaccttaggctgtccacagcattctttgaaatctacgtggagaaagccatgccctcgtggttcttctattctgcacacctgcagaattaacaacacatggatgccatggaagttgatgacttgtaccattgaagtgatggcttgagccacacctaggtcctcctgagccacagcatgggcagccaaggagtgctgtgcctggacacagggaacagagtcctaaagtgcctgctagaagtgaggccatagatttgcttcaaatttcttccatcatatatcctcgtttatggctctgaacttccactttacagaaagacctagggatgagcacaattcagccacattctttgccactttatggcaaggatggcctttgctccattttctgatgagctattcttctttttctcctgagacgtcatcagaacggcctttattgtccatggttctaccaacattctaatggtcatcacttgaataatctctaagaagtttcagaatttcctcgcaactctcttcttctgagtcctcaaaagaatcacctctagtgttctattcagggcaatctagactttttatagtctgatcctccaaattattccagactttgtgcattactacatccacttctacattttggagtatttgtaatcacaaaagccccacctcttgatactgatttttttgtcttagtccactttgtggtgcaatgaggcaatacgacagactgactaagtataagtaaaagaaatttgtgttctcacagttctagagcctgggaagtccaatatcaaggtgctagcatcttgcaggggccttcttgctgtgacacctatgtgggaggcaggaaagcatgtgcgaaggagagaaatggggctaaattcatcttttaatgaggaccccaggcctgtagtaactaatctactccctctatgagtaacccactctgccaataatggcattaattgcttcatgagggcagagccctcacgacctaatcattcctgaaagttcttacctctggacactatggaatttgggattaagtttccaatatacattctttctaaatagccagagctttttataggtttaccacccaaggctacatgaggctctgaagcagtggcctgagggtggctgtcctttgtgagaatggagaggagtgaactgactcatggagacacaagtagatgaagtaaagggactcattgcttcattacatggatagtgagggtgactgaaggcattaacggattaatcgtggtggcaaaaccatctgaggtggacaccacggggagccaaccagaaaaagaggacacatcccattaaatggtgcttcatctccttgcaaaaccaatgaaagaaagtgaaacacaacgccatagtgtataccagacagtggattgagggaagagtttcctaagtcgtaatcgacaaagtggagaaaacatacaaatctttgcatggtgctaacatttggactgtggcttcattgtttcttattaacattttagtgaaatattgctagaaggagactgaaaatgaagtatgaaaagttaaatgggatttctgttccaagttagtccttttcagatgagaggaactaagaagttacagggaagaaacaataatatctgctgagcaagatttttgcagggcaggccaaggaattaccaaggagaaaaaggaaatgtcagcttcaccttgcatctgctcccgagccaggtcctgagcaccccctgctggcgctgatcgtcccctggtgtctgatctcctctggttccctcagcttccctggtggtgtctgagccgctctactggtgtctgagcccctctgcctgccctcagctccccctcgtggtctgagccaccctggtggtgtctgaaccccgcttgtgatgtcctgagcccctctattagtgtctgagccctactggtgggtcctgagcccctttggtggtgtctgagccccctggttttgagcccccccttctgcatcctgagccctcctggtagtgtctgagtgttattttcaccatacactcaaataagattgagcagtgattctttcatctgtggtggtcattccaagtgatctgtccagggcacatggggactctatccctaggaccacttgtccccacagaaggagaaaccacagtagcagcaccaagggtaggtcacagcattgtcaccaggagtccccatattcttctcccagacgcagtgaaccttgtcaccctcttcccacactccacagggggtgtacaaagaggcatcttgcagtgacctgaccctgggatgttatggaaaaggagacagcctgagctcatgactcctggaattacatgctccagtcttggctatatacagacctacaattcttttccttttactcaggcactttgccttctggttgaggacagtgttctacagccctccacagtgtgctagagctgactagagtcgaatagccactttctttgtgcaagtttcctttctgtgactttactggatttcattggtagtaagcgttcatccagacagattccaagacagtgtccacatgaaaggaaaacaaaggctgatgggcagagacgccctgagcatccagtcccagggtacctttgccagctgcccttcctaacatccagaggcagggaagggaggagccccgctgagcagtgcacacatgtccgcagagagaatgtcacagaaatgcagctctgctccctctcatgagaagcagctcatccgctgtcctgcaggccctggtgaggagccagcccatgtttgggtccctcctcagcatccccaccatggagcctgtgcctgctcatcactgttgagggagcatccctcctgcagcaggctcacttgtggctgccccacacagggctgctctcagtgtgttttctctgtgcttccaggactcccttgtgaacttcagctgggggaggtcgaggacacatgaggctgccctgggcattctctgagccttctgcaaagactctggtttcaccttcgctaacaatagcttgagctgtgtccagcagactggagtgggtggcacaagtgtgtaatccagctggaaaaaatcagtactattctccatcagacaaggaagaactcaaaagaattcttgctgtttaacagggagctgagcaagagtaaggtgtagaaagcttacttaaagaaataataacagataaatttccaaaacttgagaaagatataaatatccaggtacaggaaggcatgacaacaccaaacagaatcaacaaaaataagactactacaagacatatactaatcacactttcaaagacaaggacaaaaaatggatcctaaaaccagcaagaggaaagaaacaaataacatatgaaggcattccaattcctctggcaacaggcttctcaatgcagattacacaggccaggagggaatggattgacattttttaagtgctcaaaagaaaaaaaacctgccatccaagaatatattcttcagcaaattacccctccaattgaaaggagagataaagactttcctaaacagaaaaaagatgagaggattcaccaccctcgggcccatcttacaagaaatgctaaagggagttcttaaatctcaaagaaaaaaatgctaaagaataaaacaaaacttttataaatataaaacccactggtaaaattaggtacatggagaaacccagcggatggagtcaaaatgtagaatttttctgtgtcttttttgcctttgcttgtttctgttctttcatttgagttgtcgtctcctttaaataacttctcatatctataaggtgtttcttttaagactcatgatgaccacagcacaaaaacctataactgattcactaaaaatcagaagcaacaaattctactgaagaaaatcactgaaccacaaaaacaagaaaaagaaagaaagaaggaaggaaggaaggaaggaaggaaggaagaaagaaagaaagaaagagaaagaaagaaagaaagaaagagggagggagggagggaagaaggaaggaaggaaggaaggaaggaaggaaggaaggaaggaagaaaggaaggaagggagacaggagtctcaaaactgccagaaaatgggcaacaaaatggcagtggttgctccttccttctcttttcccccaactagacggcatcgctcctcacactatgctacctggcgttgggacaggagtgacacaggtcatgctgaactgttgttcttattctcttcagtgtgtcgtttcttacttttaggctgtaaccaggtatggggatctctcacttggcttccttagctcttgtgaaggatttttggacgtggatagttgttcagattaatgttccggcagggaaccatcactggagagtcctattccgccatcttgctcctggatgatcactcaagactgtcagactaaaggacacacatacactgaaactgaaaagaaggaatgaaagaagacatttcatgtaaatgttaaccaaaagagagtgaggtgggagtatctacatatatatcagaaaaaaatagattttaagtaaaaagctctcacaaaagacaaagatctttgtcttatataattattatatgtgatacaaagtttcacttatcagaaagatacagttatgcacacacacacatgcatccaacatcgaagtacctagacatataaaactatcatttacagatcagagaggagacacagaaagcaatacaatacaattaggagatttcaacaccccacgttcatcaatagatagaacatacagacagaaaatcagtagggaaacagcagacctgaatagcactagagaccaaattgacctaacagatagatacagaacattcaattcaagtccagcagagcatgcattctccccaaatgcacagggaacattcttcaggatagatcacgtgctaggtactacacatgaccttagccaaaaggctgaggaatgattacctcacatgttaggtcacaaagaagactcaacaaaattaagaagactgaatcgcatcaagtatcatttctgacaatggattgaaactagaaatcactaatagggaaaaagttgaaaatttacaaagaagtataagctaagcaaacttaaaagataaggtagaaaatattttgaaataaatgacagtgaaaacgcactacattgaaacatgggatactgcaaaagcagtactaagagggaaattcataatgatgcccacctacattaaaagagaagaaaggggctggacatggtggctctcacctgtaatcctagcactttgagaggctgaggttggtggataatttgaggtcaggagctcaagaccagcctggccaacatggtgaagccctgtctctactaaaaatacaaaaatacaaaaattacctgggtgtggtgactcatgcctataatccaaactactcaggaggtggaggttgtggtgagccgacattgcaccactgcactcgatgtttattgcggcactattcacaacagcaaagacttggaaccaacccaaatgtccagcaatgatagactggcttaagaaaatgtggcacatatacaccatggaatactatgcagccatagaaaaggatgagttcatgtcctttgtagggacatggatgaagctggaaaccatcattctcagcaaactatcacaaggataaaaaaccaaaaaccgcatgttctcactcatgggtgggaattgaacaatgagaacacttggacatagggtggggaacatcacacaccagggcctgtcatggggtggggggaggggggagggatagccttaggagatatacctaatgtaaatgatgagttaatgggtgcagcacaccaacatggtgcatgtatacatttgtaacaaacctgcacgttgtgcacatgtaccctagaacttaaagtataaaaaaaagagtttgaaaaaaataatagaaaaataaaaaaaagaagagaaagaacctaaattaatcttattaatcttttttttttgtcattaagagtttatctcccatttcaaacataaagagtatctacaaatcagtttcaaaagtctaataacacattatgcaattgacaaaaatatataagcacttaatttacattagagaaataaatatgtctcttaaatgaatgaaacaatgtccacgttcactcataataatacaaagacaaggataccaagataactattattcattactagactggtaaagatccaaagtttttttgtttttttttttttttatactctaagttttagggtacatgtgcacattgtgcaggttagttacatatgtatacatgtgccatgctggtgcgctgcacccactaatgtgtcatctagcattaaatagaaaaataaaaaaaaagaagagaaagaacctaaattaatcttattaatcttacacctccggatttagagaaagaataagtaagtcctaagttagaatgaaataataaagattagagtagaaattaatgaaatacaaaacagaaaaataataggaaaaatcaacaaactaagggcttttgaaaaaaaagacaaaattgacaaaactttagctagactacaaaaaaagaatactcaaataaatagcatcagaactgatcaaggagacattacaactgatgctacagaaataaaaatgatcatgatgtgatatgatctggatctgtgtccccaaccaaatgtcatgttcagttgtaatcctcagtgttggaggttggggctcagcgggaggtgattggatcatgggagaaggttggtttctcatggtttaacaccatgccccttggtgctgtcgtccaatagtgagttctcctgagatctggttgtttaaaagcatgtagcgtggccggatgcggtggttcacgcctgtaatcccagcactctgggaggccgtggtgggcggatcgcgaggtcaggaggagaccatcctggctaacacggtgaaaccctgtctccacgaagaaatacaaaaaattagccaggcgtggtggggagtgcctgtagtcccagctagtcaggaggctgaggcaggagaatggcgtgaagccggtaggcagagtttgcagtgagctgaaatcgtgccactgcactccagcctgggccacagagtgagactgtgtctaaaaaataaataaataaataatagaaaaaaataaaataaataaataaataatagaaaaaataaataattaattaaataatagaaaaaataaataaataaataaagcatgcagcacctccggttctctctcttgctcctgcttcagccatggaagaggttctcctttaccttccaccgtgactgagtttcctgaggcctccccagatgcagatcttgccatgctttctgtacagcctgcagaacttcttttttttttttcataaattaccctgactcaggtattaatagtagggcaaaaacagactcatacatggagacgactataaatcattattgaataaacaccaacacactggataacctagaagaaatgggtaaattcctcaaaacatacattctaccaagactgaatcataaagaaatagaaaacctgaagagaccaaaaatgaacaaggagattgaaacagcaatcaaaaatctcccaatcaagaagatttgaaaatcaagttcaagtggtttctccagtgaattctaccaaatgtttaaagaagaactaaaactaataactctaaactctcctagaaagttaaaggaacactttcaaaatatttttatgtgagcactctcagtctgataccaaagacaggcaaaggccatttaagaaaagagaactacagttcatatccctaatttgtataggtacaaaattcaacaaaacccagcaaatcaaattcaacagcacaataaaaggaacctatcccaccaccagaaatgcatgataaagtgggatacatctctgagatgttcctgtttgaaacacaaaatcaaacatctttgtagtaactctaagagctgtagcctggcctggcacggtggctcaaacctgtaatcccagcactttgggaggccagcgtgggcggatcacctgaagtcgggagttcgagaccagcctgaccaacatggagaaaccctgtctctactaaaaatacaacattggcagagtgtggtggcgcatgcctgtaatcacagctacttggagggctaaggcaggagaacagcttgaaccagggaggctgaggttgcagtgagcggagatcttgccattgcactccagcctgggcaactccatctcaaaaacaaacaaacaaacaaacaaacaaacaaacaaacaaacacctgtagccttttggcaaggagatgcttcaagccattctgaatgtagtcacaccataaataacacatacccaaactccaagtggataattcttgggttaaatcattttaactgtgttcaaagtatttttgagctttggtttctccccagggttaccatcactcttttaccagcacgatgttgttgactggtcacaactgatgcaacgacaaccacagctgtgactttagattttaccatcagatgttgattggagacaataaccaattaccatacacctcaagattcgtggagaaatcatggtttcatggagaaatcaagataacatctacttgagctcatctggtcccaccaagcatgtatcttgagagcttcataaattaccagagttagcaaacaaatttacaagaaaaaaacaacgccatcaaaaagtgggcgaaggatatgaatagacacttctcaaaagaagacatttatgcagccaaaagacacatgaaaaaatgctcctcatcactagccatcagagaaatgcagatcaaaaccacaatgagataccatctcacaccagttagaatggcgatcattaaaaagtcaggaaacaacaggtgttggagaggatgtggagaaataggaacacttttacactgctggtgggactgtaaactagttcaaccattgtggaagtcagtgtggcgattccttagggatctaggactagaaataccatttggcccagccatcccattactgggtatatacccaaaggactataaatcacgctgctataaagacacatgcacacgtatgtttattgtggcactgttcacaatagcaaagacttggaaccaacctaaatgtccagcaatgatagactggattaagaaaatgtggcacatatacaccatggaatactatgcagccataaaaaaggatgagttcatgtcctttgtagggacatggatgagactggaaaccaacattctcagcaaactatcgcaaggacaaaaaatcaaacaccacgtgttctcgctcagaggtgggaattgaacaaagagaacacttggacacaggaaggggaacgtcacacactggggcctgtagtggtgtggggggagggggggggatagcactaggagatatacctaatgtaaatgacgagttaatgggtgcagcacaccaatgtggcacatgtatacatatgtaacaaacctgcacattgtgcacgtataccctagaacttaaagtataataaaaataaaagaaaaaagaaaaacaaagaaattatcagagttagttacacaaccagatttttctattattttaaatttaaaatcaggagttaaacattcatattctgtaatggctttctgaatgcctccagagcttgatcacttgaatgtttaaataggattataacctaggttacagcgactagttttgaataataatctgctggagtatgctctttcacttccttactacctaatttgtgtgggtgccaatcttcacatcagccagcacagggaaaggaggtgtgtatttaaaggttccttaacattgtccatcttttttggtgatgattatgttctacttgttttcaatgttttctgctgtgtacattaagagtgtacaacatggtgtttagatatacacatgcatagtaaaaaggttaccacaacctagcagcaaattaaccaatcaatttccttttatggttaccgttttgtagcaggagaaactaaattctactcttttagcaaatgttcagtatacaataaaatataactacagcctacctgctgcacacaagagctcttgattttataactgcaagctctttcttgtgtagcgtctgcataactgcaaactctaacttctgtagcttctgcgtgactgcaaatgtgttaactttcacctatttctccccatttcctacctctccacacccctggtagccatcatttcactctctgtttctatggatttgatatttttaaagattttacatgtaagtgagaacttgctgtatttttatcttgtgtctggctcatttcacttagcactacgtcctctggatctatccatgttgttgtaaatgacagtcgatctccttccttcttgtccagtattggggtatgtttcatcaagtcttctttttccctgaaaacatccccaaatcatgcactatttcaacacttaccttctagatatcagtctctttgtctatttttgagatttggctagcttacacattctagtcactggcttaaattctactattcagcgtgggtttacttcagctgatggtgatggtacctccttctccataacatgcagtttcagttttgagatgtgatccatcagcacatattgtgaggctcacattaccaatgggagtctgtaatacacctaagcaatatgcaggcagtttcctcactaagatgagacggggtgagcacagcttgatattctgccacgcctcctgcctgtctcactactcactacacactaaatttgaactcacatgaagttcaggttaatgtttcaatctgtttggtttaatttaatttttacttcaagattatttccattattatatgtggctatttcagtacaaattgaaggaaaggcaacttttattgcctttatttatgaggctttatttatgggcatgatgacagcagttttaaaagtcacattccgacatagtgatgggctggatgaagagagggcattccctctgaaatgctcttcggaaggatcagaaatgcctcaatcgaccaactctcctgtcctcatgactagagctgtgtcacatcttcagagagacacacatccgtggtaggaaggataagattacatggatgaatctggctgttttctaatgttttgcctgagatgaatccaaatatatggggaatggttatttttattattttgggatttgtaagcaatggctgaaaacaagaatactttttaagatgacatattatttttgtgacattctgttatttcattgtagagattgacaattacattttctttttcaaaaaataaattgtattatgtatatctaagacatacaacatgatatggaataaatatatacagtaaaatgatgactatagtgaaataaattaatgcagccctcaacttacagatttacccacctcccccatttggcaagaacagctataacctcagttagcaaagtcctggatgcaatgcacccttattaacttcctcatgttgcacgttggatctgtggcagcttccagatgggaaagcctcaaagagtcagacgtgacgatatgggggtgctgcatctgagcacacagctccctgcaatcctctctgttcccaggtgtcctgtcccaggtgcagccgtaggaggggcaaagccctcgcaggcaatctccgtgtcccatgctgcttcccgctgctctgttaccaggggttactcagcgggggtggatcccccgacctgcagggaaaggttggaatgcaatggattgctcacctctgttatggagggagcatatagtttatccctaccatcaaagttgagtatccatctccagagatgcattcaggatacatccggttctccttgcagctgagttttgtgactactgaggacacagccctgtatgactgtgtaagagacacagagaggagatcccagtgtgggcccagacacaaacctcactgcaggggtgcctgggacctggatggcaggggcccccagggcccagcctcagggcatatgcaaccaaggagggcatatggggagggaatcatcacccagggtttcctttccttaatgaacagcatctgagccatggaacctctgctttatatctgggctacggagtggcctgaggcacctgagatgcaagcacaatggagatgtttaagattctgtatgagcatatgtgacatcacagttctttttcctcatctctcggatttcactgaaactgtgaagagaactgtcatcctactggcactgtgtgctgtgcaggaaatttctaaaatatggtaaccatcatgagggatgcattcgtggctgcactgtgctgggaagagtcacaccagggagaaatcctgtgaggaaccctggactccactggctgtgcccagcacagctgtgaaagacccagttgatgtccaagaaatgagaatgcaaacatctgcctccagcacataggaaattacagcaaacgattccatgtcccgtggtccctctatccccaaattctttcccttttcccaaaatcaaggaggagaactggagtttccagtccatagcctgagccagccaccacgtgtgtgtccccagcctttcccagagctgcctgaggggctggacaagacctgctcccttccctcctgctcacacagctgcacaggggagctcctgcaggctgttagcatcccagtttccaaacagctttcatatccacaggattcatttcttgctgttactattgttattttgcctgagcattctcatgactgcatcacttgtcagagacacgtgccctgcactgaaaccccactctctgctttccacaaagatggagttccttagaccttcatctgctagaaggatctgatgtcttgtccttacactggccaagcattgtctgatatgccccagttggcacacagacattatggattatttgcacctgtgtgggaatggtctataattgggacacgtgtctagactcaaagatgcctggatggtctataattgggacatgtgtctagactcaaagatggctggatggtctataattgggacacgtgtctagactcaaagatgcctggatggtctataatttgggacatgtgtctagactcaaagatgcctggatggcctataattgggaaccgtgtctagactcaaagatgcctgaatggtctataattgggacacgtgtctagactcaacgatgcctggatggaaaaggtgcaggctgctccactgatgtcacctgtttcatcatagttttatgatttaataaaagtcatatttttttcatttttgcacatcaaatttttttctgtgttccatattcctaagcccatctttgagctcacagccctttcccaagaaatcaacttctagacctccctcttctcggggctccgaggtgatttctgagtggcatcctctccacctccctgctgggaacagagccagtcgcagggctcatgggcagctttagaatgcctgctactccggggtgtccccctgcttctcactggagaagaggcctctggggtggtcacagcctctttctccacatgaatcctgagagttcttcctgagctacacagctgggggaagacggccctaaaagacgtgaaaagagagacatgggaagtgaggtgtctcagctcttgtctcccctggttggtgtggcctgacctcaccagagccccagcctaacccacctgacctgtccccaggagctgtactgagcgatggctgcacctgctcagttacctgtggggcccagtgcctctgagagaggtgcccagtgagggctctgcagggctccccccgagcaggagctgggctgaggtaaatcagcaggaaggaggggctgcccaggccccggggaggcaggcagcgtggagaggagacagaggcgcactgggagggagcaagccagtcaggaccaccctctcagctctgagaaatgagctatgctcacggaatgctcacactgaccactgaaagacttgactatgatgatgactctccctgtgttagcaggtgggtgtaagcacctgcttcccaggttcaagccattctcctgcctcagcctcctgagtacctggaattacaggcacctgccaccacgcctggctaatttttttgtatttttagtagagatggggtttcaccgttcaccatggtggtcaggctggtctcgaactcctgacctcaggtgatccacctgtctcagcctcccaaagtgctgggattgtaggtgctagccactgcaccagcctcaacacaactcttttagggtcaatatcttgagacccacaaggaatttcctttgagcaaattctgtgggaggtatgtagccttttatctttatagttatgtatttaggaaaaaaaaaaaaatgagagacaggtttgtgtgacacagttcccagctagccttttccctgtagcgtagtgagtctgagatcccaagattttatttttcttttataatataaacatgaaataataagaaatgtatatttgtaagatctgagagctacagtgtaaaagaaaataacacagaaaaagaatacacacactcgcacacacacacatacacacaaacacacatatatggtctctgtccctgtctcctggtgcacagctcctgaaacccttggaatctcccaagtgatgtgtctttatggatgctaatgagacgactgatttctggggactcccaaaggactggtggccaggggaaccaacctcgtgattacggggttaaacttttcagccccctatcccctgatttccagggatggggaggagctgaaggttgagttgatcaccagtggtcaatgatttaatcagtcgtgcttatgtggccatcgtgggtggctcatgtctgaaatcccagcattttgggaggccaaggcgggaagatcacttgaggccaggagtttgagaccagcctgggcaacatactgagaattcatctctacaaataaaaaaaaaatagccaggcatggtagtgcatgcctgtggtccagctactcaggaggcagaggtgggatgatcaattgagtccaggagatcaaggctgcagccagctatgattgcagcactgcatgccagcttgggtgacagagctagaccccgtctcaaaaacaaaacaaaatgaaacgaaacaaaaaacaaactaaaaaccaaatcatgcctatgtcatgaagtcatgaaactcaggacagcggccgggcatagtggctcatgcctgtaatccctgcactttgggaggccaaggcaggcagatcacttgaggtcaggagtttgagaccagcttaggcaacatagtgagattctgtctctatttttttttaattaaaaaaaaagataaagtaaacatggggcagaggaagcagtcagatatgcatttgtcccaggtgagcagagggatgaccttgagttctgtcctttgtcctgcaaggataagctatcaatttacattgtcagggaaattcaacagaactgttctaaggtcaaaatcttgaggcccacgaggaatttcttcatgggcaaattgtgagggaagtatgtagctttttaaaaaaatctttgtaggtatctatttaggaacaaaatgggggaggcaggtttgcatgatccagtttccagcttgacttttgcttttggcttagtgagttggtggtcctgagatttctttgcctttagcagtcattattcagggaagagggtatggtcttgatactcaaaatttcttaggcgagaaatctaccagggtttggatgagaccatacattgctcattcagtatctcaaacccagaaagatgagttactgacattgaatgtgtgaaaggaaaacaaacagctctgttgaattttttgaatttcatctaaaacagttctgggttttgttttgtttagtttttgagacagagtcttgctctattgcccaggctagagtgcaatggtgtgatcttggctcactgcaacctctgcctcctggttcaagcaattctcctgcctcagcctcctcagtagctagtattacaggcatgcaccaccatactcgggtaatttttgtatttgtagtagagacagggtttcaccatattggccaggctggtctccaactcctagcctcatgcaattcacctacctcagcctcctaaagaactgggattacaggcatgagccaccatacccagccaaaacagttatgttgaatctcaccctgacaacataaatgaaaaacttgtcttcacaggtaagggacaaaggacagatttaaaagtcatccatctgcacactggagacaaaagcatatctgactgtttcctgtagtctatgtgtatttttcttctgtaaaaatgcagattcactgagtgcaagatgaatacataattgactattcctccacccttttctttccgcatgtaaaatgtgggttccatgaatgctgatcaaagactaaaaggaacacaaatgcttggcttttcaatatgctctctcttcccgcttgtttttccttttgccttcccctactggccactctttttccatttacttattcattcattcatttattcatttatttatttatttatttggagatggagtctcactctattgcccaggctggaggcaatggcatgatctcagctcactgcaacctccgtctcccaggttcaagcaattctcctgcctcagcctcctgagtagctgagactacaggcacccgccaccacacctggctagtttttgtattttagtagagacagggtttcaccaagttggccaggctggtcttgaactcctgacatcgtgatctgcccacctcagcctcccaaagtgctgggattacaggcatgagccactgcacctgacctatttttttaagacagaatcttgctctgttgctcaggttggagtgcagtggtgcaatctcggctcactgcaacctctgccacttgggttcaatcaattctcctgcctcagtctcctcagtagctgggattacaggcatgtgccaccacacccagctaatttttgtatttttggtagagacagggtttcaccatattggccaggctggtctcgaactcctgacctcagctgaggagactgagacaatcctggtcaacatagtaaaaccccatctctactaaaaatacaaaaattaactgtgcgtggtggcacatgcctgtaatcccagctacttgccaggctgatgcaggagaatcacttgaaccagggagtcagaggtttcagtgagccgaggtcacaccactgcactccagcctgatgacagagcaagactccgtgtcaaaaaaaaaaaaaaaaaaaaaaaaaaaaaagggctgggcgcggtggctcacgcctgtaatcccagcactttgggaggctgaggtgggcagatcacgaggtcaggagatcgagactgtcctggctaacatggtgaaaacctgtctctactaaaactacaaaaaaaaattagccgggtgtggtggcgggcacctgtagtcccagctactcgggaggctgaggcaggagaatgtggcatgaacccaggaggcggagctttcagtgagccgagatcatgccactgcactccagcctgggtgacagagcgaaactcggtctcaaaaaaaaaagagagagagagaacttagtgattttaaaggtttttttcctttcttttgatatctaatgttggatttacaactttgaaatgcaaaactacatgtacaaatctgtgaaacacagggcagatgctagacaaaatatgccagaatttcccagtgattacctcgattggaaaatttcatctccagacttttccatacattatgcattttctacagcaaacaagcattgcttttgtgatcataaaatacaagcagacacaatcaagactgggggaggtttcctgggggagagcagccaggcccaggatgcagggctctccttcctgggacatcagccaggtcagggcccttgaggcacaggtctgggcagctctaccagtgggcatgggcagagaaggacccagctggttgagcccctgatgcaattgagggcaggccccttgccggagagggagacagaacagctgccaaaacacagccttgaggccaggctctgtctgggggtctcgctgctgctccccagcccacagggcttccagccgcaccaggacaagcttcactgcaaaggcgggagaggaggggaggggatgtgccttaccttggggcgtgtgcagtgtggactgtgtgtgcgtgtgcatatgcacatacatttgtacgtttgtgggatactggtgggtgcacaagctttgtatgtgtggacgtacatgtgtctgtgtgtggggtgtgtatgcacgtgtgtttacacatatggggtttgggtgtgcacgtgttcatacatatgatgtgcgcatgtgtgggcatatacatgtgtccatttatggggtatgggatgcagatatgtgcatgtattcatgcacattcatgtagcgcatgtgtgtgttacagcatatggtgagtgcatgggtgttcgtatctgtggggtacaggtatcatgcacgtgtgttcatctgtgtggggtgtgggtatacgtggaccgtggcctgaggctcccccacaggacactgctccctgccgcctccccaggggctaacaggaccctgctcctcttgctaaagccagtttgggagcagccccacccaggcagccccaagccaaccaggctcgcctctgaccagatggctgaaggagcaggtagagcaggaagtgtgagccagtgacccaggttcccctggtggccaggcttggtggcccatgtccatggagtcccccacctgccaatgacctccagccatgtctcctgggtaccaggccacccatgggtgggggtgggggtaactccctgctgactcactgctcagctggcaccaatgaggtctccacctcagccctgggctgagtgtccagtgctgagtccttcctacaggcaggtgagcttgggaggcagggaccctgtggacttggggagcgggctcagggtctggaggccagaggccttgtccccaggcccggcatcccatcagcaagagcccaggaggctctcagggcagcactcctctagcaatctcaggggcagcgtcctcccaggagtcacatccagatcaccatacgtacctgctggcccctagcatgtcccataagtggagaggggttggcctgtggaggcaggggtggccagaatatgtgccggaaccccatctacaggctgacacctaaacccaaatggcacaggggagcctgagcatgaagtggctggcctctccctcgcgggggcccagcaactgctgactccatgtgccaagccccgcctgcccgctggaaagcctcaacagactgctccctgtggtgacaccaccactcgggtcggcttggctgaggccagcggagcatctcccctctaggtccattcacatccatcttccctggacaaatgaacactccccaaacactcacttgccactttgaccccagaccaaacacacagccactcctggagtgccggtgactgagggtggctgggcccttctgtgcccacaaagcagggcctgggctatacctgtggggctgcacgactgtgccaggacagccttacctttgctgggggcttcgtgccctcccagctgcgtgtgtccatggacgaggggacctggtagatgtcatgccccatcccggcagaaggtggcacctggtaaatatcctgggcagggcctccaggccctggggacacctggtacaggtctgtggccgggctgggaaacgggtgatggggcgtctgcttcgagaaggtggatgtctgcttggctgggggcgactggaactgagggctgggacccgggacttggtagaggccttgctgagccttgctgggagtgggcaccaggtagacgctgtcgggctggggctggtaggtgttggggagcatgggcgtgtactgggaggccggaggcactggggcatggaggccaggctgaggctgggccggggtggcgggagggccggggccaggccctgctggcttcttatcatacatacccaccaagatcttgaggtggttcccaggcatgatgccctggcgcccgtgcagcgagcagagccaccagccatccaggccctgcgtgtcctgctccagcaccgtcatgatgtcgcccttgcggaaggagagctcatccggggactcggccacattgtcatagagggctttggccagcacattcaggtggttcatggtgtccggcgggcctggggccccggctcccgtgggggcacacaccgagctgcccgggccgcgtgccctcggggctccgagcgcgccgcagccgccccggtgccgccgcgcagctgccgcctcggccatccacagccggtcccttaagtttttttttcttattgtgacaaaaagcatataagattaactgtcttaaccatttgtaaatgtactattcagtagaattatgtatattgacattgctgtgaaacatctccgggaccttttcatcttgtgaaacggaatccctgtacccattaaacagcgattccccagttccccttctcccagccactggtaactatcattccactttctgtttctatgaatttgactactttagataccttatatagtggaatcatgcagtatttattgtttgtgactggcttatttcccttaacataatgtcgtcaaggcttacgtatgttacagcacgtgacaagattttcttcctttttaaggctgaatactactccattgtatgtataaatcacattttgtgtatccattcatccattcatggcctttgggttgcttctatctcttgtgattgtgaacaatggtgctgtgaacgtggatgtgcaaacaatctctttgagaccctgcttttaattctttgattatatatccagaagtgggattgctagatcatatggtagttctatgtttcattttttgaggaccctccgtactgtttcccataaccataatagctgcatcattttacaatcccactaacggcacacaaagcttctggtttctctacatcctcaaaaatgcttgtttgtgtttttttctttttcttttttttttttttgagacagaggcttatcctgatgcccaggctggagcacagtgacatgatcatagtttattgcagcctggagctcctgggctcaagggatccacctgcttcagcctcctgagtagctggactacaggcatgcaccaccacacccagctaatttttgtatttttggtagcaacagggttttgccatgttgcccaggttggtctccaactcttggcctcagatgatccacctgcctcagcctcccaatgtgctgggattacaggcgtgaaccaccatgacgagccaaatgaggctaattttaaattcttttgtagagacagtatttcattatgttgcccaggctggccccaaacacgtagcttcaagtgatcctcttgcctgggctgctcaaagtgctgggattggccgggtgtggtggctcatacctgtaatcccagcactttgggaggctgagtcgggcagatcccgaagtcaggagtttgagaccagcctggacaatatgttgaagccccgtctctactaaaaatacaaaaattagccaggcatggtagagcgtgcctgtaatcccagctacttgggagggtgaggcaggagaattacttgaacctgggaggcagaggttgcagagagctgagattgcaccattgcactccagcctgggtgacatagcaagactctgtctcacgggtggggaaagcggggagggctgggattacaggtgtgagtcactatgcctggtccacttattgtttttgatggtagccaacctaatgggtatgaggtgatagctcactgtggtttatttctctgattagtgatggtgaccatcttttcatatgcttttttggccatttgtatggcatattcacccagaataggtaatttttttaaaacataaaaatttaaaaattattttttaaaagaaataatttgtgtgtgtgtgtgtgtgtgtgtgtgtgtgtgtgagagagagagagatggagtcttgctctgttgcccaggttggagtgcaatagcaccatcttggctcactacaacctccgcctcccgggttcaagcaattctcctgcctcagcctcccaaggagctgggactacaggcgggtgccaccacgcctggttaatttaggtatttttggtagagacagggttttggcatgttgactgggcttgtcttgaactcctggcctcaagtgatcctgtgctgggattacaggcgtgagccactgcaccgggtctctgttcttgtcaaaaatcaattaatcgtagatattttgatttatatccggactctcatttctgttacactggactgtacctctacctataggccagtaccagagccttttttttcctttcttcttactggtaaactgaagtcacatcacagtcttgattattgtagcttagtaggttttaagattggaaagtataaattctccaactttgttctcctctttcaagattgttttgtctaatctgggttctttgcattgctatatgaattttaggatcagcttctccatttctgccagaaaggcagctgggattttgatagaggttgcattgaatctgtagattagtttggggattattgttgtcataaccatgtttagtcttccaatccatgaatatgagatgtcttgatttaggtcttctttaatttttttttttgttggtggtggtgagatgaggtctccctctgttacccaggctgaagtgcatgatctcagctcactgcaacctctgcctcctgggctcaagccatcctcctacctcagcctccttagtagctgggactacagtcatgcaccaccccacctggctaatttttgtattttttgtagggatgaggttttaccatgttgcccaggatggtcttgagctcctgatctcaaagcaatccacccgcctcagcctcccaaagtgctgagcttaaaagcatgagccactgggcctggtcaggtgttctttaatttttttcaacaatgtttcagagttttcagtatatgagtctcagacctctttttttgaattatttcctatgtgttttattctttcagatgttattacaaatggaatttcttaatttcatttttggatagttcattactagtgtatgaaatataattgatctttgtgtatggatcttgtgcctttgaccttgctgaacttgtttattagcatgtgttttctctttctctctctgtctctagtgtgtgtgtgggtgggggaaactttcttaggctttctatatacaagatcacatctgccgggcacagtggctcacgcctgtaatctcagcactttgggaggccgaggtggatgggtcacctgaagtcaggagttcgagaccagcctggccaacatgatgaaaccctgtctctactaaaaaaaatacaattggctgggcataatggtgggtgcctgtatcccagctactcaggaagctgaggcaggagaatcacttgaatccaggaggcagaggttgcagtgaggcaagatcgcgccaccacactccggcctgggcaacaagagcaaaactccgtctcaaaagtaaataaacaaataaaaagatcacatcgtctggaaatatagttttactttttcatttctaatatagatgccatttattttatttttttttgtgtgcctaattgtcctggctggaacttcctctttttttttgagaccgagtttttctcttgttgcccaggctctgaggtgcagtggcatgatcttggctcactgcaacgtccacctcccaagttcaagtgactctcctgcctcagcctcccgagtagctgggattataggcatgcaccatcacatctggctaatttttgtatttttagtagagactgggtttcaccatgttagtcaggcaggtctcgaaccactgacctcaggtgatccacccaccttggcctcccaaagtgctgggattataggcatgagccaccgtgcccggactggaactttcaatataatgtagattataagtgacaagagtagatgtacttgcctagttcctgatcttagggggaaagctttgttttccccatttaatacattgttagctgtgggtttttcatagatgcctttagcaagtaaagaaagtttctttctattcctagcttgtggactgtttctatcatgaaagggtgttggattttgtcagaaaatttttgtgtttattgagaagatcatgtggtttttgctttttattctacttttatggtgcattatatcagttgatttttgggtgttactccaagcaggcatgaatcctacttggtcatgttatagaatctttttatgtattactggacttggcttgctagtattttgttgcagttttttttttttttggtctttatgagaaatattggttattatttttcttttctcatgatgcctttggttttggtaccaggaaaatattggcctcaatgaatgagtttgaaagtgtcagccgggcacagtgggtcacacccataatcccagcactttgggggactgaggtgggtggataataaggtcaggtgttccgagaccagcctggccaacatggtgaaaccccgtctctattaaaaatacaaaaaaaattagccagacttggttgtgcgcacctgtattcccagatacttgggaggctgaggcaggaaaatcgcctgattccgggagaggttgcagtgagccaagattgagccattgcactgcagcctgggtgacagagggagactctgtagtataagaggaaggaatgcatgtttgtagtataagaggaaggaaggcattagaaggaggcctgaagattcatttgggggatttggggtgataggtaaggtcagggcttggagaggacaggaaacttttcttttttttagacagtgtctcactctgcctcccaggctggagtgcagtggcgcaatctctgctcactgcaacctccgcctcctagttcaagtgattctcctgcctcagcctcccaagcatctgggactacagccacacaccaccatgcacagctaatttttgtttctttcttttttttttttttttttttttttttgagacagagtctcactccctcacccagcctggagtgcagtggcacgatctcagttcactgtgacctccacctcctggttcaagtgattctcctgcttcagccccccgagtagctatgattacaggcatgtaccacaagcctggctagtttttgtatattttattttattttattttacattattttattttatttttgagatggagttttgctctttcgcccaggctggagtgcagtgacgcaatttcggctcaccacaagctccgcttcccaggttcatgccattcttttacctcagcctcccgagtagctgggactacaggcacccgccaccacacctggctagtttttgtattttagtagagatggggtttcaccaagttggccaggctggtctcgaactcctgacattgtgatctgcccacctcagcctcccaaagtgctgggattacaggcatgagccactgcacctgacctatttttttaagacggagtcttgctctgttgctcaggttggagtgcagtggtgcaatcttggctcactgcaacctctgccagttgggttcaataaattctcctgcctcagtctcctcagtagctgggattacaggcatgcgccaccacacccagctaatttttgtatttttggtagagacagggtttcaccatattggccaggctggtctcgaactcctgacctcagctgaggagactgagacaatcctggtcaacatagtaaaaccccatctctactaaaaatacaaaaattaactgtgcgtggtggcacatgcctgtaatcccagctacttgccaggctgatgcaggagaatcacttgaaccagggagtcagaggtttcagtgagccgaggtcacaccactgcactccagcctgatgacagagcaagacgccatgtcaaaaaaaaaaaaaaaaaaaaggctgggcgcagtggctcacgcctgtaatcccagcactttgggaggcccaggtgggcagatcacgaggtcaggagatcgagactgtcctggctaacatggtgaaaacctgtctctactaaaactacaaaaaaaaattagccgggtgtggtggcgggcacctgtagtcccagctactcgggaggctgaggcaggagaatgtggcgtgaacccaggaagcggagctttcagtgagccgagatcgtgccactgcactccagcctgggtgacagagcaaaactcggtctcaaaaaaaaagagagagagagagaacttagtaattttaaagtttttttttcttattgtgacaaaaagcatgaggttctcaaggttcacgccatgatggtgccactgcactccagccccttccctctactttgctgccactcggatgggggaagctctggaagacttcttagggaagtggcatataaactgtgtgtcatacttgttgttgtttttttttttttttttggagacagggtcttgctgtgtcccacaggctggagtgcagtcgcatgatcacagcttaccatggcctcaaactcctggctcaagcaatcctcccatctcagcctcccaagaggctaggactacaggcaaacaccaccacgcccaactaatttttaaaattcatcccacgtagaagagggggaaaggcatgaaagggcatttgtggcagaggaacagtgtgagcaaagaccaatagtctgggaaaaggaggaggataggctgtgggtggagcaggaaatgtgggtgcttctcttggcaaaggattctgaatgccaggtgagcaggacgaatgtatcttgtgggcgccagagaggcctgggcctcagcctgcccctgtaaaatgaggtgattagactggtctgcttcaggccttcctagggcaaggggctgtcacagaaagggtctactctaggttcttccaggttcaaccccagaaaggcagaatgggaagtggctggagcagctcagaggctaggggtaatattttgctccagagcccaagtctgagaatgactattttaccaagctgtctgcattgcatccctaagtcaccctggctaaccctccacccagtcagggtcctgcagggaaaacccaggccttgggtcaggaggcaagaagggtgatgggtgtcttacccctggctccaccctaggtaagggttggccctcttggagcctcaacttgctcatatgcacaatggaggagctgtgccttgggctctctaagcctctctccccaggacagcactgtcattctggagatgggaacagcattagcaaaggaacggaagtaggattgtgaggaccttgttgggcaacagacaggcaggtgaggctggagaatggagtccctagaagtggatggttcttgttggggttggctggatccaaggggtatgaccttcctccttatgtgcagaactgggtgagccctaggtcatggccagcagccctcggagtgggactgaggacctgttgggaaaccagtttggcaaggccatcatctccatgatgtcatccagccactgtgttctctgggcaatagtgccaggcaaacttctggccctgcaggaggagaaagggcctcagatgcccactgggcagcaatgaattccaggagacccagcctcacagacaaaggagaggcaaggggctggaacaggaaggagagagttctggatgtgccagcctggacctctttagacttctgggagtccctgatgcctgggcgcagggagtgggggtctaggctcatggtgggacactatgtaattgctacctgatgggttggacactggctcctgatcatgcttatactacatgtgtggcaattttgttaccactatgaccttcacagcttgagtcctgtgaggtaggaccaccattatacagataaggagacagactcagaaccctcgttcttttgttgtttttttttgttttgttttgtctttgagacagagtctcactctgtcgcccaggctggagagtggagtggcacaaccatggcttactgcagccttgacctcccaggctcacagtgggactacagacacatgccaccatgcccggctaattttttttattttttgtagagacaagggtctccctgtgttgccagggctagtcttgaactcctgggttcaagcaatcctcctgccttgaccttctgaagtgctaagattacaggcgtgagccactgcgcctggccagaacatttgttcttaatcaccatattctaccatccaccatttggaagctccgcttggatgaagcctgagcactggggagacctgggcctcagtctgcccatctgtaaaatgagggggtttgactggcttccttcaggccctcctagggcaaaaaactgtaacaagaagggtctagattcttccaggttcagccctggactggcagagtagggagtatctggagcagctcaggggccgagggtattttggctccagagtccagtccgagaatgaatattttaccaacctgtcagtgtgggatcccagcaaacccttctctctacttctgaacatagcacctgaatcttggcatcacagagtcctggatacccaccttatggttcaaataggtaactgagtcccagagaggacaagggacaggcttcaggtagtgtagcaaatcaggagcagagccattctgcatcccagattctcaacctcccaaaactttgtttcctcctcaggtcctggcacacttaagcatgaaataactgacacatattgagtgcctatggcataccatgcactcatgtaaccatcaccacagccctataaagcagatgctaatagtctgtcccttttatgggcaaagaaactgaggctcagagaggggaagtcatttgtccaagttgacactgcatgttggtggtagggaagggatttgaacccaggtatataggcccttccccctcagcagatccagtaagcctcactggaggcatgaagacctgtagacagcagggtggatggctcctttgctggttctgaaggcgcgcagtgtccaattcagagtttccacgcaggcctggcctctctggggcaggcagaaaagtgctgaggctgcagaagggctctgaatcttcccagaggaggcggccatggtgggaggcagtgctctgcaccaacctcagagccaagtgtagacatggtggctggaccagctgcaaacaagggaaggcaggcagggtggggcccaaaccctaacccagcctccaagccgtgttcccagccttccgccagccaggccctgccctaccacccttctcgctccccacctggatttgagatgaggacgccgggcctaataatagccaaacggcagcagaggcagtgcctggagccactgccagttggagcctggggtcccccatggtctcatgttggcctccaacagggttcagaactttaaaagtactgcactccagcctgggcgacagagtgaggtcttgtctcaaaaacaaaaacaaaacaaaacaaaaaccctttaaaatagcaactgcttatgaagtttataatatgtgctgggcactgtgctaaagcatagcccacagtaacttacttattcctcaccctacccccactggctaagactatttcttttttttttttttttaagacagagtctcactctgtcacccaggctagagtgcagtggcgcaatctcggctcactgaaacccctgcctcctggcttcaagtgattctcctgcctcagcctcccaattagctgggattacaggggcccgtcaccacgcctggctaatttttgtattttcagtagagacggggtttcgacatgttggccaggctggtcttgaactcctgaactgaggtgatccatctgcctcggcctcccaaaatgctgggattacaggcatgagccactgtgcctggccaggctaagactattcttagcccttttgatggatggaacactgcccctgatgataacaggaacttggcagccttcaattgctgagcatgcatactgtccctccttggcactctgctaagcactttctttgtattttcccattgattccccatggcattatgagacagatgctaatttctttagacgaagaaaaaaatgaggcccagagagaaaagtgacttgcccaaggtcacacagctataatggacagagtcgagactcaaacctaggactttctaactgtagcgaggctaagaccttagattctggaaacagacaaacttaagtacggtgggttcatcactgctccttagctatgcagccttggcaagtcacatcacctgcctgagcctctgttttctcctctgtaaattgagggtttgggggagataatactaacactccctgacagctattaagcccacgttgggtgtaataaaataggtaatttacagcacacatttccatggtgcattccctcagtcaattctcacaatagcccccaatgttaggactcctctcttccagcacctgtgttttttggttgttgtgtttttttgtttgtttttttttttagacagtttcactcttgttgcccaggctggagtgcaatggcacaatctcagctcactgcaacctccgcttcctgggttcaagcgattctcctgcctcagcctcctgagtagtgagtagctaggattactggcgtgcgccaccacgcctggctaagttttatatttttagtagagacgggatttcaccatgttgtccaggctagtcttgaactcctgaactcaggtgattcgcctgccttggcctcccaaagtgctgggattacaggtgagagccaccatgcccggccccagcacctgttttatagaagggaaatgtgagtctcagagaggagcggcacttgcccaaaatcaatagcaagtgagtcaggacttaagcccagggctgtggttctagaggctgagctcttttttattttttaagacaggatctctgtcacccaagctggagtgcagtggtgtgatcatggcacactacagccttgacctgtctgggctcaggtgatcctctcacctcagcctcccgagtagctgggactacaggcactcaccaccacacctgacaaatttttatagagatggagtttccccatgttgtccaggctggtctcaaactcctagtttcaagtaatccgtccacctcagcctcccaaagtgctggaattacacaggtgtgagccaccattcccagccaggcatgtgactatttttggccaatagaatatatggaagtggcattgccagttcgaagcctgggtgttaagagattgggccttaagagattccactcattctcttggaactctcgcagctgttatgtgaacaagcctgggctatcctgcctaagagaccactggaacagggactagttatcctagctgaagctgtcctagtcagtcaccatctaatccaatagctgaccacagatacatgagtaagcccaactgagaccagaaaaatctttagctgagcccaggctaaagtgccagtccatgaaatcttgagctaaaaaaatggttgctgttttaaggcactaagttttggggtggtttgttatgtagcattgttgtggcaattgataactgatacacagttttattcagtgtaattaatgctggctgctgtaacaaacaaaatatctcagtggtttaacccaatcagagtttatttctcactcctgcaaagtctgatataggttggggctctcccagggagctcttttccaagcagtgaccttgccccccaatcctgcctccaccccaggctctccatggaatctattcctgaatcctctgcatgtggaaagggaatcagaaaatcaaaggaggcacatccacacttaactgcctttgcgcaggggtcacgtataatttcattggcctttatgtagtcacatgactctactaactgcaggaaaaatgagaacatgaccttcctgtgtgtccaggaaaaggaaacaggttacagaacacaaagcattgcttctgttacattcctcctgttgtggggctggtgtgcgtgcatgcatgcgtgtgtgtgtgtgtgtgtgtgtgtgtgtctgtgtctgtatgtgtggtgggagttggaggggcgtgtgtgttaagtagagaattaacatctataaagaatcaacagtggtgcatgcctgtaatcccactactctggggagctgaggcaggaggattgcttgagctcaggaggttgaggctgcactgaactgagatcatgccattgcactccagcctgggtgacagagcaagaccgtgtctcaagaaaaaaaaaaaaaagagagagagagagagagaatcaacttcagcacctaccatgtgttagcttaaataagggacaagttataggtaaagaatttgaggctcagcttaactgggcctggtgccgcatgcctgtagtcccagctacttgggaggctgaagtgggaggatcacttgaccctaggaggttgaggctgcagtaagcagagattgcccactgcattccagcctgggtggcagaataagaccttgtcttaaaaaaaagaaagaggctgggcacagtggctcatgcctgtaatcccagcactctggggggctgaggcgggcagatcaccagaggtcaggagttcgagacaagcctggccaagatggtgaaacccggtctgtactaaaaatacaaaaattagccaggcgtggtggtgggcacctgtaatcccagctacttgggaggctgaggcaggaaaatggtttgaacctggaaggcggaggttgcagtgaactgagatcatgccattgcgctccagcctgggtgaaaagagggaaattccatctcaaaaaaagaaaaagaaaaaaagaatctgagactcagaaaggttgaggaacttgccccaaatcatacagcaagccagttgagtagctattttgcggtagtgaagggctcagggagatctggagttggacagatctaggtacaaatcccaactctgtcaattcttcactgtgtgacatttggcaagttacttaatttctctaggcctcagtttcctcatccacaaagtggggagctaatacttccaaccttataaggttgggagtgatcattcacagagcttgcatgggatggggatcctggtacatgggccttacataatgaatgtcagccacataggcagaaatgatgctatctctgatcttaccctgccagggtccatgaatttggccaaggggatttattatgttttcgataaatcctatcccttccctctgtctcttgtggtgtaaatggttttatttacttcattaagagatggcaatttggctaagtgtggtggctcatgcctgtaatcccagcactttggggggctgaggtgggaggatcgcttgagtccaggagttcaagaccagcctgggcaacatggcaaaaccccatctctacaaaaagtacaaaaatgagctgggtgtggtggcacccacctatagtcccagccacttgggaggctgaggtgggagaatcccttgagcctggaaggtggaggttgcagtgagctgagatcatgccactgcactccagattgggtatcggagtgaaactctgcctccaaaaaaaaaaagagagagagagagaaagagagagctagaactatttccccagttgaattttttttaattaattaagtttttaattttttgagacagggtctcactctgtctctcaggctggagtgcaatggtgtgatcacagctcactgcagcctcgacctcctgggctcaagcgatactcccacctcagccggtgcatgccactatgcccagctaattttatgtattttgtttttggtagagatcaggtctcactttgttgcccagctggtctcaaactcctgggctcaagcaatcctcctgcctcagcctcccaaagtgctaggattacaggtgtgagccatgatgcccgctccagctgaatatttgttactgaataaacctttataagcacaaagcccctgaacacctatggctgctgacagatgtctgaaatgcctccattactgcatttttttttgagacagggtctagctctgttgcacaggtaggagtgcagtggcgcaatcatggctcactgaagccttgaactcctgggtgcaagcaatcctcctgcctcagccaccgaagtagctgggactacaggcacacaccaccatgtctggctaattttcttattttttgtacagatgagatcttgctgtgttgcccagactggtctggaactcctggcctcagcaatactcctgccttgcctcccaaagtattgggattacaggagtgacccactgcactcaggcttaaatctttttttcttttttttttttttttgagacagagttttactctgtcgcccaggctggagtgcagtggcgtgatctcagctccctgcaacctctgcttcccgggttcaagcaatcctcctgcctcagcctcccaagtagctgggactacaggtgcattccaccacacccggttaatttttgtatttttagtagagacggggtttcatgatgttggccaggctggtcttgaacccctgacctcaagtgatccgcccacctgggcctcccaaagtgctgggattacaggcatgagccatcgtgcctggctggcttaaataatttttaaagttttgttttgaacaggtagttctgggaggccagaggagttatctctcaggagataattatgctcaagtctggaagataagaaattgttgaacaaaaaactaagttggtctcgacgtgggggtgggggtgttccaggcaaggggaacagactacgcaaatgtcccaaggcaggaacaatctccagaaactgatggaagaccaacgtgagtgaagtatgaagggtaagggagaagtggggtttggatggggagaggggaaaaggcccagactgaaaggcccctgtgggaaccttcataatttgcaggacctggtgcaaaatgagaaaaaggagctccttgttcaaaaattattaagtatttcaagatagtgacagcagagcattacactgacccttcattgcatgaagctggccctgctcatggaccatagtaagaggaaaggactttcatgtgagggctgcagggacccatggaaggtttttgagctagaggtgatgagatctgatttgcatacgctttagttgctgtcgtcactaccccacacctggatgatgtgtgtctctgcacaggtggcctgcttcactttcctcttaaacatgtcactcccctgctcaagaacctggggtggttcctacttcctattagacccagcccagattccctatccagacacccagaggcccttcaaaatcttcccttactggatttagttaatctaatgtcaacaaaggctgtgtgctgaatcccagagagatgatgactcaacccaagttcacacagcaattataggagagcaagtcaaggctggaacccaggtttcctgaggttggcccatccagccctgagcgaaggtgcagtcctctgaagtgttttgtatcccccatcctagcacagagccatgcacacagtagatgctcaatctgtgcctgtggccgtgagttcgttcctcttagggcacatctctgccagggcatgggtgtcccagagtccaggatgcagttagcatccttcctgactccttctctccctcatccctacctctaggcattcaccaagccccaccgcacccaggccagctggccaggtcctgcccatagacatgttgtttggcctgtgcagtgttttaaagcttttccaattcatcgttctaacattttaaaaaatccggaaacttcacatggcaacccgcatcttgtgtctctttgcaaagtctcaagcctgggtctgggttccttcggggaggcagttctctccaacctctgagcttgcggtgggtggggtggggagcggtcactgtagtccccagtggggcgcctgaatttgggactttgaagcgacagtgccctaattacctccaaggaccaataaggatgctggaagctgattcaatcagacgtataataacccctccttctggagcggggccaggtgggggcaaacgccgcctctggtctctaacaacagggagtaggaggggtgttttgccctaaaccttacaactagccccaacctgatgtttgacttcagaatcccttagggcttcatagatgaaatgaatgcccctgagagaggccatgctgcttcctctcacctggcctctgcctttgctttcttctcccccgggactgtgctcttcgacctcatcttcactctggctggctccggattaccattcagatcttaactcacacgtcacctccttagaaaagtcttcccagagcacgtatctgaagctccccaaaattactctgtactgtaattactccccatcacagcactgacgatcggaaatgattaatttttttgttgtctcctgctagactgtgagctctgagaagccagggacttgggtttgtctcgctcaacagggtccccaggacctagaaaggatctggcatcaacgaaggggctcaacacacatgtgtggaacaactgaaccactggattcacaaaacagctttccctgaaggatgcatgtgacccctgggtcagccagccagcatgggtgggagccagtaaggaggcagccaatttgcaattagggagcaattaataactacccaattggtacaaaagacagctgaggggctgggaggagaacaagggaatgaagctcagaaaggagcctcaggtctttcttggaaaatactgggagcgggcaatgaggaatccccggggtaacatttgaaaacctcttctgttattggagatttaaatgatcagaagctcccctaaaaggacttggtccctttaaaacatttttttttttgagatggagtttcacttttgtcacccaggctagagtgcaatggcacggtcttggctcactgcaacctccacctcccaggttcaagtgattctcctgcctcagcctcccgagtagctgggattacaggcgtccaccaccacacccagctaaattttgtatttttaatagagatggggtttcaccatattggcctattggtctcaaactcctgacctcaggtgatccacatgcctcggcctcccaaagtgctgggattacaaatgtgagccaccatgcctggccaaaacattttttaatggtttgtagagatgagatttcactatgcccaggctggtcttaaactcttggactcaagagatctgcccacctcggcctcccaaagtgctgggattataggcatgagccactgagcccagccaggacttggtcctttaagaagcaggtgtgggccgggtgcggtggttcacgcctgtaatcccagcactttgggaggctgaggcaggcggatcacaaggtcaggagatcgaaaccattctggctaacacggtgaaaccctgtctctactaaaaatacaaaaaaaaattcaccgggcatggtggccggcgcctgtagtcccagctactcaggaggctgaggcaggaggatggcatgaacccaggaggcagagcttgcagtgagccaagatcgtgccactgcactccagcctgggcaacagagcaagacttgtctcaaaaaaaaaaaaaaagaagaagcaggtgtgccgggcttggtgtctcatgcctgtaatcccagcactttgggaggcctaagggggaggatcacgaggtcaagagatcaagatcatcctggccgacatggtgaaaccccatctccactaaaaatacaaaaattagctcggtgtggtggcactcacctgtagtcccagctactcaggaggctgaggcaggagaattgcttgaacctgggaggtggagattgcagcgagctaagatcatgccactgcactccagcctgatgacagagcaagactccatgtcaaaaaaaaaaaacaacctttctgggcatggtggtgtgtgcctgtagtcccagctactcaagaggctgaagtaggaagattgtttgagtccaggagtttaagcttgcactgagtcatgatcacaccactgcactccagcctgggcaacagagacagactctgtctctaaataaatcagtaaatcctgccttagataaaaattgcagaccaggtgtggtggctcacacctgtaatcccagcactttggcaggacgaggtcggtggattgcttgagcttaggagttcaagagcggcctcggcaacatggcaaaactctgtctttacaaaaaaatacaaaaattagccaggcatggtggcatacacctgtagtcccagctactcaggaaactgagctgggaggatcacttcagcctaagaggttgaggctgcagtgagctgtgattgtgccactgcactccagcctgggcaacagagcaagaccctgtctcaaaaaataaaataaaacaaaataaaataaaattgctgttggattaattaggaggtttgatatggagcaagtcatcctttcatgttttgaagtaactttaaagtttgtccactcagtaagacacaagtatccatttgggcttcttcaatattctatggggtttggccgggcatggtggctcatacctgtaatcccagcactttgggaggccaaggagggcggatcacttgaagccaggagttcgacaccagcatggtaacacggtgaaaccccatctctactaaaaatacaaaaattagccaggcgtggtggtgcatcactgtagtcccagctgcttgggaggctgaggcatgagaattgcttgaatctgggaggtagagattgtgtgaaccaagatcgtgcaactgtactccagtctgggtgacagagtgagactctgtctcaaaaaaataaaataaaatattctatggggttcaagagtttcgtttttagggccaaagcattattattggaggaaggcaatccctacttctcccacttatttctgccatgggaggagggttctcctgcccaacacccacaggcccaggcacctggaggcaactctaaaaacagcaggagactactgaaggaaattgtccatctctacgaggcactccttgtgtctccagaatttattaaatgacatcacagtaaggcttggcaagtaggataagggagttagaccagggaggacagacagaagtctgcaggcctgaacacaggcaggaaggaaacggaaaatgcaaacaggagaggtgaggccagagctgagcactgcagaaggaaaatgaacaaccctagtttgtattacagaacactttcacaagtacggtctgcctttatcctcagcagttcttactggtaagatataatgatatccattttatagataaggatcctaaagcccagcaaggtcatggatctacacataactgagccacacatcttagatcagtgctttttctgcttggcacaccccacagggactggcacataatgggtaaagagttgacatttattgaagaaaagtagaaggtatgcatttgacagcacttaaaaaaaaatgtaggccaggcgcggtggctcacgtctgtaatcccagcactttgggaggctgaggtgggtgaatcacctgaggtcaggagtttgagaccagcctggccaacatggtgaaaccacatctctactaaaaatacaaaaattagcccagtgtcattgcatgtgcctgtaattccagctactcaggaggctgaggcagaagaatcgcttgaacgtgggaggtggaggttgcagtgagccaagatcgcaccactgcactccagcctgagcaacagagcaagactccatcacaaaaaataaaaataaaatagaagctgatagggtatatttgagggggaaaagattcaataacagaaattgaaatgtaggtaagcatgaggaagttgtaagcacttcctagctctgtctttttttttttttttgagacggagtttcactcttgttgcccagggtaaagtgcaatggcgtgatctcggctcacggcaacctccacctcccgggttcaagcgattctcctgcctcagcctcctgactagctgggatccacctcccgggttcaagcgattctcctgcctcggcctcccgagtagctgggattacaggcatgcgccaccatgcccagctaattttgtatttttagtagagacggggtttctccatgttgatcaggctggtctcaaactcccgacctcaggtgatccacccgcctcagcctcccaaagtgctgtgattacaggtgtgagccactgcacccagcctctagctctgtctcttacttgaatgtgatctcaccctgtgtgcctcagcttcctcatttggaaatccaggtctcagagtcaggaagtaactttttggttaccttacactgaacactgaaggttgcataagagttggttacatgctgggcgcagtggctcatgcctgtaatcctagcactttgggaggccgaggtaggtggctcatctgaagacaggagtttgagaccagcctggccaacatggtgaaaccccgactctattaaaaatacaaaaattagccaggtgtggtggcacttgcctgtaatcccagctactcgggaggctgaggcaggagaatctctggaacccgggaggcagaggctgcagtgagcaaagattgtgccactgcactccagctggagacagagcaagactccgtctccaaaaaaaaaaaagagagatacactccaggtagatgggactgcatgagcaacggcttgggttagaaattatggcagcatggatgagagacactgttctcatgtattttgtttcacgaggacaataataaaacttgtttactgtgatgacaattaaataagataatgcaggtaaggtgcttagcagaggcttgtacataatgaactcagtaatggtgcttgtttttactgctatttttgttgtttttacagattaaaaaaacaaaggctctgataggtgatatgtaggccaggcacacagctattggttgttgagcaggatttgaacccacagcttttatttatttatttatttatttatttatttatttacttatttacttacatttttaaatttaatttttttttttttttgagataggttctcactcattgcccaggctgcagtgcagtgatgtgatctcggctcactgcaacctctgcctcccaggttcaagtgattctcctgccttagcctcctgagtagctgggaccacaggcacatgaaatcatgaccagctaatttttatatttttagtaaagacagggtttcgccatattggccaggctggtcttgaactcctgacctcaagtgatccgcccaccttggcctcctaaagtgctgggattacaggcgtgagcccactgcacccagcctatttatttgcttttagagacggagtctcactatgttgtctagggtggaatgcagtggctattcacagtcacaatccctccactgatcagcacagttttgacctgctccattttcatcctgggcctgttcacccctccttagacacccttgcttacaggaggtcacatattgaagctgaacttagcacagacactcgatcaatatagcacactacagcctagaactcttgggctcaagaatccctaggcttatcctcctgcctcagccttctgaggagcaggaaccacagggacacaccactgttcccggcaccatatcttcttgacactaagagaccaggctctgaaccactgtgttcaagttaccccgttgtggggcctctgttcctgccctaggggcctccctgactcagcaactgtgggtggctttgcttctgtgcctggacagcagaggaggtgagaagccttccagttccttgaaaaccaaatacggccagaccaggcctctgaggcccaaccctcaggcttggcctgctcctgcctgctcatatgggctgtggggcgcaactccctactcaacctcctggctctgctccagggggctctggcagaacctccatccagatcctccttctcaggatcttgttgggaaaaatactgaaagagaacataaaatgagtgcctctcatccatgctgcaataattcctaattctaagactttgctcatgtaatttggtccacggagtacctctcaaatcagtgtttaatgtgtctttggtggccagtgtgagctatcaggaagagttactttataactgtgagacctgcagtaagtcactcatctcatccatccacccatccatccatccatccatctacccacccattgggcacctacctgtgccaaacacattacatacagactcttcttccagaccggaaactccatgagaattgcagaccaggtgtcaaaagataattattcagggcaggcatggtggctcatgcctgtaatcccagcactttgggaggccgaggtgggtggatcacttgaagtcaggagtttgagaccagcctggccaacatggtgaaaccctgcctctactaataatgcaaaaatcagccaggcgtggtggcatgcatctgtaataccagacacttgggaggctgagacagaagaatcacttgaatccaggaggtagaggttgcagtgagccaagatcgtgccattgcactccagtctaggcaacagagtaagactctgtctcaaaaaataataaaaaaattaaaaaaaagataattattcaaccaatatccatgtgtctcaatgtgtctcctccaatttatatattgaaacataatctgcaatgtggtagtattaagaggtgggacttttgggggcgatcacttcatgaagctccatccttataaatgggattagtgcccttataaaagaagcctgagggagtttgttcaccccttctaccatgtaaggacacatagaagacgtcctctatgaggaacaggccctcattgacacccaatctactgacgccttgttcgtggatttctcggcctctagaactatgagcaacatatttctgttgtttatatattactgagtctgaggtattttgttataacaacaggagcagactaagacaatgaaccgatgggccaaggcttgtccttactacagtcctggtaaggctgttatcattatcacccccatttcacagttgagaagcccgacactcagagaggggaagtacaaagaacatacagccagagatgagtggagctgagacttggccaagttcttaaccctcctaacagggaggaaccatgctaaggggcaggccctggaggaggacacggaccatttctccttcagctcttggcttccttggcaggaagtggattaattctttctcttgtctccttcctaaccaagcctttgagggtgcccagctcagagtctacaaagtccttttcaaggtttctagagccctcctctcagccctgtaggggattcagggcggggggaccttcctcatggttcagatgggagaattgaggcctctactgcccacagttatgtgccatattaggggcctggaatctcatgcttcaagaaactgagcatggaactggctgctagatatttcctgtaggtgtggtatgaagctcttagagtctgacaggtcctagctctgccacttacaagttatgcagtcttagaggaatcacttcacccctctgaactgcagacttctcccctgaatagtgaggacagtgctagtacctatttgagagatgttgggaggatgaaatgaaacaatgcttgtgaagcacttagcgtagtacctggaacatagtcagtgctccaacaatgaggctattatggtactaagtacctaaaacagaacatcagactggtaggaatatccatgctgagggtaatgttagctaatgtttccctttttttgagacagaatctcgctctgtcgcccaggctggagtgccatggcccaatctcagctcacttcaacctccacttcccagattcaagcaattctcctgcctcagcctcccatgtagctgggattacaggcacaagccacttcgccagctaatttttgtatttttagtagagacagtgtttcactgtgttggccaggctggtctcctactcctggcctcaagtgatccaccctccttggcctcccaaattgttaggataacaggcgtgagccaccatgcctggccagctaacgtcttttttattgctactatgtaccagacacattcatctggacaatatccctgtaacttagtgccattttacagatgtgataactaaaattagcccagctaattttcttgtatatttagtagagacgggttttcaccatgtttgccaacctggtcttttttttttttttctcagatggaatcttgctctgttgcccaggctggagtgcagtggtgcaatcttcgttcgctgcaacctccaactcccgggttcaagcaattctcctccctgggcctcccgagtagctggggttacaggcgtgtgccagcacgcccagctaattttcttgtatatttagtagagacggggtttcaccatgttgacctggctggtcttttttttgtttgtttgtttgttttgtttttctgagatggaatcttgctctgttgcccaggctggagtgcagaggtgcaatcttggttcgctgaaacctccacctcccgggttcaagcgatcctcctgcctgggcctcctgagtacctggggttacaggcgtgtgccagcacgcccagctaattttgttgtatatttagtagagacggggtttcaccatgttggccaggctggtctttttttcttttttcttttttttctgagatggagtctggctctgttgtccaggctggagtgcagttgtgcaatcttggtgcactgcaacctccacctccagggttcaagcgatcctcctgcttgggcctcctgagtagctgggattacaggcatgtgccaccatgcccagctaatttttttgtatatttattagagacagggttccgctatgttggccaggctggtgtttctcttatttttttgagatggagtcttgctctattgccgaggctggagtgcttctttttttcagatggagtctcactctgttgcccaggctggagtgcttcttttttttgaaatggagtctcactctgttgcccaggctggagtacagtggcgcaatcttggctcgctgcagcctccacctcctgggttcaagtgatcctcctgcctgggcctcccgagtagctgggattacaggcctgtgccaccacgcccagctaatttttttgtatatttagtagagacggggtttcaccatgttggccaggctggtgtgttttttttttttttttttggtttttttttttttttggagatggaatctcgctttactgcccaggctggatggagtgcttcttttttttcagatggagtctcactctgttgccgaggctggagtacagttgtgcaatcttggcttgctgcagcctccacttcccgggttcaagcgatcctcctgcctgggcctcctgagtagctgggattacaggtgtgtgccaccacgcccagctaatttctttgtatatttagtagagacgaggtttcaccaagttggccaggctggtctttttttttttttttttttttttttttttctgagagggagtctcgccctgttgcccaggctggagtgcagtggtgcaatcttggttcgctgcgacctccacctcccgggttcaacagatcttcctgcctgggcctcccaagtagctgggattacaggcgtgtgccaccacgcccagctgatttttttgtatatttattagagacggggttccactatattggccaggctggtgttttgttttgtttttttttttttggagatggactctcgctctactgcccaggctggatggagtgcttctttttttcagatggagtgtggctgggtggcttgggtggctgggctggctggctggcttggctgggtggcttggctggctggctggctggcttcggtggctgggtggcttggctggcttggctggctggctggctggcttggctggcttggctggctggcaggcttggctggaatgactggattggctggcttggctggctggcaggcttggctggaatggctggcttggctggcttggctggctggcaggcttggctggaatggctggcttggctggcttggttggctggctggcttggctggcttggctggctgggtggcttggctggcttggctggctggccggcttggctaccttggctggctggcaggcttggctggattggctggctgggtggcttggctggcttggctggctggctggctggcttggctggcttggctggctggcaggcttggctggaatggctggcttggctaccttggctggctggcaggcttggctggattggctggcctggatggcttggctggctggctggcttggctagcatggctggctcgcttggctggctgggtggcttgggtggcttggctggctggctgtcttggctggctggctggcatggctggcttggctgactaggtggcttgaccggcttggctggctgggtggcttggccggcttggctggctggctggcttggccggcctgggtggctggctggcttggctggctgggtggctggctgacttggctggctgggtggcttggctggcttggctggcttggctctctggcaggcttggctggattggctctctggcaggcttggctggattggctggcttgcctggtttggccggcttggctggctggcaggcttggccggcttggctggctggctggcttggccggcttgtccggctgggtggcttgactggcttggctggctgggtggcttgggtggcttggctggctgggtggcttggctggcttggcaggatgggtggctaggctggcttggctggctggctggcttggctggcttggctagcttgcctggcttggctggcttggctggcttggctggctgggtggctggctggcttggccagctgggtgtcttggctggcttggctggcttgggtgtcttggctggctaggctggctggctggcttggctggcttggatggctggctggcttggctggtttgggtggcttggctggctagctggcttggctggatgggtggcttggctgggttggtgggctggctggcttggctggcttggctggcttggatggctggctggcttggcttgcttggctgtctgggtggcttggctggctggctggcttggttggcttcgctggctgactggcttggctggcttcgctggcttgactgtttgggtggcttggccggcttggatggctgggtggcttggccggcttggttggctggctggcttggctgcctcggtggctggctggcttggctggctgggtggctggctggcttggctggctgggtggcttgactggcttggctggctggctgtcttggctttctagctggcatggctggcttggctggctgactgggtgcctggctggcttggctggcttgggtggcttggctggctaggctgggtggctgtctggcttggctggcaggttggcttggctggcttggctggcttgggtggcttggctggctagggtggctggctggcttggctggcttggggggctggctggcttggctggcttggctggctaggctgggtggctgggtggcttggctggcttggctggcttgggtggcttggctggctaggctgggtggctgggtggcttggctggcttgggtggcttgggtggcttggctggctagggtggctggctgggtggcttggctggcttggctggcttgggtggcttggctggctagggtggctggctgggtggcttagggggctggctggcttggctggcttggctggcttggctggctggctggcttggctggctgactggcatggttggcttcgctggcttggctggctggcttggctggcttggctggctggctggcttgtctggcttggctggctggcttggctggcttggctggcttggctggcttggccggctggcaggcttgcctggcttttctggcttactggcttggctggcttggtcggcttggctggctggcttgggtggcttggctggcttggctggctggcaggcttggctggcttggctgggttggctggctggctgtcttggccggcttggcttgcttggctgcctgtgctggctggctggctgggctgtctggctggttggctggcttgtctggcttagctgcctgtgctggctggctggctgggctgtctggctggttggctggcttggctggcttggctggcttgactgaccggcttggctggctttgctctcttggctggcttggctgggtggctggctttgctgggtggctggctggcttggctggtggtctggtttggctggctgactggctgggctggctgggctcgctggctggcttgcccagcttggctggctgggctggctgggctcgctggctggcttgcccggctttgctggctggctggctgggctggcttggctggcttggctggctgggtggcttggctggctggctggtttgcctagcttggctggctggcttggctggctgggtgggttggctgccttggctggctggctgtcttggctttctagctggcatggctggcttggctgactgggtgcctggctggcttggctggctgggtggcttggctggcttggctggcttgggtggctgggtggcttggctggctggcttggccggctgggctggctggctggcttggctggctgactggcatggttggcttcgctggcttgactgtttgggtggcttggccagcttggctggctgagtggcttggctggctttgctggctgggtggcttggctggcttggctggctgggcggcccactggcttggctgcctgactggctggctggctggctggctggctggcttggctggctgggtggcttggttggcttggctggctggctgtcttggctggctggctggcatggctggcttggctgactgggtggctggcgggcttggctggctgggtgtcttggctggctgtgtggcttggctggcttggctggctgggtggcttggctggcttggctggctaggtggcttggctggcctggctggctggctggcttggcttgcttgattggcttggctggcttggctggctggctggctggcttggctggctgggtggcttggctggcttggccagcagggtggcttggccggctgggtggcttggctggcttgcctggctgggtggcttggctggcttggctggctggctggcttggctggcttggctggcttactggcttggctggcttggtcggcttggctggctggcttgggtggcttggctggcttggctggctggcaggcttggctggcttggctgggttggctggctggctgtcttggccggcttggctggctggctggcatggcttgcttggctgcctgtgctggctggctggctgggctgtctggctggttggctggcttgtctggcttagctgcctgtgctgtctggctggctgggctgtctggctggttggctggcttggctggcttggctggcttgactgaccggcttggctggctttgctctcttggctggcttggctgggtggctggctttgctgggtggctggctggcttggctggtggtctggtttggctggctgactggctgggctggctgggctcgctggctggcttgcccggctgggctggctgggctggctgggctcgctggctggcttgcccggcttggctggctggctggctgggctggcttggctgccttggctggcttggctggctggctggcttggctggctttgctggctggctggctgggctggcttggctggcttggctggctgggtggcttggctggctggctggtttgcctagcttggctggctggcttggttggctgagtgggttggctgccttggctggctggctgtcttggctttctagctggcatggctggcttggctgactgggtgcctggctggcttggctggctgggtggcttggctggcttggctggcttgggtggctgggtggcttggctggattggctggccggctgggctggtttacacggctggctggcttggctggcttggctggctggctgtcttgtgtggctggctggcatggctggcttggctgactgggtggctggcgggcttggctgtctgggtggtttggctggcttggctggctgggtggctggctggcttggctggctgggtggcttggctggctgcgtggcttggcaggcttggctggctgggtggctggctggcttggctggctgggtggcttggctggcttggctggctgggtggcttcgctggcttggctggctaggtggcttggctggcttggctgtctgggtggcttggctggcttggctggctaggtggcttggctggcttggctggcttgggtggcttggctggcttgcctggcttcgctggcttggctgtctgggtggcttggctggcttggctgtctgggtggcttggctggcttggctggctggcttccttggctggcttggctggctgggtggcttggctggcttggctggctgggtggctgtctggcttggctggctgggtggcttggctggcttggctggcttgggtggcttggctggctaggctgggtggctgtctggcttggctggctgggtggcttggctggcttggctggcttgggtggcttggctcgctagggtggctggctggcttggctggctttgggggctggctggcttggctggcttggctggctaggctgggtggctgggtggcttggctggcttggctggcttgggtggcttggctggctagggtggctggctggcttggctggcttggggggctggctggcttggctggcttggctggctaggctgggtggctgggtggcttggctggcttggctggcttgggtggcttggctggctaggctgggtggctgggtggcttggctggcttggctggtttaggtggcttggctggctagggtggccggctgggtggcttgtctggcttggctggcttgggtggcttggctggctagggtggctggctgggtggcttggggggcttggcttgcttggctggctggttggcttggctgggttgcttggctggcttggctggctggctggcttggctggctgactggcatggttggcttcgctggcttgactgtttgggtggcttggccagcttggctggctgagtggcttggctggctttgctggctgggtggcttggctggcttggctggctgggcggcccactggcttggctgcctgactggctggctggctggctggctggctggcttggctggctgggtggcttggttggcttggctggctggctgtcttggctggctggctggcatggcgggcttggctggctgggtgtcttggctggctgtgtggcttggctggcttggctggctgggtggcttggacattaaatataatatatttggtacattaaatataaacattgtatacattaaatataaacatcttttatacatcaaacataaacattttatacattaaatgtaaacatatacattaaatataaacatcttgtatacattaaatataagaatacatttggtacatttaatgtatacaatacattaaatatagacattttagacattaaatataagcatatattcagcacattaaatgtaaacatattttatacattaaatataaatactgtatatgttaaatataaatatgtattttctatattaaatataaatatgtattctgtacattaaatataaacattttctatattaaatataaacatgtattttggatagtaaatataactatacattgtctatattaaatattaacatgtattttgtatattaaacataaacatatatttcccatattaaatataaacatatatttttatgtcaaatataaatatatattttatatattaaatataaatatgtatttcctgtattaaatatacacatatatattaaatataaatatatttttccatatgaaatgtaaacatattttaaacattaaatatattcatcttagatatggcccgtgttggaatgtgtaatagattgagtatataatgtctactcaatataaaatttatatttatatatgcagtaatgattcaggttgattgtagttaagaaaaacaagctccaaattcgaaagaaatatgtaagaagagagacagggagaaaaaataatgaggcaggtaaatgcaacagacaattcgagacccacaagtgcagagcaggcttcccagacccgggtaatgtctcctgggctgataggaagccctcaaccccccaagtccttgtcagccataaaccacctgagcacagagccagagggaccatgttggggctgggcctcccgacttcagttcctctcattctgtgcaaaggaaaaacaattcagaatctacagaggtttagacgtgtgtagatgtggacagagaagtccgggcacagtggtttactgcccaagaagacagtgagtccccggaggaatagaataatatacatcatgctaatatatgtcatcccagtactttgggaggccgaggtgggtggatcacttgaggtcaagagttcgagaccagcctggccaacatggtgaaacaccgtctctactaaaaatacagaaattagttggctgcaggggtggatacctatgatcccagaaactcgggagacagaggcaggacgaactgcttgaacctgggaggaggaggttgcagtgagctgagatcatgccattgcactccagcctgggggacagagcaagatcccgtctcaaagaaaaaagaaaaaaagaagttgtgagtgctaagttctctctggattttcaggaggccagttctccagtccacggtgtcctgggaggacaggggttcctgagggtgaacagagcctgtgcccggtcaggtaggatcacatgtccctgaagttcagaacccaggagaatggggagggtcctgggggttcctgctgcatggagggaagaccctctttccacaggggccccagagagcgagaggaaggaggagggcaggtcagtgagtgtgatggtcacagtggagagggaagcagaaagaagtgttcccacaacaagacacacacagtgtccacgctgaagctacagagaggacctctccacctgtgtctgccgcaaagcagtagggcgtcttctggcagcccagagtcacctccagatcccacctgcaccatgcttcctgcggggactgcctgtcttcctaatacactgtcttctgaccagtcttccagacaaatcaccggttgctatatatatatatattttttttaatagctaatatcttacactgatatatttatattatatataaatatttttgtactttatgtttatgctatatatacagatgtagttagctatttatgttatatataatataaacatgatgtatattcttatatttctctggggactcactgtcttaataaactgtcttctgaccaaattcttccagacaaatcagctgttgctatatatatatatatatatatatatatatatatatatatatgctatatattttactgcatagaatatataatatattatatagcatagaatatattatatattatatattaattatataatatacattacatattatatataatatattatattattatgctatatcatatattatatatgttatatatgtatatatatattatatatacacatatacacatacatacacacatgtatattttaatagctaatatcttacactggtatatttatattacatatgattatatacaaatatttttgtactttatgtttatgctgtatatacagatgtaattagttgtttatgttatatgtaatataaacatgatgtatattcttattttcctgtgaggacccactgtcttcttaatacactgtcttctgaccaaagtcttccacacaaatcagctgttactatatatatatatataatatttatatacacatatacacatacatacgcacatatgtatattttaatagctaatatcttacactgatatatttatattacatatagttacatactaatatttttgtagtttatgtttatactatatatacagatgtcgttaggtatttatgttatatataatatattaacatgatgtatatccttatattcttctggggactcactgtcttcttaatacactgtcttctgactagaatattccagacaaatcactggttgctctctctctctctatatatatattttttaatagctaatatcttacactgatatatttatattacatatagttatatacaaatatttttgtacttttgtttatactatatacacagatgtagttagctatttatgttatatataatatatcaacatgatgtatattcttatattcctctggggactcacagtcttcttaatacactgtcttctgaccagactcttccagacaaatcagctgttgcaatatatatatttatttattttttaatagccagtatcttacactgtggctcatgcctgtaatcccagcactttgggaggccaaggcgggtggatcacctgaggtcaggagtttgagaccatcctggctaacacagtgaaaccccatctctactaaaaatacaaaaattgattgggtgtggtggtgcatgcctgtaatcccagctactcgggaggctgaggcaggagaatcgcttgaacccaggaggcagaggttgcagtgagccgagatcgtgtcgctgcactccagcctgggcaacagagcgagactccatctcacacacacaaaacatcttacactgatgtatttatattacgtgtagctgtatataaatatttttgtacttatatgctgtgtacttatattctatatattataaaacattttataaaattatacatgtataaaatgttacataaaaattttaatataataccattttattgcatatatttctaaatttaatataatgaaattttatatataataatgtataacatttctaaatttattataatacaatgatatataattattttctcatattataattatacataagataatttattataaataaaattttatataatctacatttattataataaaacatataacacatttctaaatttaatacaataaaatactatgtataataatttataacgtttcaaaatttattatataattttattatacaattattttgtacataattatatatagtatataattgtatttatagaaatataattatgcatatacaatatgtaattttatttttacatagtatatatgcataattatgtattaacaaatataataataattttatatacttatttacattaagttacatattatataaatgatgttatatgttatatatattacatatatttttgcttaatatattaaatttaatctataaaattatgtattacaaataaaagtgtattttacatatacactacatataactttatttatataaaaatataaaagtcacatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccaccctaaggggagatgggggagttgggatggacacgttgaccagtgaggactttcctttgctggttttgaggtgtcttagcccagaagctaagacgggaagtgattctggagcaggtgagctgatcacaagcctgagccaagaatccatggagctcataaatagcagaagccaggaccctgtgcaaatccttctgaaatatcccccgtttactgggctcctaggggtggggaagaaaaattccctgacatttcggcctcagggaaagagagagacatcccactggccggaagcctctgctatttttcagaagacacctggggcatcaccctttcccaaatgacggtgattttcagagtggttcactttttggagagacatttctgccctggagatccatacatattgaatccaaacgaatactttttaattaaaaaaaattaaacattagaaagttcaatattgaggcagctacgagtttgaattcctcatttttcctaaatgcatgttgtcaaaatctgtattgcatttagtaactacctatgtttctaatgtatataaggttacacaatgttttcttctttttctcctcctcagggtcagaatttgaaataaaagttttggaaagaaaaaacactcttgtctgtttgtgcaaaaataaaagaacccatattttaagaatattttaagataaatacaaattgtgtgtgtgggggggttgcttataagaattcttcatatcctaaatcaaagatagatcttgttattaaccagaaaacaaaatgtgtgtgtataaatgtacaacactcttacactcacacaaacacaggcacacatgtgcacacacacattcacgcactcactgatgtactcacacaaacacaggcattcatgtataaatacacacctaagcatgtatttatggaaatataattatgcacatacaacatataattttatttttacatagtatatatacataattatgtattaacaaatataagatcaattttattatatacttatttacataaaggtatatatgatataaatgatgttatatggcatgtatatatcacatataactttgcttagtatataaaatttaatctataaaattatgtattacaaataaaagtatattttacatatacactatatataactttattatttatatgaactataaaaatcatatgtttatattaataaaatatatttatttatatcaatatattaatataaagtatacacaatgtatatttatataaaaatttttaattaaaaaatattcattttggttcaatatgtatggatcgccagggcagaaacgtctcttcaaaaggtgaaccgttctcaaaatcaccgtcatttgggaaagagtgatgccccatccgttttctgagaaacagcagaggcgtatggccagtggggtgtctctctctttccctgaggccgaaaagtcagggaatttttcttccccacccctaggagctctgtaaaccggggatatttcagaaggatttgcacagggtcctggcttctgttgtaaatgagctccatggattctcagctcaggcttgtgatcaactcacctgctccagaatcactgacacaaatgcaaccacacacttacacaaacacacatcaacacgaagacagaatcacaaaacacactcatagaaacacatggacacacaaagacatgcacactcacacaaacgcagggacacacacacaaacacaattacaaaaatgtgtgtttttttgcacacgtgggtgcacatgcacattgacattctcacaaagcacacaaacatgtatacatacaaagacactcataaacagaatcatgaaaacactctcatataaacacgtggatggctactcacccacaaagacactcacatatgtcatacacactcatacacacactcagaatcacacaagcacacacaaacacataaatacagtcacacactcatgcaaacacagtcacaaaaagactcacataatcatgtggacacacaaacataaaaattcacacaccggggccgggcaaggtggctcacgcctgtactcccagaactttgggaggccgaggcgggcagataacttgaggtcgggagttccagaccagcctggccaacatggtgagaccccgtctctactcaaaaatacaaaaattagccagatgtggtggcgtatgcctgtaatcccagctactcaggaggctgaggcaggagaatcatttgaacccgggaggcagaggttgcagtgagccaagattacgccactgcactccagcctgggcaacagaacgagactctgtatcaaaaaagaaaaattagccagatgtggtggtgggtgcctgtaatcccaggtactcaggaggctgaggcagaagaatcatttgaacccgggaggcggaggttgctgtgagctgagattgtgcctttgcactccagtatgggtgacagagcgagactccgtctcaaaaaaaaaaaaagaatttatacattgccatacagattcacacacatacattcatattcacaaacacacaaatacgataaacacaggggcacacacaaacaccatcacaaaaacacacttccataaaacacaggaatgcacgctcacacagaaacatgcatggaaacacacgttgtcttacagactcacagaaacactcatcatcacataaacaggcacacacagccacacaagcacacacccacacccacatcaacacacacactcccacacggcacccacgcgctcactcacacaggtagaacaggcctgcattacctgataacgcagttaaatcagacgtgatgctgcctaccgaggagacctggaggcttcccatgaatgggctttcagaagagaggtctctgggtgcatttggtgacaccccaggcagtgggggagacgtccaggctggaaggccagccacagccagctctgctcaaggatgccacgtccatttgcttcagtaggatatgcaccctggtaacccaggttcctgcctctccaggaaaccccactgaggtcagcacatccccccaggtttagaaggggtctctgggtgcatttggtgacaccccaggcaggggggggacatccaggctggaaggccagccacacctagctctgcccgcagatgccatgtccatttgcttcagtaggatctgcatcctgtaaaccctggttcctgcctctccaggacaccccactgaggtcagcacactgcccaggtttagaaggggtctcttggtgaaatgtggtgacaccccaggcagaaggggggacgccacagccagctctgcccgcggatgccacgtccatttgctttagtagaatctgtaccttggattcccaggttcctgcctctccaggacaccccactgacgttagcacaccctccaggtttacaagcggtctctgggtacatttggtgacaccgcaggcagaggggggacgccacagccagctctgcccgcggatgccacgtccatttgcttcagtaggatctgcaccctgtaaaccctggttcctgcccctccaggacaccccactgaggtcagcaccccccaccccccacccccaggtttgtccagcttcgctgtctggggagagacacagaaagaccacattcggtggaattctggctataaccttttgtggccggcaagaaggatcaccaagctgtcctgttaccttgctggagtgatcactggtttcacgcttggcccccgtgcagtgagtgcctgggccaggctcgattcctggagctccggtgaaatttgggcttggagctcatgcctgcaccatccagaaagcagaaggcagccggcccgggctgtacggtttgtagaatcagagagaacactgtttgccttcatgtctgtaccacaataaatctgccaactgcagtcaaagtctctggattcctgacccctcattttattttgtctattacggagtggaaggagtgagaaagattttgcttcctattttgttttgcaaagtgtttctaagaaaaacaacccatgttctgaaaatgagattctgagtgtcccctgggcgtgatgaaaacaaattttgggaatccaagggcctgagaggcagagtgaatgtcatttgcatttccctgcgaatgacaaagtcactttttatttattattattattatagattcaggggatccacgggcagctttgtgacctgaggatattgtacgttgctgaggtttggggtatgaataatcccgtcacccaggcactgagcattgtacattcctgaggtatataatgtgtactaaaaataaaatgcatatttatatatgcactaatgattcaacttgattccttgtaattaagaaaaacaaaccccaaattctagaggagttctagaatatataagaagaggtccaggtgcagtggctcatgcctgtaatcccagcactttgggaggccgaggcaggcagatcacctgaggtcaggagttcgagaccagcctggccaacatggtgaaagcccgtctctgctaaaaatacaaaaattaaccaggtgtggtggcgggtgcctgtaatcccagctacttgggaggctgaggtagaagaattgcttgaatccaggaggcagaagttgcagggagccgagattgcaccactgcactccagcctgggtcacagagcgagactccatctcaaaaaaaaaaaaaaaaaaaaaaaaagagcgagagagaaaacaaacaagcaagaaaatgcaacagaaaaatccgtgacccaaagctctctccagttgctgctttctgcctgaaattcaaagaatctcagggtagtttttcaacccttgtacccccgcccctgcttcctgctctattagtactgagggtctgtggtgccccttcattgtgtccaggtgcaggcaatgtttagctcccacctataagcgagaacatgtggtatttgattttctgttcctggcgttaattcactaagcatagtgcccttcagcttcatccacgtgactacaaagggcatgattttattcttgttcatggctgtgtagtattccatgatgcggaaggaccacatttgctttatctaattgagaacatgtggtatttgattttgtttctggcattaattcactaagcataatgcccttcagcttcatccatgttgctgcaaagggcatgattttattcttgttcatggctgtgtagtattccatgatgcagaaggaccacatttgctttatctagtgaagaacatgtggtctttgattttctgttcctcatattgattcactaagcataatgccctctggctgcatccatgtggctgcaaagacaagattttatttttttcatcactgtgtagtattccgtggtgtagaagggccacatttgctttatccagttgaggacatgtagtatttcattttctgttcctggcattaattcactaagcataatgtccttcagctgtgtccatgtggctgcaaaggacatgatattattctttttcatggctgcgtagtattccatgatgcagaaagaccacatttgctttatctagtggagaacatgtggtattcgattttcttttcctggcattaattcactaagcataattcccttcagctgcatccatgtggctgcaaagacatgattttattctttttcatggctgtgcagtattccatggcgtagaagggccacaattgctttatccagtcaagaacatgtggtatttgattttctgttcttaattcattaagcataatgccctccagctacatccatgtggctgcaaaggatgtgattttattctttttcatggctgtgtagtattcgatgctgtagaagaaccacttttgctttatccggtaccctactgatgggcaactaggttgattccatgactttcctattgtaagtcatgctgtgacaaaccttacagggctgggcactataatcccagcactctggagggccaaggtgggcagatcacctgaggtcaggagttcaagaccagcctggtcaacatggtgaaaccctatctctactaaaaatacaaaaactagccaggcatggtggcgcatgcctgtaatcccagctgctcaggaggctgaggcaggagaatcactttaacccaggaggcagaggttgcagtgagccaagattgctactgcactccagcatgggcaatagagcgagacgccatctcaaaaaacaaacaaaaaaaaaggaactttaccatgcatgtatctttttggtagaatgacttcttttcctctgggtagatgcccagtcttggaattgctggtgcaaatggtggagcagtttggattcaggaggtacatgtacaggtttcttacatgcggacgatgtgtgatgctgaggtctggggtatgagtgatcccatcacccagatagtgagcataataccccacagttggttttttcaactcttgtccttctaccttcctctctccccctaactagaacccagtatctgttcccttctctgtgtctacctatacacaacatttagctcccacttatagtgagaacatgcagcattctgttaatttacttaagataatggcctccacactgttcacaatagcaaagatgtggaaccaacccaaatgctcatcagtgatagactggataaacaaaatgcagcacatagacactgtggaatactatgcagccatgaaaaaggatgagttcatgtcctttgcagggacatggatgaagctggaaaccctcatgttcagcaaagtgaaacaggaacagaaaaccaaacagtgcatgttctcaccataagagggaagtgaacaatgagaacacatcgacccggagaggggaacatcacacactggggcctgttgcaggggtgggggactgggggagggacagcattatgagaaatatctaatgtagatgatgggttgatgggtgcagcaaaccgctatggcacatatatatctatgtaacaatcctgcacattctgcacatataccccagaacttaaagtagaatagaaaaaataaaaaataataaaaataattaaaaaagataatggcctccagctacatccatgttgctgcaaaaacaaacaaacaaaaaaaacaaaaaaatgattttgttccttttcagggttgcgtagtattccatggtgtagatgtaccacattttctttgagggtagagggtgggaggagggagaagatcagcaaaaataacctgtggctgggtgtggcagctcacacctgtattctcagcagtttgggaggctgaggtgggtggatcacctgaggtcaggagtttgagatcagcctggccaacatggcaaaaccctatctctactaaaagtacaaaaattagccgggcatggtggtgcacgcctgtaatcccggctcctctgtaggttgaggcaggagaatctcttgaacccaggaggcagacattgcagtgagccgagatcgtgccactgccctccagcctgggccacagagtgggactccatctcaaaaaataatcataaaaataataataataacctgctaggcttaggacctaggttgattccattacaaaaaaaaaaaagaaaaaactaactttttaaaagaaggatctctctgttcaaaaacaaaaccaatgccctgtcaggaaagatgttctgtgtttctggtaaagctggaaggaacctacaggaaggagtcaccccataaaactagtggagcagcattaccttttgaggtgagggctacttctgttaggccaccaggatgagtgccttcctggggagtgtggttcatcctataccatccaggaagcaattcctgcccccaaatcacttgccagcttctgccccgtaagtaaaatccccagcaagcgggcagcaaggagctgcttgccttggaagtcagctgaagtctctgcccaccacccagactgtgtcctctgggaaaggccaggtcttccagttggatggttttcacattagcggctgcttagaatcatcaacattggccaggcacggtggctcatgtctgtcatctcagcactttgggaagctgaggcgggcggatcacaaggtcagggaccagcctggccaacatggtgaaaccctgtctcaactaaaaaaaaatacaaaaattagcttggtatggctgggcatggtggctcatccctgtaatcccagcactgtgggaggctgaggcgggcggatcatgaggtcaggagatcaagaccatcctggctaacatggtgaaaccctgtctctactaaaaatacaaaaaattagccaggcacggtggcaggcacctgtagtcccagctactcgtgagactgaggcaggagaatggcgtgaacctgagaggtggggtttgcagtgagcccagattgcgccactgcactccagcctgggcgatatagagtgagactctgtctcaaaaaaattaaaataataaaaaattagcctggtgtggcggtgggcacctgtaatcccagctactcaggaggctgaggcaggagaattgcttgcaccccagaggcagaggttgcagtgagccgagattgcaccattgcactccagcctagacaacagagtgagaatctgttgcaaaaaaaaaaaaaaaaaaaaaaaaggaatcatcaacattgccttggcccaatctcttcccagacttgtcaaatatttaccactggacctccatgttctagtttcaaagctctgctggccacggtggctcatgtctgtcatcccagcactttgggaggctgaggtaggaggactgctcgaacccagaagcatgaatccatcctaggcaacatagtgataatagtgtcaaatgagagccagtgtccagtaattccccaaatatctgagaattttcttttctttaagtcacagtcatcctggcagaaggctgtaggtccctttggggaagactgggaaaaagattaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaacaacaactaagactttggtacagcccattagctctccctgtggataccatggactacacaatgccatgggtgtctgtgagtcaaaccattctgactgctgctttgacactgctttccactgtggtgaccacacccacctcatctttggtgattaaggacagcccatgttccctgccaccccaggattcaattatcctcattttacttaaagataccagtccagtggctgcagttcctgctgtaacattttgcctactgagagcacaagctcaaagctcttccaggatactgggctcatctcacaatattctttctcatgatcgttgtgaggagtatgttctgtagacccttcagtgtgagtgagcaggtctgacataataaatccagtctccctgagtttttgcatacctttctgtacacataaaccaaggaagttgtggcatctcaactttatgtaccttaggtaaactctgattctgtttcagccaaccaaccaagtcaccaaacaaataagcaaacagccaaccaatcaaccaacaagcaaacaagcaagcaacaaaccaaccaaacaaccaagcaaggaaacaagcaccaccaaccaagcaagcaaccaaccaagtaaccgatcaaaccaacccttggagccctttctaaagctttgacctacaactctgagtccagaatctctgtttagtgggccaacattaataaatttagcctaatccaactttatgttactttcaccatggtgccacacacttaatatccattcccacatatattctccagatttccttctgtataaattgcatgtgtgtgtgtgtgtgtgtgtgtgtgtgtagaaagagaggatcaactgaaaaatcacacaattttataaatttagaaaagagagctttatttcttataaaggtttgcagcctgcaaggtggccattatgacaggctgggaagtgtggcctacagccaaggccagaggcaggcatttccagggagggagggagaggacaggaatttgagccaaatgagttggctacatatacatactcaataggatatcagaggagctatatcattttatgagaatactcataaaagaggtcctaacacatgcatattcaataaacatgcatgttcattctggggtggagacttgacatttaaatgtattataattaggccctacacatcaaaaagtgaagcagggacatgaaggtactcagcctcgtaaaggcacagcctctaaaactggccagaaccagtccatggaggatggtctcttatcaggagaaagttactgaaatcagtcccttgtccagagaaagctgtcgttaaggttagtggggcaggagatcagttactcagcatctgtgaactgggtgagttgtaattgttttaatcttctctcacagccatctctcacagccagtgcttgcttggctgctagagaaaaataaaacccatgtggtagctagaatctagttaattctttaagagtagggtacaagacttaaccctcgcctggcatggccctaggtcctgtttataatttgaggtcttattgccacaaagagtctgttctgtcagtctcatgatctctattttaacatcaatgctgttcagttgttgggtctaaaccataagagggagggaggtacagggaggtatgtctgacttcctgtcctgtcatggccaagaactgaattttaagatttatttgaggttccgttggccaacagggggtctgttaagttgggtggggggcttaggattttagttttagttctcaagggagataaaataatttaatcaattggcccctgcgactgtgggactaacatggctatgatctgtcggacagacttcagggtggcacccaggcaaaattctatgctgtagtaaatgcatcatgcacatttgtaacaatatgtacataacaatgtcacaaaatactttcacggtgacacctagattagtattttattgaatagctgatgatataaactggctcatttgatgccaagactgaccattaccaccataccaacgtcatcactgatcagaggcctaacccaaggagggggtcatgtgcagacccagcagtggggaggaaagatgctgcagaggagacagatgcccacagaggcccctgagcagataccatgctcactaagtggtaagtatagactcaacgtaggctgtaaggtctccccctgtgcaaatgggacatccacttgagagtcaagggtctgtttgggtggcagggatagccacttctgaaggtagaaaggaaataagccaccaaattggtatctttctgtgaaatggacatcgtgcttagaatctccattttccccacaacctggaggaataagtactgtcatgtgcattttgtagctgaggaatctgatgcaacaaagttaaattacttgcctaagcaattagcaattaaccaagtctttctgactcagaaactcagctgttgcctgttcatatccagcccctgtattggggtcaagatctggcctgttctcaatgcagcaagatccaggcagatcacactggactcccagcactgaatctggctcaaggggacatcaaatttgactgggtcgtggggctcaggagcatcactctcaaaaatagtggtacaggaagaggcgatgaccctaaacagcatttgcaggcagatcccatgttaataataagggtcaggactctctcacttttctgtctctctctctgtctctcctctagggctgaccccacattggacaccactgcatccatgtccatcacacaccacagctgccttttcttctgcctgcttatgggaaagtcccctcctctcctccgttttcttctcttcctgccctatcacaccgtgcacttctccctttccttaaagaaccaccatcaactttaggaggagggaaaggggtggctctggcaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacacgggagaggagaatggatttatagagaacatcatctaaatccaacttgaccattgtgtggccacacttgctagattgctttagtctaaatctagcattgtagaaagacgggggagcttggagctgcacaaacccaggtctggaactggctccttaccttgaaaggtgaataatcctggcaggactcttagccttcctgggcctcagtttctttatctgtttcttgggaaggaggatctctgctggttggttgggtgatgtgggggctgtgtgaaaacaacttgtcaatacaagccaaaacaggaatatttctccacagagtatgaaggtcaaatgagagaatacatttaaattaaacggaaaattaaaatggcaaaaaaggcaaagctgtattgaaagttctgagcttctctataaggagctttttgactatgtaagaatcctatactcgttccccctaaatataaaaaaaaaagttgaaggaggcagaagggagagtgatgcacgatgggcgaggacttcacctgctgttgctggctttgaggatggaggaaggaggccacaaacccagaagctggagcccctagaagctagaaaacgcagggacctgattcatcccttgagcctccagaagggacatagccccaccagcaccttgactttagcccagtgagatcctcttaggacttttggcaaccagaactataagacggaaatggaagccactgagtctgtagctgtttgctgcagcagcaatagaaaactaatgcagagcccaagaaatcactggtgatgagatggggaagtgggctcaggaggtctggatctgtgatgagatggggaaagtgggggaggtctggatctgtgatgagatggggaaagtgggctcaggaggtctggatctgtgatgagatggggaaagtgggctcaggaggtctggatctgtgatgagatgggggaagtgggctcaggaggtctggatctgagttggggatctggagtggaaggggaattcatttgttcattgtctatccttttgcattgattcagttttttttccatatatatatatgtgaatttcacaataaaagttttttccaaaataaaagaaacaaaaggggctttttgcaactcaattcctatctatgtctgagtccacttgtattgaatgagtctttctgctaacgtccttatatttgggtgacaatctgaatgtcagtgaccaatcagagcagaggcagaccttggagtgggcagggcatcctgagggccctgattcctgccatgaggcataaccctttaggtgccagaccatggggaggtccaggggttgcaggggagggctgtgcatctgcaatgactctcagggggctcccggtggtggcaattggtgaatctgcacggtggtgtttcaatattgtcacagccctgctgtctctcatgctctcaaaaagcatttctcttacctgtgacagacttcctatacctaacagcttgcaaaaatgttccaggttaacgagaataatctctcggagccatacctacctgcttggggtctcagtttccccaactgtctccagacaagttaggctagaaggcccctgagcctcagcccctctatacccctcctgtcacccagacctgatctggggcttgcaccctgggtgcagcatgacaggggtgggcaggggctggctctgggccagaggaccctttctgatggacttcagctgttggccttccaggggagactgatcaacctcacaagagtcatacggtgagtagcggtgggcaaatccatccccctcatcttagatttatggggagacagagagaaagaggagacactccaggaagacctgcaggtgggagtaccaggttgaaaccaaggacaccttcctggaggagctgctgtttgagccagctctgagaacaggtggggacaggactggagaggagaagggtgtcccctatgagcaaagactggccaccacccaatctaacacccccacagggcccctgtggcatccctgtccagtccctgtcaccacccagtttttccctctggacccaggaattcaaagtaagcaaggaggtccgctgctccagttggctgcatataattacaaccttgagcccaagcagcactttgggtcctggtttgggaccatgaagcggctcggtgagactgagaggtaaggccagggcaggaattgggatagtgggattgaactctccctgggggccagcctcagaaagcctgtggccatggcctcttggtcaacatcagatcctgtggtctggcaatgcctggggtacccagacctcactctggacaggccctgggagggggccctggtgagattcctggcagcctcacagccactcttctgtccatagctacaacatgtcatgccagctggaggctccatcccagttggctgggagcacaaaggccaggaagatagacatcacccaccacaggagccagtcgggtcctgaaccagggcgggcagaggttggctgccttgggatatgggtgggctcagggagtcagacagcaagggactagcctcccatcctactgctgaccagccctgtgactggggagagtcaccttacttctctgggcctcagtttccccctctgtggagtgacactaaatgatctctctggagactgggatcaatagggcactggtgattgaccaggcactcagcacatgcctggagcacacggtgcagggctgtggtggggaggtggcctgagttcctggggagtcacccatgtgtgcctgccgttctgaccagccaccaggcactcagggcagagcccactaccagcagcagctcacaccccgataccagctcagaggcggcccctagctcagcagcagggacatcacggacactttaagctgctactagggtggcttctccagctcccacgtggagaggggtcccagctgagtcccactcacgtggagtctcatgcccatgaaactgccattcaccactggccaggctcatgaggccgcatgaaacgggggtcactgggcaggagatatcgggggaacagagagggtggttgaatttttgtataataggcagtgcaagtgtttaccgtttgggaggggaaaggtttgttattattagcaatgttacacttgaatattatactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagccgagcctgctcctcagagctgccgggactgcgagaattggcatgttcacagggcactgtcacagcctctgaaacatgctgtctttaaagacgtttgcaggctgcatgcggtggctcactcctgtaatcccagcactttgggaggcagaagcggggggctcacttgaggtcaggagttcgagaccaacatggccaacatggcaaaaccccatctctactaaaaatacaaaaaattagccaggtgtggtggcaggtgcctgtaattccagctacttgggaggctgaggtaggagaactgcttgaacccaggaggcggaggttgcaatgagcagagatcacaccactgcactccagtctgggcaacaagagcaaaacttcatctcaaaaaaaaaaaaaaaaaaacacaaagacatttgcaaggaccatgtcctcacccagaatggtgcctgcctttctacagtttttcaggaagaggaaacattttctgcttctctcgctgaggttttttttaaccacccattaggaacctatagatttcaggatcgaacactgggattccctcagcactaaaggaggaaaattgcaaacagagctgaaagtgcaatgtgcaaaggtgaggctaaggaaggttcttagccagtagaccaagggcaggaaggacactgcctcctcagtctcccactagggaacttgtgattcgtctcccctgacctcagaattccttgtcatgtttgttttgtctccaagggaagggtttgaattacagaatttaaggctagagtgagcctcgtgcagttaacattaaccctctctctccttcgctggccgaggtgaagtccgggaacatgtagttctgacgtccactctctcgggggatcaccagttcacccatctcacctggcaagctgggccctagtttggcgacaggcatcttccacccacctgggaggcagggttcaacactccgcctctgaccttgtttccttcttctgccatctgcttaggcagccagaaggggttgtccagccagcacctgggctttggcgctcctcaagtaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatctccctagacttgcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggacggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaatgaccagatgaaaatcatccttatgccagaaagacttgtttttttttttttcattactagaaatgaaacagtaagtatttgttgtattgacatacttaggcttagacctatgtttaacatgaaagcctaataatagcactgtggttagactgcagcctatttttccaaaccatcattttattattaaggaaacgaaggatcaaatacctttcattcatctgatatgatcctttaaaacacattccactaataagtcccatttggaacagctgaaaatcttttaataaaactttttaaagatgagctcatggcttagtgtaaatttcacaagcttaattaggtcaaatggaaggaactcagatgagtagttgcccaatcagagcccatttgtaagtcatcagacccctccatgaccttaaaactccactctgacttaattattgcaaacctatatacaacaaagtgaaaggattaattttcattcatcaacctctcaatcccagattttcaaagaaaaaacctatgtaaggaatacttaccaaaaccacacaggaaaattggagcctgcatactttagagtcaaatttgttccactacagccaggtcgcatacaattacatcatttggttcttcatacactctagaactgactaggacagagtttagcatagaaaaactgtaagaaatcggttctgaaacatagaaattgcaaagttcaaaaggctatgaaaaaaactaatgtaaatgagagactcccctccttttgttttaaagaaatagacccatcagagaaatgcaaatcaaaaccacaatgagataccatctcacaccagttagagtggtgatcattaaaaagtcaggaaacaacaggtgctggagaggatgtggagaaataggaacactttcacactgttggtgggactgtaaactagttcaaccactgtggaagacagtgtggccattcctcagggatctagaactagaaataccatttgacccagccatcccactactgggtatatacccaaaggattataaattgtgctgctataaagacacatgcacacgtatgtttattgcggcactattcacaatagcaaagacttggaaccaacccaaatgtccaacaatgatagactggatgaagaaaatgtggcacatatacaccatggaatactatgcatccataaaaaatgatgagttcatgtcctttgtagggacacagatgaagctggaaaccatcattctcagcaaactatcgcaaggacaaaaaaccaaacaccgcatgttctcactcataggtgggaattgaacaatgagaacacttggacacaggaaggggaacatcacacaccagggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataattaaaaaataaaaaaagaaagaaatagatgttctgtaaaaatatacacaatttttacagacaaatacatttataagttgtttttgtcttaaaaattggggatatttcatatttataactaattattgaaccttaagttttcttggccatttctaggctaataaactaagaatcatgtaaactaagccaaagtagaatagacataaaagtcctgaacacttcaacttctatccttcaagaagtatacctcgcaaagctcatttgagagaggaaaatctttcctccaccctctgttttacagcgctgaggcttctcatcacatttctatgacttgtagcttaaatccatgttacatggtcactggcattgttagtgcttctcttttaacactgtaggagataatcaatttggtgatgtatttaattctatcactagaggattgtaaaattacatatattaatacctcactttagaggccacttaatttttttccaaggggatatttgactatatttcacttgtgtcttatttaatgattttataatttaaaccctaaattataaatctagaatttagaaagtatatttccccactggattacatttttggaaatattattttatatgtgcacaaatattacaaaatcactgtagacacctgaaaactatattatcttttaaaggcaatatttacattaaactggtataacaaaattgtttggtgcattttttccagtacattttgtatatattatgtttaacctttttttattcagcaaataatttttgagtatctactaagtgctaggttctgcattactaactgaatttaaagagtgaaataacagacatggtctcagacaataaaaattaacattaggtcacctatttatatatttttaaatggtaattatgaaaactttttgagatttttaactagataacattataataatacacttgatgttgttaatatttgccagtgagcaaaaaagaaaataaaaagatggttttattcaatatacactttaaaattgcagaaaatagtcaagtttctctgctttgcagttgaatgtctatgtgtttttctctgcaacttggcttttgtggagtgaaacaattattcttccagcccaataaaagcagaagagtaacaataaatctgatattttaaatgcttatcaaaagatagtagacatattatttcagaatactgagttcaataagttgacctacaaaaaaagccaaactgacagtattactgaataaggaaaggcccaaagagacaaaatattttttattttgtaacctcggtatgacacaacttaccctaactataaagaccctaaatgaccaagatgggtgcttataatatggagagtaaaaaagtcatttcacttttagcttttttatttctctcagaataaaaagtgtataaggagttgataaagaagttgatactataagttagtactacaatgacagcacttttcaagaaaagacttttttctctcttacaaatatcatgttagcagtatttgttttctccagaaataatgaggaaataaaaacataagtatgtgggtaattagttagtttcttaaagaaatgagttatgcaacaggctaataatgtatacttcactggcttttgaatgccaacaatcatattctttataaagcacagagaagatttttctaaagaataagtatgtgaacctgaaaagtaatcaccacttggtagtgacaatatggatagggtgaagggtgtcatcaagaagcaatgaaaagatacatttgcagttaaatttgaaaaccatgatgtttaatacatatagtaataaagaatactttctcctgtttcaaaatcattttagaatttaagatagaagctaaaatacctagggataatgatatgactatcaaaaattaaaaattaaaggacattttgagtattataagttaagaatgagaacttattacccaatgaacaggggataattcattatgctccatatccattgaattaaaagacaggcccattacgtggataatttgaaagtttaattttatttaaaagtcttgtttcattcatcaagcaaaatgattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtacattgcaagagaataattattttctttattaaaaaagaaatactggatgctaagtccaaaagacataaattattttatactaataactactaacattttattcatgaaaatataaaggtcaaagattttaaaatgatctttaaatgattaataacatgttgatctttttcttctttctgtaaacctttttgagtcttaaaaatactaaactatacaagcaatattaaatggtatataaacttggattaaaatattcaaatttactagaatgtagacattggaaagaatgaaaataaacagaagcataaagcagcagctataaaattaagaaagcaactaagagtgtttaaagtacatattcatctgtagtctaatgtctaccataaaaaatgactcttctcagtaaaacacaaattgttcatgaagggaaaaagcatgttgtattagagaatattcaacataatttctttagtactaacttgtgcctggagtattattggtttttctattatgaacttatgcacttgataatttttttcataaaaattgtatgtacaactctgactgtactaaaaatacaaaaattagccaggcatggtggtatgcacctgtagtcctagctacctggagggctgagacaggagaatcgcttgaacctgggaggtggaggtcgcagtgaaccgagatcatgccacctcactccagcatcagtaacagaatgagattccatctcaaaaaaagaaaagagtgtaatatcggtatacacaggtaatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtaccatataatttacaagtgttatctcatttattgtaggtaaaatgtaatttcgaactctgggagtataaatgaattagatagaataaaattctatttaaatggccatcagtaaatcggtatctaggaacagggtgatacagtgcccaagttttctattcttactaaatgttgtgtttcattttcaatgttttcttggatattgctcttttttggtgattttgattttttttattttagaaaactaataaattgactcttcttggtactgactcgggttttatagaagaagaagtaattaaattctgtacatttacctttacctcattttttgtcttttaaatttattttaattgacatataataaatgtacatgttatggggtacagcgtgatattttgatatatttatgcaatgtgtaaagatcaagtcagagtcattatcatatccattacctaaatcatgtattacttctttgcagtgagaatattcaaaatcttttattttagttatttgaaaacacacaataaattcccgttaactacagtcacccaacagtgctgtagagaactagaacttcttccttctctctagctgtaattttgtatgtattaaccacagttttcttatactcttctttctcctactctttccaggatatggtaaccaaaactctactatctacttctatgagattaaaaattttagcttccatacataagtgagaacatgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtgctgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaaggacataaaggacaaatctacaactaagatcatactgagtgtggaaaaggtgaaagattttactgtgaacaagaaaaagattttactggaacaagaaaaggatgcctattctcaccaatcatatttcacatagtgaaagtcttaaccaggacaattaggtgagagaaagaaataaaggacatctgaattggaaaggagacagtcaaattgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagattttgacaacaaaaatgacaggtattaatgaaagaaattaaagaaaacacaaaaaaggaaagacatccatgtttacagattgaaataactaatattcttaaaatgacccactatcctatgtgatttacaaatttggtacaatcactagcttgtatttttaaaagcacctttgctgcatattcttaagacattcaacaatgcctggatttaagtttgaggtattattatatctattttatactgggcacaatataatgttatcagaggtaacggttttgattggtcctaggtcatacagtaatatatacattgtgatttatagacatgctatcttttaatactcaggcatttagaaagttcatttagaaaaagttataaaaacttgccttcctttctgactatatcacctaaaaatcctaatttaagaggtaataacattttttatttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattatgacaaccagcatgaaataactgtcatcacagaagcatggtatattcgattccaaaacatattctttgtaagttttaatatatttatgtattatttatacttagattgtaacccataatgttacaatttatgttacaatattgtttttccttcaactcttaagaatattcttaaataataaaattaaaattaatgaattataatttttgttgcttgggaaaaagagtagacacacacgtgacagtgcatcacttcaccccatcatttcatctcatcatttcatctcatttcatctcatcattttatcccatcatttcatctcattccatctcacctcatcattttatatcatctcatcatttcatctcaccatttcatcaaatctcatctcatctcatttccatttcattttcattatttcatttcactatttcatttcatctaatttcatttatttcattttgtcatttcatataatctcatttcgtttcatctcatatttttgatatcatttttcatatcatttttcatctcatttcatctcaattcatttcatctcatcatttcatctcctcatctcatcatttcctcctttcattacatttcatctcatttcttctcatctcatttcaatttcatttcattatttcatctcatttcattatttcacctaatttcattatttcatctcatctcatctcaattcatctcatctcatttcatctcatcatttcatctcatcatttctcatctcatcatttttcatctcatcattgaatctcatttcatttcatttcatcatttcagctcatcatttcatgtcacatctattcatttcatcatttcatttcaacatttcatctcatcatttcatctcatctttcaatttcatttcaatatcatcatttcatcatttcatttcatctcatttcattatttcattatttcatttcatttcaaattcatctcatcatttcatctcatctcatcatttttcatctcatcatttcatctcatcatttttcatctcatcatttttcatctcatcatctcatctcatcatttcatctcatttcttctcatttcatctcattttatctcatttcatctcatctcatttcaatttcattatttcatttcatttcactacatttcatctcatcattttatctcatctcatttcatctcatcatttcttctcgtctcatctcatcatttcatcatttcatctcgtttcatctcatttcatctcatctcatctcatctcatcatttcatctcatcctttcatttcatctcatcgtttcatctcatttcatctcatctcacctcagcatttcatcatttcatctcatcatttcttatttcatctcattttatctcatttcatctcatatctcaattcaatttcctttcattatttcatctcattcatctcatttcattacatctcatcatttcctctcatcattacatctcatctcatctcatcatttcatcatttcatctcatcattgcatctcatcatttcatctcatttcatctcatcattcatctcatcatttcatctcatctcatcatttccatttcattatttcatcatttaatttcatcatctcatttaatttcacctcatttcatttcattttttcatttcattatgtcatttcatttcatctcattacatttcatctaatttcatttcatctcatttcatctcatcatttcatttcatctcatcatttcatctcatcttttcatctcatcatttcatctcatcatctcatcaactattttcaacttatctcatcatttcatcatttcatctcatcatttcatctcatctcgtatcttctcatctcatttcaatttcatttcattatttcatttcattattgcatgtcatctcatctcatcatttcatctcatcacatctcatcattttatcattttatttcatcatctcatcttatcatttcatctcatctcatttcaattttatttatttatttcaatttcatttcattatttcatttcatttcatctcatcagttcatctcatcatttcatctcatcatctcatctcatctcatcatttcatctcatcattcatctcatcatttcatatcattttatctcatctcatcatttcatctcatttcatctcatctcatttcatcattacatctcatttcatctcattttatgtcatcatttcatgtcatcatttcatcacatctcatctcatcatttcatcatttcatctcatttcaactcattgcatctcatctcatcatctccatttcattattccatttcatcatttcatttaattatgtcatttcatctcatcatatttcatctcatttcatctcatctcatcatttcatttcatctcatcatttcatctcattttatctcatctcatcatttcatcatttcatctcatcatttcttctcatctcatcatttccatttcattttcattatttcatcgtttcattatttcatttcatctcatttcattatttcgtttcattatgtcattacatttcatctcatttcatctcatcatttcatccatcatttcatttcatttcatcatttcatctcatgatttcatcttatctcatcatctcatttcatctcattatttcatctcatttcatctcatctcatttcatcatttcatttcatcattacatctcatcatttcaactcatcttatttcaatttcattacatttcataatttcctttcattatttcatttcatttcatctcatttcattatttcatttcattatttcatttcatttcatctcatttttcatctcatcatttttcatctcatttcatctcatcattcatctcatttcatctcatcattttatctcattatttcatctcatctcatctcatttcaatttcattatttcatatcatttcattatttcatttcatttcatctcatcatttcatctcatttcatctcatcatttcatctatcatctcatcatttcatctcatttcatctcatctcatctcctttcaatttcttttcaactttgtcatttcgtctcatcatttcatctcatcatttctactcaccatttcatctcaaaatttcatctcatcatctcatctcatctcatcactttgtcatttcatctcatctcaagtcatcttatcatttcatctaagtgaaatgatggaatcatgaaatgaaatggataggatgccctcagtgatgttaaatttaaaaattgtttcttttcatgtatgcatttttatatttatatgtatttatatttatatttacttatatttctttttacttatttttatttatgtttttacttatttctttatttatagacaaggtcctgttctgtggcctaggctggaatgcagtggtgcattcacagttcactgcagcctcaagcaaacctcccaccttagcctcccaggtagctgggaccccaggtgggcaccaccacacctggttaatattttattatttgtagagatggagtcttgctattctgcccaggctggtctcaaactcctgggctcaagcaatcctcctgcattggcaacccaaaatgctgggatgacagatgtgagccacagtgcccaacctatttatttatttatttatttatttatttatttaatgaggacaaggtctcactatgttgcccaggctggtcaactcctggactcaaatgattctccaaacttggcctctcaaaatgttgggattacaggtatgagccaccatgcctggcctaaaaatagtattatatttttgtatcatataattttcaattaggtaatatgaatattctgtacaggaaatacgcccttaattacataggaataaacatttgttacactgagaaaaatctaatagagctaaaaataaaaattaatttggaaaggtcattagatactcatacattcttacgtttatacattctttcatatattcatatattcttttaacagtatcaatggtttggagttatgtgtacaaaaccatgacctatatgtaatacaactaataacaagcacttacaattcaaggcatattatatacaaagctttaacttcctatcaaaatattttggtttttttctttctgttttggcagatactatgaacacaacattcaactcacagacactatggagcccttactaagcataaagtactgtgaaaggccagggctaggagagaactgagacagggccagggataggacagaactggggcagggtcatggccagagaaaaaccaggggcagggtcatagccagggacatgagaggaccaaggccagggccagaagcagggcagaaccagggccagggcagggacatggcagggccagggccatggcaggatcagggtcagcagaaggccagggcagggctagggtagcacagggccaaggcaggacagggtcagtgtagagcaagaatgggccagagtatggcagggcagggacagggaggtccagggccagagtcaggtccaggacatggacagggcagggccagaaacatggcaggacaagaaaggggacagggcaagggcaaggccagagaaggaccatggaaaaaacacggccagggagggtccagggtaagggcaaggccagggcagaaccagagccagagcaggccaaaggcagggccagggcagggcaaagccagggtaggccagggccagtgtagggtgagggtagggccagggcgagttcagggccagggcaggactaagatagcacagggccaaggcagggccagggcagggccaaaaggaggggccagggccaagcatagccagtgtcagacctggggattgtcagggccagggtcagggtcaaggctgggccagggacagggccagagcaaggacagggccagggagaaggcagaaccagagaggatccagagcaaggccagggtcagggcagaaccaggaccaggataaggcaaagccaaggccagggcagggcaaggccagggagaaggcagggccggggcaaggcagtaccagggcagggcaggaccagtgcagggccaatgcagggtgagggcaaggccagggcatggaagggcagggcaggaccaaggaagggccaggagagggccacggcagggtcacggccagaacaagggtatggctggggtcaggaatatggtaggatgagggctgggcccaggctgggacatgcagggcagagcatggcctgtgcaaggcatggccagagccaggccatagatatgggagggcaacaccaaggcagagtcagggtagatccagggctgagcagagtcagggcaggtccagagtcgaggcagagctagggcccaagcagggccatggtagcaccagggcagacgagggcagggcaatggaggactgtgccatggcagtgcctggtcaactccggggcagggccagaagcaggacagggacagggccaatgctcaggccagggacagggcatgacaggtcgtgccagagcagggctgggccaacgttggggcagggcaaatcagaccaggacacctccaagtccagctctggccctgccttggccctggccccttcctggcctgaccttgtccctggccctgccctatccatgccctgtgtgtttgaccagtgttttataaccagaatcctacaagaaacttaaattagttctttttgtgcatttttagtagagatggggtttcacaatgttgcccaggctggttccaaactcctgagctcaagccatctgcctgccttggcctcccaaagtgttgggattacaggagtaatctggccaagtatttaacttctttatgcctgtttcctatatttggaaaatggggatgctttaagtacctagcacatagaattattgtgagaatcaatgcctcacatatttacatattgataaaattatattatattcatagaacactactggaagcaaagatagtattagttaaaatttagtgattactgcaaatattattactattacaaacaatatagtatagacattactactaatatagttatcttaaaaatctaaaataaaaattttatgtaatagcctaatgcaatctctcctgctctgccctggttcagccctagtgccggctctgccgctagtcctactacatccctggccctgatccttccctggtccagccgctgccctggcccttcccatcttcaggccttaccatggccctaccctggtcctgaccctgccctggtctggtcctgaccctggccctaccccagagaaggggtatggcagagccagggaagggccggggcaaataagggacaggacacatccaaatccaggaaagggccagggccatgacagagccagggcgagtccttggcagggccaggttccaggccagggccaggaaagggtcatgacagggtcactgtatggccaaggtccaggccaaagccaaggcagtggcagggtcaggtctgcataagggcaggacgagagcaagtgatatggcagggccagggccagggctgtgccaggacagaacaagagcagagcagggcaggaccagagccaggccacagagagagtagggcaaatgccaaggcaaggccagggtagtgccaggtctgaggcgaggtcagggaaggtccagggctgagtcaaggctagaaccaagacggggcaaaggccggggcagatctagggcacaagcggggcagatctagggcacaagcatggcaggctagggcagggcaatggcaagaccaggtcatggcagggccagcccaggatagaacagggcacaggcagggcagggccagggccatggctggggcaggacaaggaccaggaccggggtccaggccagggcaagggtatggccagggcagaggtagggccagagccagggtctgggcaggaccaaggcaggtctattgcagggccagggttcagaccagggccagagcagggctgggacagggccagggccagaaccaggaaagggcaatgtcagaacaagggccatggcaggaccagcaatggggctggggccaggacagggacagggacagggtcagggatagggccagaatagcatgccaaggtagagccaggccaaattagggccaggacagggtcaggaccagggctggaccagggtatggccttaagtagcgaacggccagggccagggtccatgccagtgccagcgccggtccagggcagaggcagggccatggccaggtcaaggacaaggctggggcagggccaaggtctgggtcagggtaagcacaagaccaggacagagccaggggagggacagggccatggtagggccaggttaaatcagggacaagacacctgcaaatccacttcagggccaggtcagggcagggccagttcagggccagggccaagacagggccagggtcatggctgccagggtcattggcagggccagggccatggcaggaccagggtcaggagcaggggtcaatgccaggccaaggccacacataggaccaggtctgtgctagggccagtgtgagggccaaggcagggtcagggcagggacaaagggagggcagggccagggcagggtggagcaggcccagggttgcacagggttaaggtagggcatgaccaaccagggcaggtctatggctggggccggggcagggccagagccagggcagggccaagacagtggcagctccagggcagggccagggttaggaccacggacatgtccaaggccagtgccagggcaagggcaagggcaggggcagggccaggttcatctaagaaccagggacaaagccaggcccagagctgggccaggacaggtacctggcagggctagggtctgggacagggccatggcagggccagggccacaaccaggtctgtgctatggccaggtccaacacagtgcccaggtaaggctagggtgaatgccaaggtagggccagggcagggtcaaagctaggctagggccaaggcagggccagggccggcaaggcagggccaggaaagcatagggccaaggcagggcagggccaggccagtgccaagacctgggcagggccagggccaggacaggtccagggcagggccatgacagggccaggggctgcgttagggcaagggcagggccagggcaaggtaagggtcagggccaaggccagggtagggacagggcaagaaatatggcaggaccaggggcaatgccacggccaaggctgggccagggctgagccagggctgagtcagggcagggcagggcagggcatggtatggccagtacaggacaggacaagagctggtccacacagagagcagagctgatgccaaagaagagccaggctagtgccgaggctgaggcagtgtcagagcatgtccagggcagggccagggccagggccagaaccgagccagggcacagccaaggcagggtagggcagggaaatagcatggccaggtcagtactgggacagggcagagcagggcaaggcgatggtagtggcagggcagggacaggccaatgcagagccatgttacgccggggccagaacacctccaagttcacttcagggccagggctatggcaggacaaagaccagggccaggatcagggccaggtctgtgctagggccagctccagagcagggtctagcgaagactagggtgagggccaaggtaaggccagggcagggtcaaaggcagagtagggccagggcagggtgatgacacatccagagcacagcagggcagggtaatggcaagaccaggggcagaccactgccagctcagggccagggaaaggccagtgcagagccaggaaagggtctgggtctgggtcagggccaggaacaaggcagagcagggccagggccatggcagagtcagggcaggtccttgacaggaccaggttccaggccagggccagggcagcagcaggggcagggcctggataagggcagggccagggatatggcaggaccagggctagggccagggccaggccatagtgagggcacggcaaaagccaaggcagggtcaaggcaggtccagggcaggtccagggagcggccagcaccaagcagggccaaggcacaagcagctcagggtaaggcagggcaatggcaccactgggccatgacagggcaaggtcagtgccaggagagggcagaacaggcaggcccatggtggggccagggcagggatgggccaaagcagggccaggacatatccaaggccaggtcagggccagaacaagagcaggaccatgaccattggcagggccagtgccatgacaggaccagggtcaggacaaggggcagggccagagccaaggtcaggccagtgcaggttcacggcagggccagtgccagggcaagaccagggaagggacagggtagcacagggccaagacagggtcaggatgggaccagagcaggacagggccgagagtccaggtaacagtagggcaggtacagggcaaggcagggcagtacagggccagatccacggcaggcgcagggcaaagccaggcccattgccaatgcaccagccctccctacaaggctcctaccacctggtcactgctgcagcccgtccattgctgtaagcctgaccctggctgcagccgcctgccctcctagcgtggtcgctctcctaccgctctggtgcactgcagtctccgtcactgccacccacctgtagcgaggcgagccgtggtgtcgcaggctctaggtgtctcctcctcctcctggcatggagcagctgggcgggcaaagccagaaaagcctagaggaagatgtgaggggtggaagggttagagcctcaccttgtcatgccggccactgggtggcaggggccagtttcagcaaaggcactcacacccaccctccaaagtccagcctctccttttggcccaagctggccgggaactgaggtctggggtgggtgctggagacaccacagcacgcagctccccactccacaggaaccattgggcccactggggctgcactccttggggagcaggagaagcagaaaaattcagacccagccagccctctgcacccaggtgccaattcctgttccggacgcttccacgcacagggccctgtcccccgtggtgtccccaggggtgcctggcagcctctgaggcacagacccagagtgcacaggcccaggaaccacggtgggtgtgggggctctgccatgctcaggattcccatgcaaacgctgcgtgccctgccgcattccagtatgaccaagagtgggtcgccctctggagtgtggagtcagggagaggagaaccactccttccttggatgccaactctgttgaccgccaccagcagtgcagcctgatagcaccgaactcgtcccccactccacggctagtcctgccctcaatagcaccccccacctctgtcccccaatgccgccagtagcgtatacccgatagtgccctaacctgttctcctccatgggcattgcagccccagaaagcacccataacccaccttccctgccgtgggcagtgcagccctgtacagtgctaccaactagtacccctaatgcaggcaatgacaccctggatagcgcccccaacccaccccacactgcgaaaggtgcagccctggatagcccctgtcctaccactctggtcatgctgcagtctctgtcaccgccaccaccaaccacagtgaggcaagccagtgggccgcagactctagcacccagcagccaggcatggagcagctctcgctgatggccggctcctaccactctgaccacgctgctgtctgtctctgtggccatcttctttcactacaaaggaataaaaataggtatcaataagaaaagtaattttggaaataatacaatcacatggaagttaaacactaccctcctgaataaatgactagcgggtcaatgaagatactaagacagaaattcaaaaatttcatgaaacaaagggtaatgaacacacagtataccaaaacttgttatgcagaaagcagtacaaaggcagagatttacagctataagtgcctaccatccaaacaaaagaaaaacttcaagtaaacaatacatcttaaagaactagtaaagaacaaactaaaccgaaaataagaaaataaataagatcgtagcagaaacaaaattgaaataaaaacctcacaagattaaacgaaaagttggttttctggaaagctaaacaaaattgacaaacttttaaccaggctaagtaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaacgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacaaatcctgctcaaactattttgaaaaacaggagggaatacttccaaacttattctatgagaccattattactgtgataccaaaatcagacaaaagcatcaaagaaggaaactacaggccaggatctctaatattgatgcaaaaatcctcaacaaaataccactgaatcaaattcagtaatacattaaaaagataattcatcatgatcaagtgcaatgtatccctgggatcaagggtcactcaacatacaatgtgatacatcatatcaaccaaataaacgacaaaaacagtatcatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaatggaaagcttttcctctaagatctggaacatgataaggatgccccctgtcaccactgttgtttaacatagtaccagaaatcctagctaaagcaatcagtgcagcccctgatatggcccccaacccaccctgccccctaccaccagcagtgtcacccccccccaatagcacacccaacgtaggcaaaccgccccgcctccctgcaccatgggcattacagcaccccatagcgccctcaacccgaaaccgccacaccaccccccacagccgcacagtgcagccctggatagcacacttagcccacctcactgttgccagcaatacagtctgggatagtgcccccaaccggctccccgccaaaggcagtgcagccccggtttgggcccccaaaccaccccccggtgcaggcagcacagccccagatagcacacccaaccagccacccaagacgggcagtgacgcctgagatagggctcccaacccgtcccaggccacccgcagtgcagcctggatagtgcacttaccccgatgcctttctacgctctggctggctgcagtgtccatcgctgccaccaaccacaaacagggctgcaaacaggaaggattttattcaccgtcgatgcggccccgagttgtcccaaagcgaggcagtgccccaaggtctgtgcagagcagaacgcagctccgccctcgcggtgccaccggcccgcccgcccgcccgggtctgtgctgaggtgaacactgctccgccttcgctgtatctccgaagtctgtgctgaggagaacgcagctccgccctcgcaaaggcacacagcgccggcgcgggcgtggcggagaggcggacagcagcggcacggcggagaggcagacagcgacggagaggcggacagcggcgcagaggcggacagcggcggcacggcggaggggcggacagcggcggagaggcggacagcggcggcgcggcggacagcggcggcgcggcggagaggcggacagcggcggagaggcggacagcggcggcgcggcggagaggcggacagcggcggagaggcggacagcggcgcagaggcggacagcggcggcacggcggaggggcggacagcggcggaggggcggacagcggcggcgcggcggagaggcggacagcggcggcgcggcggagaggcggacagcggcggagaggcgcacagtgccggcgctggcgcggagaggcgcaggcccaggctccactccccagctgtgaaagggtaagaactgagggtggctgagactcggggttgttcagggcggggtgggctctggacccagcaggcctggcacccaggtcagggctccaggggaggccaggtgggcgaaggccaagaaggggctggggctggtcaggaagggctcctggtgaccagagcactttgcgtgagccagcgtgggaggaaggtgggctggatgagccagggaggcgccgggaggggccttggcagaggcgaccccctccgtcagcccccaggccactgaaccctgggtagcgagaaccgacaggggagactgcagacagaggagtggaggctccccggctttgggggctctgagtggaagcatctagggggtccctcaagaggcccccaaacgcttccccatggtgaaaaaagaaggcgcagagaggggcacggcgccggcgccgacacagaggggcgcacagtgagatttgctgtgatttcttttattgccccaaatgtacttcatcttggtagatttctattggctttaaaaatgtgtgtgttttgctgttggggagtggggtattatacggatgtcagattttgctggttgactgttcagatcttttgtaaatccttgctccttttctgcctagtttcactctgtcacttacactagagtgcggtggcacgaacatgactcactgcagccttgacttcctagggtcaagtacttcccctggcttaacctcctgactagctggtactataggtgtgtgccgccacacctgactaaatttaaaattttttggagagatgaggccttgctatgttgcccaggctcgaactcctggcctcaagctatcctttgtctttgcctcccagagttctgggattacaggcatgagccactgtgcccggcctctgcctagttttaacagttgctaagaggaggatgttgaagtagatgtcttcttggtgggtcaatccttttgtcattaagcagttgttatggtcacttccttttcaccccattggtgaaggaggggtccctgccctaaagtgtaggagatggctgaacacgacacctggcgtggatggatgagattaacagcagtgttttagtcacatatacccacagctcagaggaggacactgcatgccacacagggtcagatgggcaccgcactctgtagcggagtgagggctgcgggctgaggaagcaggcaggcttgatagtaacaagagcacacaatgaccaatggttcccgagggggaatgcaattggcttgtttgaataaattcatgggctggcagacaggtgaagtgaaacttcttaggctgaggtgcaactgttctggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcaacgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttaaagtgtttgctctggatgttacaatatgtgtattgtaatatagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcccgtagtcccatattcatcccttctgcataagaactttctatagccattttttattttgatttttttgttttaattttttgtattgtggaaatgacagaacatatttctgtagccactttttagcatgtctaaattgaccagtgacaaattcctatattctcttcctcggagaatgtctttatttctctcttcatttctgaagggtagtttcatgggatatagaatttgcagcgaacagttttttgtttggttggtttttttgtttggttggttttttttaagcacttgaaaatgttgtgccacttccttctggcctccatggcatttgaattggtgtgtccctacaggcattctgccatttttggtctttgtttttagttttgaaagtttaatcagtgttgctttcttttggtatactttgaggtttgctcagcttcttgaatctgtaagtttatatctttcaccaaatgtgggaagcctcaggaattagttatttgcatgctttcacagctctggtctcctgtgggactcagataacataaatgcgtggtcttttgttatcgtcccacaggtccgtgcaactctgttcatttgttttcaggttattttctctctattgtttagaccgggtgaattctgttgatcaggtttcagcttctctgattctctcctctgtcgtctccacttttactcaatagagcccatccagttagatttttttaaaatttcttttactgtattttatatttctgtaatttccatttgattcttcttcagtttctttgctgacgttttcagttctttgattgttgccataggatttgtagttgcttgttgaagcatttttatactggctgttacaagtgatgagtcagatggttccaacatctgcctatgtaattttttttatttttgcaggcagtcctcctgtttaggtttagtctgtaggtcttggtctactttgtgggctgtgattgcaatggcaatttaatttcagagctttcatggtgttattttggtctgtttggcttatatgtatcactgggattctcccaccagtcccttctgttgcccacctgagggaacaggggagctgccccaggctgggccacctgctgcagctaggtgggtggggaatggtggtggtcttggtgtgtggagctggttttcttgttgtggggaagatctcctttgatctgcagggactgagtctgcctgggttgccttctattgctacgttgggagttgggaaactctgggcctgggtcaccttcctattggatgaggtccagggagacacctggctactatgcattccctagtcctagagtccctcagcagcctttttctgtccaccttttggaattctccattgatcctctcctgtctattatttctacaatttgggttacatttcttaggagggtataatgtgttatcttctctagaccagaaatccttagtggtggtttcgggttgtaactgtgctaaagggagaattggcatatttgtgatgtcgaatctttcttttcaaatgaggacgtatcattattcagtatataatatttacaacacctacttccttgggttgaagaatgtggttaaggcaaggaaagtacttaacgcagtgcctggtgtggagagcacttacgagtgttggtagtgatgctattccttttgtcctttggtagcctattaaagcttttcttcttttttaaaaaataaagttccggtgcacttcttgttaggtttattcctattttatccttttttgcttttattacaaataggagcttcctatcttttataatgtctacctggttctttggcccttatgtgaaaatgttttaatagccttctaaatattgctctcccaaatgagttttaacttgcctctttcttttgttatcctttttttgagacagggtctcactctgtcacccaggctggagttcagtgatgcaattatggctcactgcaacctctgcctcccgggcccccaaagtgctgggtttacagtgtgagccactgcacccagccttacttgtctatttcttttaagagtgggaactataattgagcccagagctccaaaaacaaatgaaggaatgaataagtgaataagctcttcccatgggtttggtgtggtttggggctctactcttaatctaaatgctatgttttatataatctaaaatttcccctaggtgtgttacatgattgtgttgtgttgaacttacattgagactccttttcacatgtactggttatcagcgtgggacttttccattcactctttgaattattcgtttgggggacacagatagacctctgtgtctttcataaagagtgtccattggccggttgcagtggctcatgcctgtaatcccagcactttgggcggctgaggagggcacatcacgaggtcaggagttcgagaccagcctggccaatatggtgaaatcccatctctactaaaaatacaaaaatgttgggaggccgaggcgggcggatcacgagttcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaatacaaaaatgagccaggcctggtggcaggtgcctataatcccagctactcgggagactgaggcagtagaattgcttgaacctgggaggcagaggttgcagtgagctgagattgtgccactgcactccagcttgagtgacatagtgagactccgtctccagaaaaaaagaaaaaaagaaacaaaagagtgtccattatctacactggaaaaattgagattgggattttgacatgaagtgcggaaatgtggattgggtccatttagtttacctaaacagatgatgaaatactaaccgttttatgaagcattccctagtgcaaagttttgcctgtgtgtctagtgacgggagcagtgagaatgaggcttggaacacggagcgcattgtgggcctgtcgtgggtggggccagcagcacatgcatgccaggctcacagagcagcctttgggtgttcttttcccagaggagctctatggtgactttgaagacttggaaacaggggacgtgcacaagggaaaatcgggccccgatactcaggtatgtctttgttgtagctggctgttcttggtcattgtgttctgagagaggcccatattgagaaatgcaaatcttacttgtgatgtgtgaagattgcagatgggatggatagattccttcctaaagggtggggatgtggagaccaaagagaagctttcttgtttacttgttaagttttggacgacagttactaccgtttcttgccatagtcatttgccaagtccactgtgatttttcactcacagaagtcttagcttctcagacttacattcaaccattgccatcattctcctctttttaaatttaagtgtcatttaaaagaatgaagtccctgttctccctaatatttctttagaacagggtctgggagcatctgggtgagggacatatctgttatttttattctagtttgtgttcccagccagcttaaggaatagcagctaattgtaatgcagatgtaacaatttcatgtagcagtaccatgttattcagagaccaaggttatgttgtgttttgttttgttttattgataacgataacagatttttgctaagatttttgtttaaatagaactttaaaaaatctaatgtttaaagaaaagaccttcataaacatacacaaaattttttcttctggaaatttaagaatgaagatatagagaaacaagaaagaaattgaccctgatgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctcttagccccttgtcaagactatcacatagtgcaggaatccctgactttctttgggtccctgcttcctatcctgcttctgtgcctttcagttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagtgatctaagacagtgtgttcatttcagtgcaagccaatgctgcctattctgatcgctgctccctgatttgaatggcaggtgatcagtggcctgtgtggcttatggacacacaagagctcccaggggaagtgctctcaaaacatcctggtcagagttcagaaggacatgtggagtataaggtcagatgcggagataagggagatggtgtggccctcctgcctgggggtgctgagcaggttgctggaggcggtgatctgactctgaaggagacagacacagaaacgtgtgtacagttgatggtgagcatctgagttgcgtcttgttagtgaggccaggagtgcctgtgtaagctggaacagattaggtgtatgatttgtgaaacggagtttcatcctaggtcttcatctagtcaaaggactgtttcctgattaggcattagcttagtggttgctagtctgtgttgacctttgaaaggcatgactaggctaactctgaagtttttgcttcacaccatttacaatttaaaattacctagagccttgtgtgccattggaaaagactgaatgtttcactctgaaatgggagtccttggagggttttgagcagaggagagacattcaggtaatcagatcactctgccaagagatcagtctggtagagatcagtccggtggcacaaaccagagggctggcagtggagatgagacaaagagtcaaacctggatagagtttatttggaagctgggtcagtaggatttcctggtggactgaatgtgggatgtgtgagaggaaatgaggatggcggctggaaattcctggaaggatgggttgttgcaggttagataggaaactgtctgcagatgcagttttgggaagatgatgtttggtttggctgggtatcatgcagacaagcggagcgtcaagtctggagagacaggtctggccagggacttagatgtacagccgtcagcatgtagatgccacttaactctgtgaggtggccagggagtgagtgcagagtgactgggaggagcaagactggcatgggcgagatggggcgattgcggctgtgaggcctgagcagtgccgaggagggagagggagaagcagtgtgagcatgcaggcacgcaggagtccagttgtacatggaggcgaagcactgttcagatcccgctgcagtgttaactacggtaaaggcagagttgaccactggaggagtccttcagcgtggaggccttcagcaatcttggcaagcaccaattttcatggatgtaggagaatgggagcagaggaactggaggctgcaactgcggaaaacttttgtggggttttgctgcagagagaagcagagaaatgaagcagtttttggtggaagaagtggaatcaaaaggttttgagataagagagagaacagagggaagagctgttggaataaaatccaggaagagtggatggtgtctagtgagcaagtgatgtgtggcccggagtaaaggcatggacaaatcatctgtgcctgagctgcccgtagaactttctgtgatcatggagatgcacgtctgtgcttcccaatattgtaacactggccgcaggttgatatggaccacttccagtgtgactagtgtgattgaggaactgcatttttaatattatgtaattgtaattaattttaatttaaatagccacacatagctcctctatgggccaggtcagagctctgataaggctggatatgggaggaaaccctggtagagggttgaccatagaggttcttttggttttggagtgaatcaggaaacagccatcagctgagtgaaggtgagggtggtggtgggtgtttgaagacaagagaaaagtgtgaaagaattgtttggagaggaaggaaagaaggtgtggactggggatgtttccaatgtttgagcacgcagggctccacagttatctacatttgctgtcccttggagcaggagagaagaaaacggttgggacatattctgagcagactgtagaggtaaaatgtgtaggttttttttgtttttttttgttttttgagatggaatctcgctctattgcccaggctggagtgcagtggcacgatcttgactcactgcaacctccgtctcccaggttcaagcgattctctcacctctgcctcctgagtagttgggactataggcaggcaccaccacacccagctgattttggtatttttagtagagacggggtttcaccatgttggcgaggctggttttaaactcctgacctcatgtgatctgcccgcctcggcctcccaaagtgctgggattacaggcatgagccactgtacccggccaaatgtgtagtatttttaataggataaagcctacataattttgtccacagttcctttatttagaaattgctcatttgttcatgttaatcctatgtttattacagataacagcatacaggttccccgccccccgccccgtcatgtacagctgaatcatgcagaatttgaagatcaagatgatgaagccagagttcagtatgagggttttcgacctgggatgtacgtccgcgttgagattgaaaatgttccctgtgaatttgtgcagaacattgacccccattaccccattatcctgggtggcttgggcaacagcgagggaaatgttggatacgtggaggtgggtccttttgctgcatatttggtgcctgaggctctgtggatttcccctccatcaatcatcttaccctctcatccccctcagatgcatctgaagaaacatcgctggtataagaaaatcctcaagtcccgagatccaatcatattttctgtagggtggaggaggtttcagaccatcccgctctattatatcgaagaccacaatggaagacaaaggcttctaaagtataccccacagcacatgcattgtggagcagccttttggggtaaaatatgattacaataacttgcctattgccgagattaaaccttacaggctgcgttattttagctttgtgcttttcctttcataaaattccactcctaagatttttctcttttctgggagcggggaggtggtttggagtatatatgtaaatctatatccaaatctaaatgtccatatccagtatgttaaactagaatctaaagtttgtggtttgctatatttctttttttccttttcctttaagaccctatcactccacagggaactggtttcttggcaatacagtctgtcagtggcataatggtaactatcttggatgatttcttttacagattggtttgagaaatatatcctgaatgtgggttattatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtatttaagcagtgctcaccatgtgctaagcactatatgaggttatgaggagccatcagagaccacccagacacaagactccctgcagctgtgctggggtagcagtctgttcactccattttcatttgaccagtcacgcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagcctttttttttctttcttttttttttttttttttgagacagagtcgcactctgtcatccaggctggagtgcagtggcacgatcttggctcgctgcaacctctgcctcctgggtttaagcggttctcctgcctcagcctcccaagtagctgggattatagatatgagccactgtgcccagcctcaagtcacccttgttagtttggcttaccaactttaaagttttggattgcttttgtcaaaccactgggttgcaagttcagatggtctctcttgtttttcttagctaattgtaagtaaaattcactttggtaatttattgtgtcacatagaattgaagtttttcttttgctaatattattcctattttcaaattttggggttcctgttagcctgattttcggatagctgccacaggagttgtccttgatctggataaatccataaaaattgtgaagaaattaaagctaactggttttccacttcatttattaaggtctgtatatctatatattctcatatttataaatctccatattgtttgagaaaaggaatgaaatacctctaaaatatgggcctcatttttagaaaagtgtttgaaatcttttataaacttcatattttgtttgctcctttatattctgtattacttaaatatgctcaaaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcggtagaaaaatcgacaaagcatttgcagacaacttggcaagggtacagagaaacggacgtactgtttttcagtatttggggagggtggtttgagcagcatttattgacaatttcattagtggggatgtttctattgaaaacacagagttaggaagtcataaaatgttcttgcaatataaggtaataataccaccagcatttatcttactgttttcatgttctaagtgcatgcatctgagtaaaaggatctgggctgcagtccagtctgagagatgccagcaaaggcttcctaggccaattcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtttttttatcttgctacacctgtagggaatgtttaattctgccttggacgtggccaaatttgaaggtgctgtgatttgaactgtcattgggataagggggcagatcaagaaagcactctgagctccagaaggagctttctgggccagctttgaggataagctgctgatgagcggtgaatgtcttaagtagtattcagggcagggtgttaccattcatgcttgacttctagccagtgtgatgagaggctggagtcaggtctccagagagttgagcagctccagccttagatctcccagtcttatgcggtgtgcccattcgcttgtgtcttcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatgttaaagtaaattacctcttttcagatattgtcttcatgcgaacttggtatcctgtttccatcccagccttctataacccagtagcatctttgttgaaaccagtgggtgagaaagacacctggtcaggaatgcggaccacgggccaactcaggctcgcccatggtgtcagactaaaggcaaacaaggactctctgtataaggtactggtcgtgtgtgtgttagtagagatgaagcctgtgctctacagacagggagtcacacagacacttttctataatttcttacgtactttgaatgttcaagtataaagtctaacgttaaatttgattgaacaattgtatatttttgggatattttggaatggaacaccaaaaaatggtaatagtggttctttctggattgaagacaaacttttcctttttaaaataaattttattttatgtatttgaggttgacaatatgatcttaaaggatacatatagatagtaaactggttactatagtgaagcaaattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctactggtcatttcctatttggcccatttttcaactgggttgtttttctgctattaagttgtaagagttctttactgatttttggatattaacactttatcagatatgtggtttgcaaatatttcttccagtctgtaggttcccctttcattttgttggttgttcctttgctgtgcagaagctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccagttttattcttttgcatgtgaaaatcctattattgaagagactatcttttttaccattgtgttgtcttgtttgcccttgtcaaaaattagttgacagtatatgtttggatttatttcaaaggtctctgttctgttccattggtctatttttttgtttttgtgccagcaccatactgttttgattactgtagctttgtaatacaattttaaatcaagaggtgtgatgcctccaactttttctttcacagtaatctgttggctgtttggggttttttgtggttccatatgagtttcaggattgttttttcttttcttttttttttttttttttgaggcaaagtctcactctgtcgcccaagctggagtgcagtggcataatctcggctcactgaaacctctgcctcctggattcaagcaattcttctgcctcagcctcccaggtagctgggactacaggcacatgccactatgcctggccagtttttgtagttttagtagagacagggtttcactatgttggccgggctggtctccaactcctgacctcgtgatccgcccgctgcggtctcccaaagtgctggaattacaggcatgagccactgtgcctggccaggattgttttattctgttctgtgaagaatgccatcagaactttgatgaggattgtgttaaatctgtatatttgctttgggtagtgtgaacattttaacaatattaagtcttctgatccataaacataggatgtcttttcatttgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctaggttatttgtatatagaaatgcaactgatttttatatgttgagtttataccttgcagcttaactgaattgatttagtagttctcacagttttttgtggaatctttggagttttttacataaaggatcttgtcatctgcaaatagagataattttacttctttaatttagttgcctttttttctcatctgattgctcttgcaagtactctattgaataaaagtgatgaggctggccatccctatcttgtactcaatcttagtggaaaagctttagttgttccccactaactatgattagactgtgggtttttcataaatggtctttattatgttgaggaactttccttctatacataaactattaagaggttttatcaagaaaggttgctaaactttgttaaatgcttttactgcatcaattgagatgaccatgtcgttttatctttcattgtgttaatgtgatatatcacattgattgatttacatattttaaaccagtcttgcatgccagggataaatcccactgaaacacgatgtataatgtttttgatgtgttgttgaattctatttgctaaaatttttttaggatatttgcatcagtttttaatttattggagaagttgacctgtagtttttctttgtttggggtgtgtgtgtgtgtgtgtgtgtgtgtgtgtgtgtgtgtgtgtgttttggtttggcttaggtattaaggtgatactggcctggtaaaatgtgtttggaattatttcctctcgctctgtttttgcgaagagtttaagaagtaaactcccaggggatgggagtgactctggacatgggagtgacatgatagtgactctggaacctgccgtggtgggacacagcagcatctcagtctctgtgaggccagatgcagcatcagcaaggaccccagaatggtggagccctactgtggcttgggcccttaggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccattttcctaggatatgggggtgccatgttggctcatccctggcaggtgtggctgctcagctcagccaagacactgattccctgtgaagcagggcagcgcttcagctctcgtgcagtggggggtgtgactgctcagactggccaaggcactgattccctggaaagcagggcaccaagtcagctcaggctccaaggggcagggcacaatggcagctgggaggggaggggcacagcagcgtggccccacaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcgtacacctgtttcgccttccactttccccatgagatgaagcagcccaagaccctcgccacttgtgctgcccgatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatacagcaacagagcctgaggttggaagaagggtgcggtggctgctccccctgggtgggacatgctcccgaagtggtccaggtccaggagggcacgttgcagcagcagctggtccatgggggtggggcacaatgtcagttccttctctgaggggagtgctggggctactgggcccctcttgcttccttttccctgcagggagatatcccctctgcttcaggctgatccctctgggggagtgggtggtgggggccagatgtttccttccctcctttatgtgactgtcttggttttctgtgctctactggatttctgctactccttgatgcactctggggctctcttttagtgactttcatcaaaatatagttgtttgctgctttgggtgtctttgtcaggggatgagtgcaaggggctattgatcagccccttgctggcgtcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtacatacagaagagtgcccgaatcataagtgtgcatctagatggactgtagcacaccaggctgccacgccctggaccaagcagtagccttgacctgtggcctctcccaggcactgctgccccaacacacaaaatagctactttcccagttcctgatgtagatttgttctgcctggttttgatttctataaaatacagcacattctatttagcctggcttatttggttcagtattacagaacacatccatgttcttgtctgtggtagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcaaacgtgcttctgctggaggatccctgggtggggtggagactccagggcacctgtgctctgcttcagtgtggaggcttctgtgtcgtgttctgggagcacagtgtcttggcctccaccaccagcagcagcttaaagagttcctgctgttccacatgcttgccaacaattggcctcttcagtttttgtttttgtttttttttaggttttcagtgcctgcctggacttctgttttcatttagattttggtttcttagaactttcgttattctcttcacagcttaacaatgcatttgaatagatttgttttcatgtggagtattcagttttgtaataagagggttgttcaaggcatcagtctgccactctgctggaaatagaagtctcccaggcatttctttttaaagtagttagtgaaattttgaaccatcttacatgaatttttattaaaatacacttcaggatgtggtgcccattatccattctactcttttgtaacaagtagatttctctgcattcttgaatttgaaaacaactggggttcctaaacagagaatatggaatattattggggatgatgtctttaataatacatttcaagataggagaaaccttttctatatagttgactttaataaaagcctagggcaaaactttcaatatattaacagtatttatgaggcagttaagaatttgggtcatctccgtctccactaaaaatacaaaaagttagccaggtgtggtggtgggcgcctgggctacttgggaggctgaggcaggagaatggtgtgaacccgggaggcggaggttgcagtgagccgagatcatgccactgcactttagcctgggcgacagagcgagaccctgtatcaaaaaaaaaaaaaaaagaatttgggtcatctcaattaaacatagaatttaagattacgttgaaaattcagtacagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccgggcatggtggctcatgcctgtaatcctagcactttgggaggccaaggcaggtggatcacctgaggtcaggagttcaagaccagcatgaccaacatggtgaaaccccatctctactgaaaatacaaaaattagccgggcgtggtggtgtgtgcctgtagtcccagttacttgggaggctgagacaggagaattgcttgaacctgggaggtggaggttgtgtgagccaagatcgcgccactgcactctagcctgggtgacagggtgagactccatctcaaaaaaaaatccagagtgtttggtagtcaagacaaaaagctagattatttttgttagtctgggaaataagcaccttagtggcccaaagacaaggcctgaaatttccatgaaaagaaactgggatctattcatctgttctgttgagacctcatagttccataccacagaaataggcacagtgggtttcggggggagagttgtaagtataagctctctgttcctctatattggccatctatagaccttctttggagaaatgtctattcaagtcctttgaatcagattttttgttgttgttgaattgtagaagtcctttttatattctggatattaaacccttatcaggtaaaccattcacacatattttctctcgttcttcggggtgtcttttcactctgatagtgtcctttgatgcgcaaaggtattttaattttggtgaagtccaatttattttttcctttgttgcctgtgcttttagtgtcatagccaagaaattaccaaattattgtttagttttttaaaagtatttatgtggttatttggctgatacctgtctctaatgattgacggcacttcttgagcgcggcttttaaacatgcaaatttgatgtcactttccgaggctccttccatggcatccctttgcttctaggccgcagcccttgtctggcctcgctgctgctctggcccctgccctcctctagggcctctcttctgctgcctccagctctggccacagtggcctttcattcctcagtgcacttgcctggggtcctcaacacttgcagttccctctgccgggaatgcggcagctcctacgtccccctcccggcctccacctcctcgctgctccttcggacgctggtcctgagaccactggtcggtgcggccttccctggaccctctccaaactccccagtactcctccacacttttctccaaaaaaccagtggcactcaattgtgccgtccagggacccctgggattttcacgaccctgtcagtggctgagtgaggttgagtcaagaatgtttcgtgacaataaggagatgttattgatctcttttcactggaagtgggagcgtcttgcggggggacagcgggctgaggatgcagctgtgttaggacgtgacagctcgcacaactgaagcaccaccactttcccacggtttttttttttttttttttttgctttggaaaacatttctcacaaaatatgcaacttatgttaccatgtaatgggcttgcttctgttactttaaaacaaactaataaatctcttaaatgtttctcagctttattttttgttgttatggttcgttttcttctgtttcccccagctttatgaaagtttaattgacaaacttgcctatctttactgctcacagcgtgctgctttgctgtatgtgtgccctgtggaatgcttcctggtgctgctgcacacctccatcacctactgcggtgagggcccctgggatctgcgctcccggcgctgcgccctcgccccaccgctgtgcctgagcgccccccccccccatcccgcccggggacccgcgcccgctcctggaaccgcacccatggccagcgccctgtccccaaccccgctttagtttccacccacgcgaagaaactcagcctcggtcctgtttaggcacggaaagggctggagaaccgcgtccttccgaggcgcccccagcgcggctccccacagcgtgcaggaccccggactgtcgcgccgcgcccggggacgcacaggaggtgggatccaggagcgaagcccctgcagcgtcccagactggacgtggccctgcacccccagctgctgggctggccgggacatgcatgagatcgcgcgctttacaaactgttgttctttctgggaaagttaaagaacgcgctgcagccgcttcgcctgctgctgaaaggagccaggcagggctggtcactccgcgccacgccccgtgcgccaacaccggaaggtgaatgttcagaacatttttatcatttaaagccagtataccggctgggcgcggtggcttacacctgtaatcccagctacttgggaggcccaggcaggaagatccgattgagcccaggagttccagagcaccctgggcaacatggcaagaccctatctctacaaaaaaaaaaaaaaaaaagccgggcgtggtggtgcgcacctgtggtcccagcaactcgggaggctgaggcgggaggatgacctgaattcagtaggtctccagcctgggcgacagagcgagaccctgtttactaataaataaagccagtgtacctaaaataccatcataacatggaatcagtataaaaatgattattgaactacttgacattcctgttttgtgctaagtctttgaaatttggtgtagtgttttgttttcttttctcttttgagacagagtttccctcttgttgcccgggctggagtgcaatggaatgatctcagctcactgaaacctcagcctcccaggttcaagcgattctcctgcctcagcctctggagtagctgggattacaggtgcccgccaccacgcccggctaatttttttgtatttttagtagagacagggtttcgtcatgttggccaggctggtctcgaacccctgacctcaggtgttccgcctacctcaacctcccaaagtgctaggaccacaggcatgagccactgtgcccggcccggtgtgtactcttataacacctctcaattcaggtctaaattttgtgggaaataatctatatttaggtttcacagtattcacagttgaaaaaatagatgtatatccccttgtttcaaatgtaactgaacctagtcccttgtttgaaattcaaattaattgaaattaaaaatttccagttctcggcagcagttgcacatttcaagggctcaatggccccatgtggcagtggtcccgtagaggacggcacagctctagacatggtgtaggaagttggagaaggcttccttagggaagcaagtgacggttgagccatgaccagaagttggttaacttggcaaaggctgggagttggggaagcagaagagtgtgtcaagcacaggaatgttatgtggaaaggcctgtgacacagggcatcatgacgcctgcaagccagcgtagctggagccaggacagcggcagagtcctaggagctggggaggaaaatagagaggcaggggatgaggccgccttaagatgctatcttcatcccaagacaccaggaagccctgagagaacatttaaccgggacagcatggtcagattttcatttttcaaaaagcccctttgctactgggtggagatagtttgcagggagttcagggggaggaggcacagagagggagaagtggtgggtgctagagctctgagaggtaacattggaggggtagtgggtctgggggttgtgaggaacaaggggttttcggggagtaccccagggcccccaggtgtctggctgggatgccaggtggagtgatgggcacctgtgggacagccaggtagagacatctgaggcggcagctggggaactgtctggaactccggttgatgtgctacctgggcttaagatgtactcccaagagttaccaacacctacacttgggagtgggtacattatccagggaggagccaagattgaacacaggtgggtttttgttcagcattttaaaaatttttaatttttttttgtagagacaaggtctcactatgttgcccaggctggcctcaagagatcctcctgccttggcctcccaaagggctgggattacaggcgtgagccaccggtcccagtctgttcagcactttttccactagcttagtatctccacacacctcaaagagatcaccaagtccaactcatacatgcaaaccagtgctcaggaagtccacatgatcctgctgtggttcatttgaccaaaaccgagtggtggagctaagcaaggctgtttcacagaagccagatatataagtggcctcaatacggagggcagtctccatctcccagtgtctctgactgctgcacgcacacttggcaacctgtgctcaggtcagggatagtctgggtgggggctccagtttctgccactcaccagtgatgtgactctgggcaatgtacaaaatctcttgggttttaagtttcttatctgtaagatggggataataaaccaatcttgcagcatgtgaggatttaatgagactacagttcccatgaaggggatggggtgccaaccttcccacacagtcaaaaatccacatataggccaggtgtggtggctcacgcttgtaatcccagcacttggggaagctgaggtgggtagatcatgaggtcaggagtttgagaccagcctgatcaacatggtgaaaccccggctctactaaaaatacaaaaattaggtgtggtggtgcgcacctgtaatcccagctactcaggaggctgaggcaggagaattgcttggacccaggaggtggaggttgcagtgagctgagatctcaccactgcactccagcctgcaggacagagcaagactctgtctcaaaaaaaaaaaaaaaaatccacatataactttcaactcaccacaacttttgttaatagcctactattggccagaagccttaccaataacataaacactcaacacatattttgcatgtgatttgtattgtatactgtattcttacaatgaagtaagctacagaaaagaaaaagtactaataaaatcataaggaagagaatgtattcactatcactaaatggaagtggatcatcataaaggttttcatccatatcgtcttcacattgagtaggctgaagaagagaagaggttggtcctgtcatctcagggatggcagaggcagaaaaggtcagggagatgggaaggaagtcaggagatgcacacacactgagaaattcatcgttatttctgtctgacatttttgctttttcatttctctaaatatgtttctttatgttaccaatccttcttccaccatttgctttagttttggtgtccgtaccatagaaaggtccatgtggtagaagtcacaagtagtcttgaataatcagaactcctctgccagattgtcgaatgtcaacttattttctggcactgcatctacatcctcttcctcatcatctggcactgattcgaaaacactcatctccatcaagtggtcttctgttaattcctctggtgtgatgtctcttcactcttgaatttctccaagatccatatcctgaaagcctacattccccaccttttttgccacaggcacactctctttcatgatttccttgattggccctgttgtaaatcgggaccagttttctccagtaggaaggctgggcactgagagccttcgaaccttctgcttcaccttttgacatatagggcccaattttaatgcatttaaatgttgcctccactccaaaatgaatatgggacgtatgtaatgtgtgaaataggtgtgtctcacccccttcatgaatattaatagagccttctataatctgttgaatatgtacgtttagccaaccctttcagcataacttcctgtctcatctttccctggaagtgcctgcttttggtctttgctggaggctacacttcccagcctgtcaagatggccagcctgcaggctgcaacctttctaagaaataaagcttttgggctggcccagtggctcacgcctgtaatcccagcactttgagaggctgagttgggtggatcacttgagaccaggagtttgagcccagcctggccaacatggcgaaaccccatctctacctagaaaaaaatacaaaaattaaccagatgtagtggcatgtgcctgtcttcccagctaatcgggtggctgaggcaggagaattgcttgaacctgagaggcaaaggttgcagtgaactgagatcgcaccactgcactccagcctggatgatagagctagactctgtcagacaaaaaaaaaaaagaaagaaaataaggctcttggcctggcacagcggctcatgcctgtaatctcagcactttagaaggtcgaggtgggaggattgcttgagttcaagagttcgagaccagctgggcaagatagtgggacccctgtctctacaaaaacaagtttgaaaattagccaggcatggtggcacacacctgtagttccagctacttgggaggctgaggtgggagattgcctgagcccaggaggttgaggctgcagttagtcatgattgtgccactgtactttagcctctccaaatttgtagatctcataattttaagtcaccaacctccaccagtctcattttaggttgtcatataatgacatcagtttttcttgaatcatattagagtctatagatatgcttttcttgtagatatccttcacccagataaaagctgcgttttctctatttctctgtccttccttccttctttcatctttttttttttcaccctgacagagcctcgcttccaggctggagtgcagttgtgtgatcttggcttactgcagcctccacctcttgggctcaagtgatcctcctgcctcggtctcccaaagtactgggattaaaggcatgagctactacatccagccaaaagctacattttcaagactagataaaaaggtatttggcaaaaagagcaaagtttcatgtctgctagcatggctgcagtgatgacactgcgaatttccttttcttattttacagcggttcttaggctggattaatttatcttgaaatggtgggcaaccacagctgcagacctcagtctacagtacatatcaatcaatccatctttttcttgtactgtcttttctctgcttcttggcagcacttccagcatcactagtggcatttcgtacatgtcttcttcaggtttattgtattgcactaaacatgaaaaatacatgagaaccacaagagattacttttcactgtgatacacaatctacaggagagacaagtgctcacgtggagatggctagtgtcacatggcattttaagtggacactggacacctgagctcactgcaatagtagcaggaggggtgacagaattattacagtagtacagtgggctcccattaatttatgcaattatgacttaatactgcatctttacatttgtttacatttctcttgactggcaccatgtactgtgtttgtgtgcataacttttgataaattttaactgtttataattgatatatgtatgtttataaatgatatatgtatgttttatggtggtaaatgataaaaatatgctagtattttatgcattcatgacatacctttttcttaactttttcaatatttctaggctacaaggttcatctgcaagtttcttcaaatggttgcaatgcttagtgcaacctccatctcctaggctccagtgatcctcctgcctcagcctcccaaagtgctgggattacaagcatgagctactacatctgtccaaaagctgcatttccaagaccaggtaaaaaggcatttggccaaaagagcaaggtttcacatctgctggcatggctgatgtgaaattttccaatacatttttccaatatatttattgaaaaaaaaagtggaccaggtgtggtggttcatgcctgtgatcccagcaatttgggaggccaaggttgggagggttacttgagtcctggagttcaagaccagtctgagcaacatagcaagaccccgtgtgtgttgtttttttttttttttttttttgagacggaatttcgctcttgttgctcagactggagttcagtggcatgatctcggctcactgcaacctccacctcctgggttcaagtgattctcctgcctcagccttctgagtagctgggaccacaggtgcatgccaccacacccagattttttttttttttgtatttttagtagagatgaggtttcactatgttggccaagatgttctcaatctcctgacctcgtgatctgcccatcttggcctcccaaagtgctgggattacaggcatgagccattacgcctggccaaccccatgtctatttaagaagatttaatttaaaaaagaaatttttttaagaaaaaatctgtatgtaggtggacccatgtagttcagacttgtgttgttcaagggtcacaactgtacctgtggtgactgatacgaaacagatgaccaaaaaatgatagttttatttccccatctggtcccatttaaaagaggtgtttaggtctgagaattttcacacgtacaaggttccacagtcaggatgccgaggaatggcacccctcttgctggagtccagccctccccacccaaccctgctgactgctgatttgccttctatccctgtcacgccattgtctcaggaaggtcatgtgagtggagatatgcagcatgggctctttgtaactggctgctttcgctaagcatcatgtttttgagatccaccccaatgctctgtgtgtcagtgacatgttcctttcaattgtggaatggtgttagcctacacagggagacacaggtggttacctcttcagccatgggaggacgtgtggttgtgtccagatttaggcgattatgcatagagttgccataaacatttctgcagaggttttcatgtgaacacaaattttccttactccaggaaaattcgttatgggactgctgggccatgtggtttaacagaactgtcaaactgctttccagtggcacctcactatggttttgatttgcatttccctagtgattagtgtcgatggtctctcataggctttctgtcttccacatagagcgtcctcttcagtgagggtccaagtcttttacccacttttgtttggatggttttctaacttgattttaagagttctttatatatgtcagactactttcttcgttggatatgtggtttgtagatattctctcccagcctatagctgtcttttcagtgtcttttaatagtgtcttttgcaaagctatattttttattttgatcaagtctaattgacggatttttgtttttacatgcatttggcatcatgtctaagaacaatttccctaacctcaattaatgaagatttcttcctatgttttcttccaaaactttaaacactctctctctctatctctctcagcaaataaggaggaaagtttcatgacaattgcagtcctggtttctgtagctggtcacatggtcctataactaccttcttgcactccccagtctgtattccctttgccttcaggaagcctccactggttgtggtttttaacctggtgggggaaccttcattcctgaaggttctggaccattattaatcctgccgagattgggctgttgtgcttttccattgatcttaatcacagcgcatgccacgagggccctcctgtaccccagacatgctcttcctcagtccattgtgaagcagcagggcagtttctccttggtgatctggaccagccacccccaccagcgtagttaactccttctttacctgttgatccagaggcatgaggagcttggtgccaccagatggcagcctaaacttccagcgcaatggatcatccctctgtcttttggcggcagcattcctccctctggaactaagacctctaggccagcagagcataaggtggtggggacaaggagcaaaacttttgctagtgggtcactaggggtgatggggtttcaccctgttggccaggctggtctcaaactcctgatctcaaatgatccactcgcctcggcctcccaaaattctgggattacgagcgtgaactactgcacccagcctagtgctaatcactttttaaaaagccattctaatatgtagtgatgtctcattgtggttttaatttcaactttcctaatggctaatgttgctgaccatcctttcatgtacaaagaatatttgctttggtcaaatatctgttcatgtcatttgcgcatttttaatttgattacttatttattttatgttgagttctgagagttctttattcttgacacaagttctttgtcagatatgtgatttgcaaatattttctctcattctgtaacttatctttccatcatcccaattgcgtcttttgcagagcaaaaaaaaatttaattttgatgaggtccaatttatcaattttttcttttataaattgtattttgatgtcaagtctaagggctctgcctagtccctgatcctgaagattttcttcttttttttttcctgaaaatattacagtttgacatttaagcccatgatccttgtgttatgttttgtataaaatgtgaaggtcaggccaagcctcatctccttgcctatggatgtctgattgttcctgcagcacttgctgaaagggctatcagtcctctactaaactgctgttgcatctttctcaaaaattaattaagcatatttctggggtgggatctctatcttgcaccagtaattaatgtgtctctccctccaccagcaccatactgagttgattactgtagttgtagagtaagctttaataattggtacagtgatttcttctatttaattattctttttcagaattgtttcagctaaactaggtccacttccttttaatataaagtttacaataagtttgcatatgtatacaaaaaacaatgccaagatttagaattctattaaacctgcaatttgaaggaagctgacatctatgttgagaattcccatccctgaatatggcatgactctccatttatgtagatgtttgatttctttcagcagaattttgtaatttgcatatattctcctgtatatgttttattagatttattcctacatattaatacttcatgtattttgagcagttgtaaatggtattgcagtttttattttggtttccacttgtttattgttaccatagagagatgtaatttgtgtatgtgtgttattcttgtgtattgcagccttgatattctcactctttatatcaaggattttttttttgttccatgggactgtttatgtagatgattatgccacatgcaagtagtgatagttttctttctttcttttcaatctgcatactttttatttctttttctggtcttattacactggttagaacttctagtactatcttgaattaaaatggtgaaagggaacattcttgccttgttcctgctcttaaggggaaagcattcattctttcaccattaagtgtgatgttaactgtagatttttgtaaatgctctttatgaagttggaggaaattaccctctattccaagtttgctaagagtttatatcatgaatgggttttgaattttgtcaaaaccttttcctatgtcaattgataagatcattatgatttttcttcagtttacaaaacagaatatgtggattggcttttcaaatattaaaacagtcttgcataacttgagtgaaattcctcttgattgtggtctactactctttttatgcatcactaaatttgatttgctgacactgtcttgaggatttttccatctaagcttatgagcaaaatcagcctgcaaggttctttcctctgtccctgcctccttcctccctcccttccttccttcctttgtgctgtctttgttttgttttgatatcaaaataatgatatcatagtcctttctcttctattttctggaagagactgtgtaaaactggtgttgattcttctttaaatatttggtaaattctccagtgaaaccactgggtctggatatattgtgttcaggagctttttagttacaaatccaatttatataatgattataggactattcaggcttttatatatttcatcttttctgagttgtggtaatttgtggttttcaaggaattgatccattttttcctaggctgtcaaatgtatgagcataaaatttttatagcatttttcatagatgcagcctcttttgtgatatttcttgtttcattcctgatattgctgatttgtgtgttatctccttttatctttgttgatcatgctagaggattatcagttttattaattttttgaagaacctgttttttatttccttaatgttctgcattgctttcctgtttttaatttcatcaatttctgctcttcgctttccgtcctatttgccttaactttattttactattcctcttttagttttttgactactggtttgagaactttccatattactaatataaggatttagtgctataaatttctctctcagctctgctatagctgaatccctcaattgttttttaagacagggtctcattctgtcaccgaagctggagtgcagtagcacaatctccactcgctgcagcctcaaccttctgggctcaagcaatcctccctatctcagcctcccaagtaactgggactacaggtgcatgccaccacacctggataattttttgcagagatagggatttcaccatgttgcccaggctagtcttgaactcctgggctcaaaaagcgatccacctgccacagcctcccaaagtgctgggattacaggagtaagccattgcacccagcctcatccacaaattttgatatgccatattttcattgttacttgctttttaaaaattccctttgagacttcttcttgtccacattgtatataaatgtttactgcttaatttccaagtgtttgcagatttttctcttgtctttctgcaatttatttccagtttgattccattttggtcagaggacactctttgtatgatttcagtttttaaaaatttgttaaggtttgttttaagatctagagtctgttctataagagcttgaaaataatgcatagtttgctgttgatggatagagttttccataaatgttaattttaccctattggctaataatattgtttagttatcctatattcttgctgattttttttctagtaattttacaaattctgaaagtgagatgtcgacatatcccaactataattatggatttttctatttcttttttaagctctatcaggttttgcttcatgtgttttgaagctgtgttgtttggtgcacatatatttaggatcaagatatactcttgctcttttgttattatgtaatattcctcttttgttctagaaattctttttgccatgaactctatctgatattattatagcaactcctgcttttttaaaagttcctgtttgtttgcatgaaatttttttttctgttctttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcaccgtgttagccaggatggtgtcgatctcctgacctcgtgatccgcccacctcggcctcccaaagtgctgggattacaggcgtgagccaccgcgcccggccttttttctgttctttcacttcgaatctgttaaaaacctatgccatggtattagaactgaatatcttatggacatcatataatgggtcatatttttgcatttactctgctatttctgtgtttttcccagatttaaccaaactgcaaagtctgagggcatggttcctaaaatttccctcattcctgacaccaacagcaagttttagaggtttccaaagcaccctaagtttcaatcatttgctggaagaactcacagaagtcattgaaaactgctgtacacatggttactgtttactgcagggaaaggatacaaatcagaaccagcacagagagcagggctaggagggtctgtgaagcctctgttgtcctcaggtgcattactctcccagcatccacgtgtgacaataccatgaagcactgccaacctaggaacctcacccaagccttggtgtccggagtgtttcctggaactgcattgtgcagccataattgactgatctgttggagactggttggaactctgtcttcatctctccctttcccggaatctggggctgacagcacattcctgggagggcccaccatgagccagctggtagcataaacttcaggtatagtctgagggacccaccatgaatagcaaagaccctcctgtcacatggtcttcaggactacttgccaggagccaggacaaaggctagacctcttctttgggctaggccaaattctttaccacacagaaatcatatttaggattcaaatgtgccatttttatttgctttctgcatgtttcttatgtttcctttattctgttttgtttcacttgtcatggattacttaaacagtttttagcatttcattttgaattatttatacttttgggtgcattgctttgtatcgttttctaagtggctgctctaggattgattataatatacccatgtaacttatcacagcctgctggcatcaatgtttcaccacttcatgagaaatatcaaaagcttacttttatttacttccccttttcctcccccacttaaacatgtaattatcataaatatttcctgttcagatgtagagcaccgcagcagatgatgttaatattttttgcttcaaccataaaatacaatttaagaaactcatcatagtctattatacttaccatatgattaccccttctgttgttgctatttctgatttccttatttccttttcgttagtagagcttccttcagccatttattaagggtaggttttctggtaacaaattatcctagttgtccttcctcttagaatatctttatttccccctcatccctgaaggatacgttcactgaatagggttctgggcagacagtttttctcagcacctggtgatggtgtgtcgccccctctgcctcgtggttttagagaagcccaccatcctcagaaccagcgtcccttaatgcatcgtttttctctggtggtttaaaagatttttttcttcatctttcctttcctgaagttccgttatgatgtgtttatcctatttggggtttgctcagattcttgaatctgcaggtttacttctttcaccaaatttgggacatcttcaaccactgtgcctttgaatactttttcaccacacattccttcctctcctcctgggactctggtgacaggaacgctgggccttttgtcactgtcccacccatccccgaggaggcgttcatttctcagtctcctatctctccatcgttcctatgggccagctctattaattgtccttgaatcaagagactctgttctctgtcgtctccactctgctattgtacccaactgcacattttttcatttagttattgtatttttcagttgtatgattttcattttgttcttgtttcaagaaaattcaccattgttttctgaagcacttttatgatggctgctttaaagttctaacatctgatttatcttggttaatcttattttgctatttaagttgttttttgttttgctctgttatgtttttgagacagagtcttactctgatgctcagactggtgtgcagtagcatgatctcggctcactgcagcctcaaactgccgggctcaagcagtcctcctgcttcagcctcctaagtagctggcaccacaggtgtgtgccaccacaggtgtgtgccaccacagctggctaatttttaaattgtttgtagagacagggtcatgctgtgttgcccaggcagatctcaaactcccgggctcaagccatcctcctgattgaccttccaaagtgctgggattacaggtgggagccccctcaccaggcttcaagttgctttttatgtttcctgatatgacaaataatttcaaatatgttctggagatttcggttattatgtaaggaaactttttatcctatttgaacattccagttcagtccatggtacccttatttggtttaccatataggccccagcctgctttaggggaaatgtagagtcaatgacaatttagttttcaaagccctcccagtgctattctggtctcgtttgttcttctggatctgctggggctctggttcaatccctgtgcatgttgctggggttgccctgtgcggcgggggtaggttaaggaaacgccgggtgctgggtgtggtctctgcgccgtggtcagcagagcctttgtggcctgggtgtgatgctgagggccaggcttgagcggagctgctgtggcatggatcagtaggaatctcctcactgggtcttcagtgagatacccttctcagtcctttcaccagagaaaataggctcgttttcttttcttttttgtccctgcaggttttggcagttacaggttgcagggttctctgggcccatccaggagatgagagaaaaagaaaactcagggccttgtacagcgtcacccccaaagtcccgaggttcctggacagcctttcttcctctacacttcctagagtcctcttatgtctgttaaattttttccagggtgtctagttgtatttagagggcagatgccacctcgtcatagaatgccagggtccactctccaggcatttggaacgagttgccacgaggtcctcgggagggtgtgacagttcacacgcccaccagcagctttccacgtctccatttcctctgcccctgacagcatctaatgttatgatttttgtttgtaaatttggcttttggttcctttatgaggggattaattaatacaggctgctggctccttcccacgaatccaaaccttggagatgccatcaaagggatgacagttgatggagcccagaacctaagaggacccctgagagccttgcggaggctgggcaaacgtggtggagtctgggacaggaggggaatcacagtctgagtggaggaggccacacagcacaaccggggccagactgcagctctctgctccggggcccacctggggctgtcatctgccagccctgctttcctgtagaagatcccacccgtaccagccccaggaatctaggcaaggccagagcacctcaggagcctcctggagtgagggccacgacacctgggcaggctggctggtggcccctgggcagccttcctccccagcccaaggacagccaattacagcacagggcagccctggacagacagcaccagctagaaggacaggggcgttccctgcagaccagagcagcccccggggatgagcaaagagggccccagtcatcctgccagaggctctgcccccaggagcccctgcctgcctccctgaagcccacaaggaaggtgtcaactggggcctaagacgaaggcagttgaccatacccagggaacagagagcggcctgaggaaacgagacagcgaggggagtgaactccgggagggaaaaaccccaaggtttttccttggaggagggagcagatgagcggataagaccggtaaatccgtcacataccctcaggacgcagggagagcgcggctggaattggcagttatgcagaagatgcagccgggaatactggactggaacatgcgggcgcttaagtgatgaacttggtgggaaggttggagaccagaaaatgaatgagtgaggcaggtcaggctctgagctcttctagaaggagctgaaggggttgaggaggcagaggtgagggaggaaaaatattcagtgcttaaaagaggaaaaatgaatagataagaggaagtatctgaaaaatgattaggaaatttccccaattaagaaaagatgcacatcctcaaactgaaagggcctgcagagtgttaattacattttaaagttaaaatcttatgtgtactttcaaagaaaagcatctacattttgagtcaaaattgctaaaaacttccaaagagaaaaagcaggtaacccgcacaggaacgggagtggtgctgacattagaatcgcggcacagacaacggatgcaagaagaaagggagtgacagcttcagacgcgagaggaaaggaccctggaacccagggctgtgtcctgctcaccgccatgaaatatgggcacgcaggaagccatcctcagtcctatcagcccccttgagagtcaaccccagaaacactcttggagaaatatttcagcaagaaaaaggaaccggggaggatgctgccaggtctagggaggagtgatgcttccccagcgtggatggttcactgccatctaagtaagcaatgacctccgcgtgtgccgcacagtccagcttcctcagaggcggtggtggcctggtggaggaatgtgggctggctgggaggccacagagaattactgtttccattaaaaggaaatgtgttctggccgggagccctggctcacactgtaatcccagcattttgagaggctcaggcgggtggatcgcttgaggtcaggagtctgagaccagcctggccaacctggtaaaaccccgtctctgctaaaaatacaaaacttagctgggcgtggtggcgggcgcctgtaatcccagcactttggaaggcagaggcgggcggatcacttgaggctaggagttcgagaccagactgaccaacatggggaaaccccatgtctactaaaaatacaaaaattagcctggcatgggggcacatgcctgtagtcccagctactcgggaggctgaggcaggagaatcgcttgaacccgggaggtggatgttgcagtgagccgagattacaccactgcactccagcctgggcaacagagcaagaccctgcctaaaaaaagaaaaaaagtgtcacatggagacgtgtgtctgtttgggactgttttccagcctttccacactcttcccctccccatctgtccctccatctccaccaagctgtgttttgatgttgtgtttgcatgatttggtgtatctggcattttaacatttcatccttgccactatttattattttctgtttcttcgtagtagccactaaatatcaggtgatatctcattgtggttttgatttgcatttatctaataattagtgatatttagtgtcttttcatatgctcattggccacatttgcctgtttttaaatcaggtaatttgttgatttgttgttgaaccatggagacatatttttaaaccacaacagctatcttgcagattgcggtgagaactaaaagatttatgtatgcaaatcatattacctgtcacgtagtaggcactcaaaaattattacttgtcttcttagggttgttatgttaaataatgttatgttaataacatatgtaaaactgcttcttaaattataaagtgctatgcaaatgtgagttaatactacaaagctgtatgcaaaatattttaatatttttctgaggttctccatacttaaatatataaatctttccatctctagactttattctttttttagctgtaatcccttttttccattttacttcaagttttatcaaaaaaaaaaaatagcagccaaaatagaacaagtaaagacggagaaacaataactaatttcactaaagcaaagtcagagtaagatctatttaaaaataaaacgtgaagaaaagctgcaatggattacactattgaaaaatcctaagacaaccagaactgccgttccttcagagaatgtgagtgatgttgaaagattaataacatttggataacattaattacagtgatgttataaactctggtattccagttgccataacaacccgctatatgttggttttctaatgacatttcgaacaagtgttgaggcgaactgcatcacttcagaactttgattgctgtcactcagtgattttaaaattgaattgttttgttcttaaagagtcagaatatgtcactgtcttcagaaatattctcaaaattatggggaggaagtgatacacattcctatacaattatagagcactcaaaaaaaaagaaatgtattttgtttttaatacaaaattaacaggttttttctatagggaatagaaaaaaacagaaaggagaaagattatgcttcatgcttctcagaagactttgttcccttgcagaattatttgacaataaaattctttctagaaaaactcacttttcttgcttatatttctctcgtctccattctctcctttcttttcacctccctatttctttcttccagtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccttaccatctcattcccacttctaatctgtcattaaacagattaggcatcttccctgggatcatttgtcatctttacgctcgtcttttctgtgcaggttcctagcactccatatctgtgatggcataatcacttcataaatggtctgtctctgttatctcccatgtcaaattccagaattatgttcttgaacctccatcacttattttctctctacctaaacacaggaaaaaaacccaaattctttagcttgtaaatgtttttaggttctgaatttcttcttaaactttatttttaccttaatatatgtctcatcactcccatttgactcactctctctaattcacagagtataatcttagttttacaacctgagcttaaaattgttctattcataccttgcccatgtttagatgcctcatacgaaactttccttgcccactacagtatatcataatgttattttctaagttcattgccttttgagttttgccaaatatttactcaaaattggtctgccttttgggtatctattacagcattgtttgtgctattttttactttcctaccagttagaatataagtttctttagggcaggaaatatgatctttttactgctcctgaatggcttctgcaatagtaatagctcaattattgagttaacaaggttattcgacaaacatttattgagctcctattatgtattaggcattatctgagcactgaagctatagcagtgatacctattcccatgcagtttatattacagtatgggaagacagggatcaagaaatagagaaataaatatgtaggatacaatatttcctgtggtgatacattctttgaagaagggcaaagcagatgatgggaatagatactagtgagagtggggatgctcttttaaatagaatagtctgggaaggcttcatttaagctaaattttgaggagacctataggaagtgagggagttctgtccttcctatttcaagtttacggtgagcaggaaagcaaggcaatcatcaaaatgagtgtggaaatgctctaacaagtacacttagagatccaaatccaaatggtggctattaagaaaggcaagaagtttggtttaaaaatgtgcctgaagatgcaccattgaaaaatggcagcagtgtgcagggacaatgccacctaacccgcgttcagagcgaagccacctggtcggccaccggcagcttggggaagaagggcatgtggcgcgcccactccaccttgctgaagagcagccgtgaaatttttaataatatttttatttaacccaactcacccaaaatagtatttcaacatggaattagtataaacactattaatgagatgtttacattctttcatcccaccaagtgttcaaaactggtatttgattttatacttggagcacatcttaattaggactagtcgctttgcaggtgctcagtaaccacatgtgggtcgtggctattgtattggacagtacaggttaaagagaggtctaaggactaaatacagacctcaaataatattgaggttaaacaaatactaaattgactttatttttcagaatgaagtttctttgcctggagagaacaagcatgctcttatttcacgtattttcctaattgaaatcctgattttggcaggggaaagaacccactgagtgtgctacatgttggaactagtgaccttacacatccatgctccatctcctgggaaagtctttcctgaagaattgtatcttcagtctgtttgtcctgatttgtcccaaactgacagaagtacctgcagagctggctaaaatttccctttcagacattgctgtttaggtgagagtacagagtggttgggagggtcaatcagttgtagaacaatacttaggtataatccaatttatatacccactcaaaacccagagattttgcttctatatgtacagaaagaggacttagaaatacatccaccaaactaaacacgttgctgaggaggcatgtgtgtgtgtagaggtgtggagatgtgaaaattttcactattttatagtttttttctttacaacgactattcactataaaatatatgatttatttgtataattaaaaagtagacaaaatggaatacaattcatttcagtgtagctaagcaagccccagttagtaaaacttttatgtttttatttacacatttagactaaaaacatactttaaaatatttcaattttatatatgaacatctttttcaagcacagtgagagcttagatacaagtgaggattttagttattcagttaattatggttcgttggccccctcccccaagtctaagaatttttggcttaaagagaaagagtaagtgaagaatcctctatatccattcttcactagttctaagaaggatgaaaggcaagtgcacaacactctcactgcagcttacagagattttccagatgataatttatttacctttagtttaactttttctctcagaactccagataatgcagtagtaacttataagcagcacagtatcttctaacagcattcatcatgagatagacaagtcctcaactacccgagacagtgttttaccccttactcatcctgctcccctttcactgctgttgcataggtggataatttgatttccaccctgtgtaatctctagaggaaacatagctcagagatatggaatagtcaaaatgaatgggttgtttgagttatttctctctctctctcgctctctgtgtgtgtgtgtgtgtgtgtgtgtgtgtgtgtgtgtgtgtgtgtgtgtgtgtttgctgtccagtatctccatccctttttatgtttgaggtaatcccaatattatcaggcttggagcttctatttatgtaattgttgtttatattgccagatattagctctcctagcttcccttgcacttaaagttgtaggaatgtactcttgcctttaccagatacagctataccaggctttgaatcaagaagcagaagtaggaagagcaacaatgttgaaatattggcataagaaatgacaatgaacaggctgggcgcagtggctcgcgcctgtaatcccagcactttgggaggccaaggtgggcggatcacgaagtcaagagaccaagaccatcctggctaacacggcgaaaccccgtctctagtaaaaatacaaaaaaattagccgggcgtggtggctggcacccgtagtcccagctactcaggaggctgaggcaggagaaaggtgtgaactgggaggcggagcttgcagtgagccgagatcgcaccgctgcactccagcctgagacggagcaagactccgtctcaattaaaaaaaaaaaaaaaaaagacaagaaggtagcacacttgttgcagaaaagacaagttcctagaacagaatgacagtggtgctcatgtagcatcttggtggcctatagcacagccatgactgcagtcatgatttttcatcatcagttctgcatggtggtttgcatatgtatctttgaatttgagcctcaactctggctcttcacctttcattggttctgtgagattcctgctactccatcaataaatcctttttcatttacataatcagctagagtcagcttttattggatgtaagtgagaacactggcagaattatactctaatagagttatctcaggtgggtatagtctctacaatctgcagagggcaagaagaactaacgctttggcattgcaggttgctctgaattctcccttagctccacagtggtctatgaagctttatcccttaacatattttattgaagaaaatattccaaaagtcaaaataacttggaagagggttttaagatgtctgtgtgtgtctggatttttttcacttagcataatgttctacaggttcatccacatcgtcactaatggaagaatttctctattttttaagggccaaatagtattccactgtgtgtatatatcacattttgtgtatctactcatctgatgacaaatacctaggttgcttccgtgtcttggttattgtgaataatgctgcaatgaatttggaagtacagatatctctttgacatattgatttcaatttctttggatatatgcccagaagggaaattgcttaatcatatggtaattctattttaagtgttttgtggaacttctatactgttttccacggttatattaatttacatttccaccaacagtgcacaaatgtttacttttctctgcaccctcagctatacttatctttcatctttttgtgatagccattctaacagatatgaggtgatacttcattcagttgaactcttaaaagtagagagtagaatggtggttaactaaggctggagggaagaggcggctgaggggaggagagatgttgatcaaaggatacaacaattcagtttgatggaaggaataagatttagtgatctgtttcatagaatggtgactataataaataataatgcaccacatatttagaaactactaaaagagtggatttcaaatgttttaaccacaaaaaataagtataggagatgatgaatttattaattagcttgatttaatcatttcacaatgtaaatgattatcaaaacatcacattgtatcccataaatatataattatcatgtgttcattagaaataaaatttaacaaataataaaagaggtatatgttcacagaaaaaacttgaatatgaagtctaatgtagactggatatttttagtcaaatcattaactttctcttcaacatattggagacaacatcacaaacacctctctttcctatccccctaatttttgtgccttagttaaaaatatgaaaatttcagagtgttggcaggtgatcaggttaagtaaagaagtttatgttaagtggtgacttttttaaattttttatttattttttatttatatgtattttttattatactttaagttctagggtacatgtgcacaatgtgcaggtttgttacatatgtatacatgtgccatgttggtgtgctgcacccattaactcgtcatttacattaggtatatctcctaaagctatccctccctcctctccccaccccacaacaggccccggtgtgtgatgttccccttcctgtgtccaagtgttctcattgttcaattcccacctacgagtgagaacatgcggtgtttgtttttttgtccttgagatagtttgctgagaatgatggtttccagcttcatccatgtccctacaaaggacatgaactcaaacattttttatggctgcatagtattccatggtgtatatgcaccacattttcttaatccaggtggtgactgctttaaggtagcttatattttggttgatagagttgattccctggtatcctatgtttattttctgtaacagtagatgtttcttcactataagctcaaagtatagaagcccaggtttgagtaagaaatatttaattatttggcatatttgaatgtatgcatgcccttctatgcattctcttcagagctggaacaggaatttcccttaagaatctataccatttctagtttttatttgctgcgcaccatgaacaccttaccaagacttagtaataaggaaaatacaaattaaaaaacattcttgtttcagtgacggattctcgttctttgatattatagataaagcaatttaatttttgtgagtacagtgagtagatgctgtttttcattatagaaaaacctatagttggcaaggaaaaaacagttgataaatttaaaacacatttaagatacataaagttgcattaggataaagccaaaatacaaattagaaacatgggtcttagctttgtacataccaactgaattacatatagttttaggacttaaaaaatctccaaaatggaaaaatgatacatagatgaataaaaattgtacagatcttacctacgatgaaacttaggactttgtatactttttgctttgagataggatcagggctctttgtgtgtaatgagtcacgcttttatgagtaagaagccaagtgctcagacatcaccagaaaatagttttttttaaaatgagagaaattttgcatttcttatggaataattgtagaagaatgtatatcatttcagtgtgttccaagatatttcttttgatggcactcccagcacttttttaagggcatctgtcatatctttgttccagagactgtaggtcaggggattaaagaatggggttgctgtgcagtaaaacaatgtcacaaatttctgtgtcccagggcggctcctggagcctggactcacatacatcaccatgactgagccatagaagaaagaaacaaccaagaaatgggaagcacatgtagagaaagctttgttcctgcctgagccagctgggacccacagaacagctcgcaaaactaagatatgggacccaagaatgtagaggaaggtgatgaagatgatgagagagcttactgtagcacaagtcagagtagttttgggaactggggcacaggacagtgccagcaatggtcccaggttacagaaaaaatggtcagtgatgttagggccacagaaaggcactcgggacataagcactgcaggcatcagtatggatagaaaaccacctgccctgcagaaggccactaatcggacacacaggtggtgagtcatgactgtgggataatgcaaaggtcgacagatggtaaggaaccgatcaaaggacatcacagacagaaagtagccttctgcagcacacatggagaagtagaagaactggagcaggcagccagcataggagatgctcttgatatgggagatgagattggccaacattttgggacatcagaactaatgcagcagatctccaggaaagagaaattagccaagaggatgtacataggtgtgtggagtttctggcttgaccacacagcgcagatgatggatgtgttacccatgagggtcagaaggtagatgagggagaagaccacaaagaggaggatcttggtctccctgcagcaggcaggggaagcccaggaggataaattcactcacaggcccagaaatgttattggcttctatgacactcattcttctaatctatgaaggaaatgaacgatagggaccactacaataaccattttctctctcttaaagtgttatatttatttcttttgactccaagacaatcttttaatgcacttttgtgaaaagttccatatagttctcaattcaataactcacctcccatctttgtcttagttcaatgaaatcagggttatgggagaatgtggctcaacatgttactacgtgatcccacagcctccactatatcatatctctgtttttcagagtgtaagtttcattgacatcacataacatagggtccaaacgactttctctatttgcatttaaattaattctgctttgatgtaatgttttgtaatacacatattcaaatatttatacatataatttctccctattagaaaattttgtattgtattttgaaaaattctaagaaaaatcagtttaaacataatctaaaattgaattaggtcagtacaaaaagagaacctcattatgttgtcaataaattatgtttttaggagatctgtcctggatagttctgttgactgaagtagggtactgaggatgctgccacagatttcatgctagcacgtgtttgtttgctccgtatagtggcatttaacttctatttgctgagcaacagctaatttgacacagaaaagttgccttcaaccctttactaggaagatcttgctctatgatagaaaaacagcaagaggcagatggaaaaacatctatttccttagctcagatgccttctcatcttgttactatactggtgatgaattatcttatattaaaaaataaaccataaatttaactttaaaaatgtgagaggaatacaccagtgtagaatgttagtgtcagaaaggacctctagtcttattaagctcaatttcctcgtatcacagaaactgagaccagagaggttagaatgatccaaagttatgttggctgttagaagaaagaggcctaaaacttaggtgttcatatattcagttcagactttttctcataagcctctgctattgtgggaccctgctttttttgtcagctcagatggttgcaaaagtatattgtgtatgtattatactgttccttcctttgaattagatccctatttataataaaggaggacattaaccaggttactaaccaaagctgacaattgctacatcatatcccctattcacctttgacctgccctttgccctaattcttggcatcatttatggcataaatctacttttggacactttctttaaagaacatttgacttctaagatagtaagcataacaacaaccactgtcatgtattaaatgtttattgtgacagttacataatgttcattatctcattaaatcctcctcccctctcctttccagttttagagtagaaaaacactctcacatgtttaaatgtaccatttgaattctattgtgcttctaaatacattgaatctaaaattcaagtttttattctgtccagctttcagctatgtatataatgtgctagctgttttctctcattgcatctgattccatttgttcacatgtaacttgcttctatctaatttttgcttgtgaatttgaaagatttgcctctggacatctgtgttaggaactgaggttatatatcataggaaaatattatttacatatttcttatagattatgtagtttacattagatacatcacctgaggccaggtttgtgtccttcccttccatgcagcgagtcctccaggccccaggtaggtctagaggtgttgtctggtacccagggactggagtcaaaaaccttagacgtctacctggtattctattatactgcaactgagctggccctcaagccacaagacacagcccttcccactcttccctcttctttccacaggcagaggagaatgaccctgtggccaccaccatcacaggcctatggtgagtaactgccacactcccacctgtgtgtacttaaggcccacaggctcttcagtcagcttgtggtgaatgctgctatgcctgggaatcacctttcatggacatgggctcccctctggcccagagaagctccagaaatgccataaaagagccatgagctagaatagggaacctcaagagcccccttgatgcactatgcccatttgactgtgctggtacttaaggtacaagacaaagtccccttgacctttctctttgcttctctcaagcagaaggagtctgtcactgtagtcaccacagctgggaatgtgctaggtctcacctgaagctagtatgtctcgagtctcacccaaggcatatggcatactatttgggtgttgcttctcattattcagggcccaagggctctttagtcaataggtgatgggtcttgccaggactggttctttccttcaaggcagcaggttcccttctagcccagggtgtgtctagaaatgtcatctcggagctagggcctggaatggtgcctcatgacggaccaatattctttcttactgtaatgagctgggatctaagatgcaagacaaacatcatctttactcttcgctttcttttattcaagcagaagtaaaggatctcttttggagccacgagctgtgctgctggggttaggggaggtgtgggcaaggactctcttagctgccccagctgttgtttcagtaagtcatgtgttcccaagtccattggctccaagcccagctcagcaccaggacttgctgtccttgtggcctagactgcctgtcaaatttatttaggaccctagagtactccagctcatggcggcaaggcttgccagaactcaagctccatctgctggagtgggcaaattgccctctggctggaccttgtctaaaggctccctctgtgggtctgtgtcagctgagttcagcacagttttgctttccactgtgatagggcagcactgagttcaatgcaaagtctcacgattgctgcactttccctctcccaaacacacatttctctgtgccatgtggctgctgtagtggggatgagggagagttggcatcaacaattcacggctctctttctgactctctttagtgcctctttcaatgatacggagataaaaccaggtattgtgagtgctcatattatttttggttcttatgaaggtgctgtgtttgtgtagacagttggtacatttggtgttcctgtgggaggacaattgatggagccttctattccaccattttgttccagccacttccaaatgctttttctttttcttatttatttatttttgagatggagtctcactctgtcacgaggctggagtgcagtggtgcaatctccgctcactgcatcctccacctcccaggttcaagcaattctcttgccttagcctcctgagtagctggggttacaggtgcacaccaccacacccagccaatttttgtatttttattagacatggcgtttcaccatgttggccaggatggtctcgatctcttgacatcgtgatctgcccactttggcctcccaaagtgctgagattacaggcgtgaaccactgcacccggccccaaatgctttttctgaatctatggagattatatgtttttagtatttttgttaatgtggtgtactacatttattgatttgcatatgttgaatcatccctgcatctcaaggataaatctctcttgatcatgaggtgtgatacttttaatgtgctgttgaattctgtttgtgagtatttaagtttgttgagaatttttgcatctttattcatcaagaatattgacctgtaattttcttatcttataaagtctttggctttgatatcacagaaatactagcctcatttaatgagtttggaaatgtggtttttcttcaataatttggaagagtatataaagaactggtatttttaaaaaatgtttggtggcatttattaacaaagccatctcttcctgagcttctttgctgagaggtttttaatcagttttttattggtgattcaatcttcttattcactattggtctgtttaaattttcggtttcttcatgattcagtcataggagggtgtacatttccagaaatttatcatttcttcttggccttccaatttattgtcaaataattgtttatagtaatcccttatgatcatttgtatttttatggcatgagttgtattgtttcttctttcatttctgattttatttatttgagtcttctctattttttcttggttagtctagctaagatttgccaacattattttatatttcatcgattatttctattgttttcctattctgtatttgatttatttaatttctgttctaatctctgttatttaattcctttggtaaatttgggcttaatttgttcctttttacttccttgaagtttaaagtaaggtgggtttgtttttggacatttttcttatgtttagagtagatgtttattgctatactgcctcaataccactttagctgcatccataagttttgttattttgcgtttttggtctttttttataggtagatacattctaatttccctcgatatctttttgacataatggtttttcaagagtgtattgatttccacatatttgtgaattttctagttttgcttgttattgatcttagttttatatcattatagatagaaaagatacttttcctacttacataatttctatattcttaaatttacttgtgcttgttatgtggcctaacagatgacctatcctgaaaaatgttatatagtcacttgagaagaatgtgtattctgctgtcactggatagttctgtacatgtctatgaggtccttttgttttataggatgtttaagattgctatttccctactggttttctgctagagattcattcccattattgaaagtggcgtaatgttgtgtctcattgttattttattgctgtctatttctcccttcaaatctgtcaatgtttgccttatatatagttaggtactctgatcttgggtgcctatacatttatagttgttctaacatcctgataattgacctttttatcattatataatgaccttttttatttcatgtgacagtttttaacctaaagtctatttggcctggtataaatttagccactcctgctgtcttttcgttatgatttgcatggaatatttttttccctcccttcactttcagcctttgggcatccttgaatctatagtctcttgttgacagcctatagtttgattttattttttaatgcatttggacgttctttgtcttttgactggggaatttttaatccatttacagtcagctggatgtaggttccacatccacagagtcaaccaaccatgcataaaaaaaatcacacacccccataaaaataacaatgataaaaaatggaataataaaagtaatgcaaactagatggtgtaacaggtatttatatactgtttacattctattagatatgataagtaatctagagatggtttaaagtataggggatggtgtgcatgggttatatgcaaatactatatcacttaatataaaggactttagcatccataaattttggaatccacaggcgatcttgaaacccatctttcatggatactgtgggacaactgtatttacaaagttgtattaataagtaaggacttgctatggcacttcattttattttttctgtctgtgttataattcttctttcttttttctcttgctgttttcttttgtgttcattgatatttttgtattgatatgtatttatttccttttctttttcttttgtatattttctgtagtattttatttttttggttaccttggggcttatgtaaaacatcatatatatggaggcaaagtttattctaagctaataacaactcaactttaatcacataaaaaattatgcacttctcccactttgttattgatgtcacaattacatcttttatatgtgtatatctactattatacttctgtagttatagtaatttctactttgttgtcttttgactttcatattagaaaaaggtgcaccaccattacaatgttgcacaattttgtatttgtttaaataattagcttttccagtaagttttatattttaatatgcttagttatgcttagttttgctatttagtattattttgtttgagttaaagggctcacctgtcatttattttatgacaaatctagtggtgatgaagttgtctctctcagcttttgcttgagaaagtctttatctattcttcatttttgaagaaaatttttttccagaaattgcattcttggttgagaatttctctctttcagcattgtcttgcttcttcaaaattcactctttttgacttttgacatataattataatatgtctttgtgtggacttcccttgaatttgttttatttcagttccatttggcctcatgtatctgtatgtcctttttcttctacagatttggcaagtttttagccagcactgtactttccttcttatttttctcttctccatctggaacttttgtgatcagtatattatttcactttatgatgtcccttaagtccgtaggttcatttgctcttttttattcttttttcttttgctcctttgtctatgtaatttgaaatgactggtgtctggattagctgattccttcttctgtttgatcaagtctacttgtgaacaccccctagtgattttttttatttccgtcatagaattcttagctccagaatttctaattgtttcttgtaaaatttctatatctttacttcaatatttttatcttgctcatctatcattgttgtgatttcatttgtgtctcagtgttctcttgtggcatgctgaattatcatggagccccagagctctcctttcctcatgtgtgctgcttctttcatatgtgataactataatgaactttaacaaatctcaaattcgagtacattcccaatcaccttctaaaagtaacctcctaacctccactgattcctcagatgtggtagtttgaaagttgttcccatagatttcaactacaggccaaccagaggggacccatggccactagaatggtccagtgacctttatacttcagtgtgtgtaaaaatcacctgggatcctatttaacattcaagtttctgagccttcccctagccagtagattttatatacaaaatgtgagggaaccattacccttttcaagtgattaaaaaaaatcagaggtgaagcaattagatttggctacatttaatttgatgttttatctttcaagagattgggatggttctagtgaaaattatagctaatctgaatatggcttctaactgttactgggtgcttatgtcttttctttactctgatcaacaatattgggcaggtgtagtggctcacgcccataatcccagcactttgagaagccaaggcgggaggttcacttgagcccaggagtttgagaccagcctggacaacctggggagacctccatctctgcaaaataaaacaaacaaacagacagacataaaaacacctagctgggcgtgttggtatacacctttggtcccagctacttgggaagctgaggtaggaggattgcttgagccacaaggtcaatgctccagtgagccgtgattgtgtcactgcactctagcctggaaaacagagcaagaccctgtctcaaaaaacaaacagcatacgtcttattgttttgttcgcttgtttctgaaataatctcgttagtaaagcactatacttgataaacagtctgatttaatgaataaggatttaaactttagattttggagagacaagattaactaaccgttgatcacaaggagcacactgtgcaacaagctactctgataggacaaaagtcctaggagggctatataagcaaaatctcattcaaggactgaactttaagccctattcacttttagctaatcaagtgatgggcaagttgacatctatagggaagagagaagaggatgtgtttctgagctttccttcttcagtcaggcaactctgtgattcattaatttcctcccttccttctccacaccctggcatgttggcccatagccacaaggtggcaggataaccagtaacattttattcaagccaactgaagccctgcgggggctttgaagttcacacacactgtccaccttccacatactgatgctgggagcaatttagagcaaacatcatccagagtcatattactagatgactggattgcttcttttgtccctcaatcctgctctcctttcagtgctaactcaagaaaacactaagtttacactttgcaggagcccctggaatagttaaagctttaaaccatttcacatccaactcaatgatctgttacaaaaaatacctgttgattttctgttattttaatggatacctagcttccttttataaattggcattacaatagtctggtattagtattgatctggaatctatgtgcttccagatcagtcccattccttttacttttagaataagacaaaatgtagctcagacaccattcttccatgaaaccacatctctctaagaagatgctggaaagtcagtctttctcaaaaagtagttttcccctcaagtttcaacacattactccactgtaagtttagacagtataaatatgtataaaatatatatatataatatatatatattttagtataatattatgcttcagcttttcctgcatgtttttctttcttttctcttacacccttctctgtgatctcatctgacaatcactaccatggcaaccaagcctctgtgacgttccagcaagctcattgtcttctcttcactaaactttagttagtagttggtcccagtcagtaacactctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggtaagaataggttgaaataacctggctggttgtgggacaggccccctctgtgagtggtgcagttaaggacacccagactgccctttcactctgctttccctggggtaatgtgtatggctcctagtctttcacgttctcttctgtaattcgggaggaggaagagaagatactcactgcacatattgtgtcagttaatactaatctgagagcaataatttatgatcttttgaggtgaggtttgatttttaccactgtgctgttcctgtctcctaatatgttgtatcagattgtaactaagttgaggtgagaattaattgaggactatatatttgagcctccttagaatctcacccacctttgagataacttcatgttttaggttttctcaagtcagagtgttgagtccttaaatcagtatatgctgggcagtgaaaaaacactggtacactttgattgcctaagcttagtgaacagcaggggcggtgggaggcaggcctttttaacacctgtctttgctgagtttcatgctgaaaaagccttgaggctcagactcagcccacaggtctctgcaatccctccatctcccttctgccctttccatgcatagccttcacagcagttttttgtgaattatttatttttttgagctctctcttaaggttaatttttcttaagaaatatttactctcaatattataaaggtgtagaagtttattgtagagaaatgtgggaaaacatattggcaaaaagaatataaggataaaaccatttaaggtttccccttccatctatacttatatttatagttgggctctaatggcatttaaatgcaaaatgtaatatacatgtttatttatatttttaaaatattaataattgattagttaattcaacaataataattgttaacattccagacactactataaatactcatgaatacagcagtgaacaaaatggataaaaattcctgacttgtggaagttatattgtaatgggggaagacggggtaaataaactatgtggcatgcttggggggcgatgagtaaagatggagaaaaattagaaggttcaggtcaataggaagtgtgtgttggaggtgacaggtggcaggtgtacatttttccctcagcttaattaaggtttaatttgaaaacattgtacatatttatggtatacaaggtgatattttgatatatgtgtacattgcaaaatgattaaatcaaactgattaacatatctgtcacctcacatgcttgccattttattgttgtgagaacatttaagatcaactctcttagcaattttcaagtattcttttggcccttagtatctgtggttctgcatctgcagattcaatcaatcacagatggaaaatatttagaaaaaaataaaaataacaatatgacaaaaaataattcaaatatatagtataacaactatttacgtagcatttacattgtcttagctactataagaaatgtagacattatttaaactacatggaaggatgtgtgtaagttatatgcaaatactgcaccattttatatgaggcggttgagcatctgctgattttgttgtctccagggtgagctggaactagtctcccctagatataaagagacaactgaacaatatgttattattaattacagtcaccatgctatacagtacatctccagatcttattgatcttgtttagctgagactttgaactctttaaccaatatctccccatccccactgggtgtaattttcaatagctagtcagggaaggcctcactgagaaggtgatatttgagaaaagacttgaaggaagtgttggggcaagaaatataaatatctagcaaaagagcattacaggcagaggagatggtatgtataggcgccacaaggcagggggatggctggcatgcttaacacacagcaagaaagcctcatctcttcttcatgcctgcctcacattcaatatatttaaatatggttccttccccatcataaccctgcaatggccattgcagaaatcaccaataacattcatgtgtctaagtcttatggacatttttttttcaagacgtatctcttctcagcagaattcagcactgctgttccaacacattttttcctttggcttcagtgtcaactctattctactttgcctcctgattgcccagaaaactcccacatttctggctacaactcctctatttgatttgtgggcttcttttcctttatttggccattaaattctgaagctctgtgaggctgagttccaggccttcacatctttcaatgctatactattgtctaggtcattttcttctccaaagctttggttattacttatttgccaatgagtatatcaaattgttaatacaaattgcatcctcagagttccagatgacaactgctacatggtattaatatttgactgctggatgatagttttacttgaatgtttcaggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttggtaggtatcagaatctctggtaggagaactgggaagtggggcaaagacccttataaagagtgaactatgaagcagttaccagaatggataactgtggattaaacttggaataactctgagatccagtgtagataactcatctcagaaacatgctgagagataaagggtattcgtacaacagtttctgatagtcattagttatggactgtctcctagcggcattgattcctcagcatgcccaacctgcagcagggacagcaaaagcggcttctgtgatcagagaaagccctcaggtaaggaaatgcaggggtgaatgctggaagtcaggctggcatgcactgaagtattagggtgaggcgccatggcaaggtatctgaccatctttctaaccgttcacctccatttccaatctttaaatacattttacttcccaaatatgtaataatatgcatttccttcaatttctaccaccacctctactgactgcctccatctttttcaaatatacttgcctcattcagcacattcacattgtgcaaccaccacctcttttgagctccaaaacactgccatcaccccatagaaaaccccagtcctcttcccctccatccatggccgccacctggagtgtgtttggcccatggaggacactgcacattgttggtgggcatgattaaatagttgctgcttttctgcagttatcactgtattttgagtgaaagtttcataattttcagtgttttatctgggttgataggatccaattttagtttttgagtttcttttttgagcaactataacaattttaaggattaacatgtcatgacatttattctttactagaggtcttccaaagaacaaagataaatttacttattttaaaaacagaataaaattcatcctgtcttgcaaaaatacacaaaaaaacaaaaacaaatatacttgcctcataattagtttcacatttacccttgtccttctctaaactcttcactaccgtggccacagttactgtttcaaaaagggagatgaaatcatgtcatattctattctctgtgcctgaaatccacttttcaccctcatctccctttatttaaagtatgttattcatttttctagggtctcaactcaagcattcctttctcaagaagccttttatggtatgaagagtgagacagagttccctgcgccacctccattgaatcatgttaggccttaatgtacctttcctttataacacttactgaatgattaatttggcatttatttacctggctattttattcagtgtttaggatttatactagattgtaagctcctcaagagtgttccaggtctagtttaggtcaccatgtatccctgattagtaccacacatcccagtgcaccatggttctcaacaaataacatgttatataaatcaataaatgacaggaacaaagatgtttttcaatttgtattacaatgttttctactatctggcagaatcttagtaggatttaatagaaatcaggcaatgtctactccttaacctgactttgagagagaaacactgatttttaagaatcactcccaattctgactttttctcatcattatgtgggtgaggtagagatatttctgaggcttttttgttcaggaacttgtctccttggacattttaactaggtcatcactagatcattgctacatgaagtatggtctattgaccggcaacatcagtgtcagctggagacttttagaaatgcagaatctccattctgactggtgtgagatgatagctcattgtggttttgatttgcatttctctaatgaccagtgacgatgagcttttttttcatgtttgttggctgcataaatgtcttctttgagaagtgtccattcgcatcctttgcccactttttgatggggttgtttgtttttttcttgtaaatctgtttaagttttttgtagattctggatattagtcctttgtcagatggatagattgcaaaaattttctcccattctgtaggttgcctgttcactctgatgatagtttcttttgctgtgcagaagctctttagtttaataagatcccatttgtctattttgacttctgttgccattgcttttggtgttttagtcatgaagtctttgcccatgccaatgtcctgaatggcatcgcctaggttttcttttagggtttgtatgggcttaggccttacacgtaagtttttaatctatcttgagttaatttttgtgtaagatgtaaggaagggatccagtttcagctttctgcatatgtgatcactaaaaagtcagaaaacaacagatgctggagaggatgtggagaaataggaatgcttttacactgttggtgggagtgtaaattagttccaccattgtggaagacagtgtggtgattcctcaaggatctagaactagaaataccatttgacccagtgatcccattactgggtatacacccaaaggattatacatcattctactataaagacacatgcacaagtatgtttattgcagcactgttcaaaatagcaaagacttggaactaaaccaaatgcccatcaatgatagactgaatacagaaaatgtggcacatatacaccatggaatactatgcagccataaaaaaggatgagttcatgtccttttcagggacatagatgaggctggaaaccatcattctcggcaaactaacacaagaacaaaaaaccaaacaccgcatgttggctcactcatcagtgggagttgaacaatgagaacacatggacacatggagggcaacattgcacactgggggcttttcaggggtggggggctaggggagggatagcattgggagaaatacctaatgtagatgattggttgatgggtgcatcaaatcaccatggcacgtgtatacctatgtaacaaacctgcacgttctgcacatgtatcccagaacctaaagtatatatatctataaaaagaaatgcagaatctcatgcccctctgactcaataagcattttaaaaagtctatcagtattttgcatcactttgttcctccaagccttggcccaacacctagcacataagatgaagttttgggtgatgaatgaatatgctaaaaaataagagtgaaggaatatatgaaaggagggaaagaacaccatgggaaagtgaaaatatatcatactatgatatttgagtattagatcctgacaatttagtttcaacacttttggttttgtatgatatgaggaaatagtgttcactttgtcggtattaagctcataggtgttaaagcaaactaaatatggcctgagaaggacttgtacttccatatttgaatccttgtggatgaactgtaacctagcttaataggcagacaaaattgaaaacctaacttacgagtatgcacctgcaacaaatagctaagtcttagccaatctcagtggccatacttcaatcattaatacactgatgaggcaaatgccaatctgtaaccaatgcagctgttcctgtaactcactgctgatttctgtatgtcatttcccttttgtttgtctataaatttaccaccacatggctgtgctggagcctctgtgaatctgctgtgattctgggggctgcctgatttgtgaatcattcattgctcaattcaactcctttaaatttaattcagctgaagttttttcttttatcatatgtctggaaaaatcctataagagtaatgtaaacagcatttggtttccagggtgggatgcagttccaggagaaaggataccattcatttcttctgaacgccttcaagagacatgtgaatgataaatgtgcctgataacatctcaggcacgtttgtgttatgagaggaaactaaggaaaatctgaaagtttcttgggtgtataaatagagatggctggaagaagatgggggaaagtgaaagccataactgttgagaaaattaagcttgttgaaatatgcaaattgggtctcggctccatacacggttctgatagttaggacactgagactgtctcaagaagacaaccttaaaggcctgagaatccagtctgtttccctcttctagggcacctccttcccagaaatgacaccattaacactttttagcacttatgtaaaggtctggatcatttgaagttacatgccactgtaggacattttctctctgagttgttggtagacatttatactgtagagaaaattttgcacaatttaagtaactatttagaaaatgaaacaaaaaatggacaaatatgaaaaatatagaaaaattattaatggcacagttcatttacatcaaattgttactaatactttgctgcattactcctattttttctacttcgaatcatattatgactaattttgaattctactttttattctatttttatcactttaatagcctatcttaagtctttacccatattttgggataatctttaaaaatatttactttaatacggggaagcattctatcatgtacacatactacagttcttaacaataatctactggtggatgtttcatttatttacatattccattcattctccagggcttatttttcaatgaggaagcttgaagaattgagatagataagaggaaatgtaaacgtacaaagtagagtatgtctgagggaggagtacgaaaccaagaagctgaaactcttgtcacactttatttatgtgatgattttagagcattggtcctattggaaggacactggcagggttcctaaaacagcacatgctgcactgaagagaaccttgtttcttaaatgagctctaggcaacaagtacatttccttagaacatttatagaaaatatgagatacaacgaatgtcttcgtgtacctatgtattgtttttatctttaacgattaggtgtgcctatcacgcaatgttttttacagattttgctgtcaaaggctcctcagtggctgcttcagccagcagctaggacttcaggtcaaagtcctgttatgctgatgcagcttcatttcctgaagcaagatcactcccacttcactctgatgggagagtcttctttctttacaactattaagctaagatttttgagttaacattttaaaaatatatttttccttttatttttagttgacatgtaataattatatttatgagatatagagtactagtccaatacacatagacaatatggggtgatcaaatcaaggtaattagcacatcgcctcatgcatttagcacttctttgtcttgtgaacattcaaaatcctctcttctagctttgtaaaaatacacaataaattatagttaactatattcaccttacagtactacagaaacatttaaaacattatttcttgagatcttggttctttaggtgactgttgtggtggtgattaatcagtatcatgaaaatacttatgttgtctatcatagtatttcagaagactacagttatagagctgggtgcatacaattaccaaccacaatgatatgcatttacatatttcaccttttgacctatttcttcatgaatatagttcatctgtttataactcttatacttgtgtgactgttgatagaaggcctgaatgtttatgcttgcaaaaatgtatgttatcgcttattttattgtgtaaggtgatctttgaagtgttctgctgtgtttttatttttgtgtttttatatgttactcaaataaataccttttaaaaatgtaaataaatatatcttaaagaatttttaaaattattttttccagaattaaattttcaggatttcagtcttttgggatggcgatttttggaattttagactttaaggattttgttcttttgattttcaacattcgattatggtgtttggaactgtgtctttcaagattgtgattgattccaaatgcaacacagggttaaaggaaagtggaaaagacatgaaaaaaatctgagctgtgccttatctgaagctgttgtgtgagaattatagaaacatgtagagagtagacatctaaagttaggtttctgtctgctggaatacatgagtcaacctcatcttccttggtctcccatttgagaaagtgttcagcaaagaggaacacagtggcgctcacatccaaaatttcttagaaggcctttaaaagggtcagtgttggaaggtaacattatcaagtatagcagttatttggagcccacccaataaccatattgtggttacaagcagatgtaaagggcactgcagtctttcctgatttaggaagcaacgattacacctgactctttaggagagtatgtagcagacacattttgagccgtggctatcataccctggacagctcctcttggaggagtggtgactaagagcacgctgtgtgtacactcagtcttcactgctgacctccagtctccacctgcttcatttttaaataaatgtgccaaggtttatttttgacccttctggatcatccaacatttccaagtggactcatctagggataacagtgagaaagttttgggaagatctcaaaaagtgtttcttaactgagatcttaattggttcagcctttagggaaaaagggaaagatgatgaggcttgggtctaatctgaataatcagttgaccttaagcctgaatcagaatatcaaatataattggaagccttgatatatgtttttatactaacatagctatgttttcccacaaaatagatgatactggatttaggactgaaaatgtaagaacaaggggttctatgaagtccaaggatataaagacagaagtcagttatggcaaagaatttacaaaatgcttcaaaggcttatctatctcttcccttctttctacaattctgcacatgtgccagccccaagggttctgtacttatgttgagatttttggatcaatatctgttttagtggtacttaactttaaactatttgcccacttgtttcatgaatttgtcattttagtttcacttaagaagtacattgtcaaactatagtgaatttggcgaagaacaactagaggggacttagaagtacggaaaatgagtaacagtagaaggaattgggatatttaaattggagaacaaaaagttttattgaaacaaatgaagggtaattatttaataaagcaattgaatttgtcccatttaatctctaaagtacagaattactataattctatagggtgacacattttaattcatcatggagacttactttttaacagagaaatatatgcaatgatggaacgagctgaagaacaatactttctatcagttgcttttgtcagatataggttgggaaagtgggagagggtatctaagcatcagatgcaaatttctttcaatcttgaaattccatgatacgatctaagatatttcaagaaaaaaaccattcaggttgatttcaacaacataaaaaactgtaatggaaaatattaaggctaattagaacgtgaagttttattaacattgataacaataataatattttctaaggaacactagttgacagcagacaaagggaggggggatgaaatactggacttgtggtcagcaaagtcccagggttatgccacaggactacaagtactccaactctattaaggaataaattgctaatttttttttttcccctgaagcaatgtgtgtggaagtctttcactttctgagccaaaacttgaggagctgaccctgaggtggcagttttcctgggggagctgcttagatagcttttcatgcagggatagtccctcaatgcattaccttttagaggctatggcatcaggcctctatccagaaggggaggaggactagagagcgctcaggggagagggcgataagagagagatttgcttgtctaggtgatgttgctgagtagcccagtgtggactctgtgtcagagagctccaaagtacagcagcaacttggggtctttacagccccagaatttatcttatctatggcatttgagttaacaggattcagcttactgtaaagaagtaaacaccctaggggggctatataaagaagccctctttggcccatttgtctaacagatggtctctgaaattgtttgcagtgactttttaccttttttttttttgctgtgtttttccagatttagacatttatactttctctcaagctcatgtcatgccaacaaaaagtagagaattaaactaattagtctacactaaggtttccatttacaaaagagaatttattttaatattatgaaaacaacatgtgcttattttagaaaaaaataataacacaggaaagtataggaagtttaaatcatccacaataccatttctaagaccatttctagcctcctctgtttctctgtatttcgtatattagatatctatgtaattattttcaaaattggaatcgtagtgcatgcagttttgttaatacttttgtttaatatatcatgtgtctttccccatagcactatgtgttctttgaaacatgattcttaatgagaacattatagtccatttttatcaatgtactttatccttctgtttgggggcacttataattttatgcaaaatctctgtaaatttgtgaaaatattctcagaaatagataacgtgtgtgtatttttaagatgtttacctcgtttttgcccatttaactccgtagcaaggtaagctgtcatcagttggaggtaagcggaagacagtagagagtacagagccctggactgtgactcagaggatgagcaccagatccagtttgctgtgccacagtggtaagtcacctaatctttatgtgcttggattcctcatatgtaatacaggatcacaactattgttctcactcatgcaatactactattgtgagaacctcatgaattagagaaactctgaatttgcaatttagctttagaacactgacaagtagctcattgattcttgcctcattcctctggaataaagtagctttttatcaaacaagtgaacacattgctttcagtggaggcagaaggaattcattttgaaaaatgcacatagcattctccaacccatttttgcatattcttttttaagggaatgccttgtgtgagaggactagcagggtatcagaactgttttttgaaagaactttgtttgcaggtgctttcaaatatgttgtcttcaactatcattttcagtgtaaaaagcgggcttggagtaagcactgcctgcagaccacttttgtgagccctcccttcagtgatgtgatggcaatccaggcccctgctgggagagatttctgcctggttaaacctctcacagcttctaatcctctctttctcatctggctttccttagccttctccaaagtcactcacagaaggcatcccactcaacctcaccttggggtaaatcaaaatagtcctccttctgaagctaccgggtaaagcggtggtagctgtgcagctgctgctgatcaacaggctccagaaacagcagcaggaggtgagcagtccctgcgttggccaccaagtggtaggtggccagccctacctccaagttgcactgtttacttattcatctttcatggtaaagcctccagttgcctattatgaaatcagcaataatcatgtgtcccctatctgggtccctgaaaagatggaaagaggcagatcaggctggtgctctgagaatgacagacatcaaacaagaatgaaaagtgtcaccctccttggacttattcagtaactcatgcccttgagcaaaggaggattttctatcaaaggacatggatttctgtgtctttctcttgagataacattgctgggtgaccacagaaagctggctctggaagcacagaagctgcctttccttgagtaataatgtctcttcaaagggagctggagcatgagtagtgtacatgcctcagatttcagtgaaaagttcagaggaggcctgagaaggtcctgggaatgaatcatctagatgactcaaccttgcaaagccatccacctcattgtggatatcattcaatacatttggtgctccatcatcctatttccatggctatttcctcacatttttcaaagtccgtttcttgagccctgactgtgtcaaatagcatgccctgttattcttgggcttccctctctattctagcattcagggagatttcagaggctggggtaaatctcagaccaagaagacgcaatggttttgaggtagagatcctaggaatatagaattctgagctatgcagtggtcctttgctttcaggaaatcaagtttgatagtatcacctgaagcatacttacattatccacaaatgacagctccttacttgagcagttaaattgtggcaagtcttaacacacagattcctcttaaatgccacctaatccctgcctggcttcaagcctctggcttcccttggagaggggcagagtctctctgtgtgagagattcttcatttctgctttctgctctgtcagtttctacttacttgctcttccaccttgtccacaaggcttatctagcggctgtttacctctgagcagagaaaatggaagtcagcagagacaaggttgaaatttctcaggaaggatttttttttccactttatcgtgcagcaagagtaaagcctttttttcggtgattctttcctccacaatggccattggctgccctctgtcacacacaggtgtgactcccttgttattaactgtcaggtgggaatttctagggaagaaggagagtgctttgttaacctcttaacatctccccaaattgcatcatattctctcccttttccctcccagctaccttttctatttttgatttcctctttttcagtctgatttggggatttcagttcccactaactttgtataatatcctcctatctctgaaagaacaagttccatctccattttccaggagagtttttttccttgcagtaagagcaccccatcatctctccatttctacctccccatcccagtgctctctttatggcagtataattgaagagggacccacagtcttgctgaaggaacatgaccttcctactgaagttgggattacggaatagagggagaagaggaaagatggatgtttatctgaatggtcggatcttgttttccagaggacacaggccaatgggaaacttttgggaaggaagtcaaaaaatcaaagccagaactgggttttggtaatttaatctcccaaagagagaaaagtccccatactctaattcatattttgtttgacttgactgaagcccttttgaatattttttctgcttctgttctgttcttgcaataacaatgacataagtttgcctttggagacattaaaatagttttctcatctcttgttccaagcatttattttattttatttttttggcgtatttatttatttatttatttattattacagtacttttaagttttagggtacatgtgcacaatgtgcaggttagttacatatgtatacatgtgccatgctggtgcgctgcacccactaactcgtcatctagcattaggtatatctcccaatgctatccctccccgctcccccaacccacaacagtcccccgagtgtgatgttccccttcctgtgtccatttgttctcattgttctcacctatgagtgaaaatatgtggtgtttggttttttattcttgcaatagtttactgagaatgatgatttccaatttcatccatgtccctacaaaggacatcaagtcatcattttttatggctgcatagtattccatggtgtatatgtgccatattttcttaatccagtctatcattgttggacatttgggttggttccaagtctttgctattgtgaataatgccgcaataaacatacgtgtgtgtgtgtctttatagcagcatgatttatagtcctttgggtatatacccggtaatgggatggcgggtcaaatggtatttctagttctagatccctgaggaatcgccacactgacttccacaatggttgaactagtttacagtcccaccaacagtgtaaaagtgttcctatttctccatatcctctccagcacctgttgtttcctgactttttaatgatcgccattctaactggtgtgagatggtatctcattgtggttttgatttgcatttctctgatggccagtgatgatgagcatgttttcatgtttcttttggctgcataaatgtcttcttttgagaagtgtctgttcatatcctttgcccactttttgatggggttgttagtttttttcttgtaaatttgtttgagttcttgtggcacatatacaccatggaatactatgcagccataaaaaatgatgagttcatgtcctttgtagagacatggatgaagctggaaaccatcattctcagcaaactatcgcaaggacaaaaaaccaaacaccgcatgttctcactcataggtgggaattgaacaatgagaacacatggacacaggaaggggaacatcacacaccggggcctgttgtggggtggggggaggggggagggatagcattaggagatatacctaatgctaaatgacaagttaatgggtgcagcacaccaacatggcacatgtatacatatggaacacacctgcaggttgtgcacatgtaccctaaaacaaagtataataaaaaaaaaggtaggtatcaaaaacataacaattcaaaccctcttttaattaaagttggttcttgtattagtagtaagcagggagcttggggggagagatgtgtacaagtgtagatgggaggttcccaggtaaagttcttgattgggaaggttcatttgattgtatgacatgttcctccattctctctgtctctgtctctgtcttttgtttttgttgttgttgttgctctaagcatctagaatgaaaaccacaaggccagggtttgctatcaaggaccactctttcctttgcagaaaaagctggttctgagtgaaatagaaggactagggtgccaaattaactcctctccacaaagtgaccccacatggaaaagtacttgagaagctctgtaaagacatggtaaaagcttaccaaagacagtagcattatcctttcccttacacacaaagtggaggggaagtgtgggtaagtggtgtgtctaaaagcattgctttaaattatgcatccatttgtaaacactaattttttgttaactccatgttgtttgtaaattgaacaaaaaatgcatatttgtcatggaaaaattaggaaataaagatattagcataaaagaggaaacaacgaatcttaattacccataatcccatgacttcatgtttgtgtaagattatataatactattgtttcatgatctgccattttcactcagtgacatattttgcacgtgaaatacgttttacataaatatttgtataatttgactagttattaccttaaaactactggaaagaaatcccttagttcttctacttcactcatttcttctctacagtattcatttctggggtaaatccagctctttggcttgcatggccatgtagttctgaagttagctacacaggacttagccacatttcccagaataggatgtatggtacagcagaattcttactgaacttgaagtcagaagaactggttccttcacttactatgggtgaccttggacagtatacttgatttctttgaatctcatcagtgaaatgagtatgggaatgtctaccttaactgtgtgatgacagaatttgtgaggatgaactgaacaactatataaaagtgtttgggaaatgctgaagagccctacaaatgaaagacattaataatattaactgaaatagattccataaatactatgtgtaagatcctaccttgatttaccgcatttaatcatcaaatccactgtctgacaaaagtattatcattagttctattttatagtctaaacaaatctaggcagaaaggtcaaataatttgcataagctcacacaatcagtgacttagatttgatccaatctatttcattcgatagtgttggtcttttcccctaatagtagtaaaaactgtgggctccattgttagcctgcctgagatcagatgccatctccaactaggcaagttaccttttctgcctgtttcactcttcaaaaattagagatacaataataccaacccaatttctttgggtttcataagtaggaaataaaataatacataggaaagacttggaacattgcctgacacaaaataggtgtcttaaaacgttaattattattattttcaatgttgccaagacagtgaaccctgtggtggtgaatttgcatgtgaaaacctgttaaactgatacacactctttcttttctcctaatattgtcgcacttgcaccttatgtcctaagttttctagtaatcttgaatgtacataatgtttagttgtgaaataaattttgctttgtgagggaattagttgtaattgagggtagaatcaaagtttgttcagcgaattccatctattcagttgtaaaggcagcgaataaacaccatgacttgtatttgaaagtagaaaataccgactttcaattgtcatttcccccgaggaaaccattaaccagcacaattgtttttaaatatcaacctgaaataacactgtatttttactgctattctttctctctccttctctctctttgggatacagtttggctttgaaaaaatatggtatatatgcggtgtttggtcaaataatttagcactatggaaaaggttgtgaaccagtcatagtatttgaggttgtaagaagaaacctttgaaaaggtagtggctgcacaaatgtattaacttagtaccacaaagtagggagttctgaaactgtggtggaaatattgcctgccttgactacctgttcttcctgagtccatttgctgatcagaactcaggtaacttaaaagtcatataccctggaaaggagtatggaaacaggaaagatcctcagcggctatacaagtgagagatatggcagagttctaataagattgactaaaagcttgatactgtcttacatccaaggagcaaataattgttctacctggaatgtccaggccccaattcacaaatgcattcctaccttttgaactgaataatgatctctttcccaataaactgttataagacaaaaaatctgaaaggaaaattgttgcacatacatcatattcttatattctgtattttctgggacagtctgtttcagattagatgatgagtcctaattcaggtttgcaaaatattatcaaggcaaatctttatggagattttattgagatattattttataacaaaaaatgggataactgtaatgttcatcaaaaaaattggtggtagaaggaaggaaggtgttggagtgttcagtaaccttaccccagaatgccacagtacaaattctgtgagaagtcattcttgtgtagtagaggcgttcatttttctcctaatatcccttctgaaaattcccttttactagtcagctcttagcttcttggaaagaaggcccttcgtctaggacaatgttcatctccccacataaaaattcacaattcatggcatgttagttcaataaaatattatgctttctaagaatgataattatgaaaacttgctataaatgggagcaagttcaacattaaatcacatgaaacagacatattaacaaaaatagatacattagagcaattgaactataaatgcttttttcctttaaaaattttccttcatgttattttcacattcttttagcaacaaatgacaatgaactgccattgattttattttttgaacttaagcagtgtatccacaagtacaccattgccctgtccaatttttagggggagatattctattatctaaaactcaataaattgacccatcacgtttttggtgataccttatttaggtaaaaatattaggcatttagaagaatgcatttgtgaatattttgactgatattactatagatggaattagaatctgccctttaggggctcagaaggaagtaatgtttggatgtccttaggctagaatattttattgtcccacaaaaatgttgataaattgcttataagggcttatttattagaaatgaccatgtcaccaaataataaagccaaatatgataggaatcacaatcagaaaatatgttttttcttcttttatttacaaccaaccaaacaaaataacatagctgtaattttgtcaatgtcagaacaataaatttaagtcaaatagaacttaaagaatttttatcacagatgaatcagatggaaactatccagaaaacacccaaatatgtacattcctcagttaatactcagtctaggtgccaaagggaagccacacgcttccatttatctatataatttggcaactttaatttgtaaggggcccaacaggtgtttaatttcataggctgatatagtcaatattactagatccatattttttagatttaaataactatataattctgatttctctttgttagactgtactgatctgatcatggaggaataatctaatatggcttagattatgttggaactccccagaactttcctcagggctgcctttatctccttattctggaggctatagataaggggattgaagagtggggtcaccatagcatagaacaaagttttgattttctgcatccccatagagtgtccaagtcctggactcacacacatgaccataagagagccatagaacagtgataccacagccaaatgagacccacaggtagagaaggctttatgtttcccagtgctcgaaggcatacccaacacagctttcaggacaagagtataggatccaataataaagaggaagttaccaaaaataactaatgagcttagagtgtagcaaaacagttggattcttggggcagagacacaagccaatgcaaatagtggccctgggtcacacacaacatggtcattaatgtttggaccacagaagggcatctgagagatgagaacagtggggatcaggaaacacagaaatccacaaacccagcacagtatgaccagtttggcacagagatgcccagtcatgatttattaggatagtgcaagggatggcagataacaaggtactgatcaaaggccatcacagtcaaaatcaagcattcagatgtacccaaagagaagaagaaataaaattggagaaaacatccagcaaaggagatggtttttttctctgaaaggaagttgaccaacatcttgggaactgtagaagagacataccatatctctaaaaaggagaaatttcccaggaacatgtacatgggagtgtgacgtcgccggtcacaccacagggcgcaagcaatggctccatttcctgttatggtcagtgcatatgttgtagtgaagagtgagaagaggaagatctgaattgtccactcaaaagataaatcttggagtataaattcatttactaaagcaaagctggaatttggctcagagacattcattgggccagtgacctgcaaggtcaagagacacattatcagtcaggactgttttacaaaatgagttccttttttaagaatgaagagaagacaatgaacatgaagtcatttttcaaaagaataattaggaagagaatatagtttactttttcttggctatacagtatatgagttttgggcttagtaggtagctgattgaacaaaaacttctgccagcttctaaatctctccttaatatgcaatcgtgatagaactaggtaaagttaaattccttttgtaaggtcattattttgggacagaaatgatttaatatagtttctggatagcatacaacccaaagttagtactttgagaaggcacaaatgtgttagtttcttactgcaaacccaacttatagtgcaatagactcagcaaggaaagttttgaccatttacatttcagctaaacatattacttaacattatttacatatgcaaaagaaatgcacatattttaaaataaattggtagctatcacgttaaagccattatctctgaatttctattgctgctgttgttagcttaagtgattatctaatgttgcttaccaatattgacttttaatattaatattgtaaagctgcattgttttctgtagaaagggaaggctttaagtttctgattaatcttttaccttaatttcataaactgatacagtgattattatattgataaaatcaatacagtattgatttagtcattatgtacaaaagtttgcaaagatctagacattaaactttatttttgaaggtatttcataaaatttggagattgattttccttatatgctttttataaaattgaaaaattttactaaatgacagaaattaaacacttttttttgttataggtaaacttcctcctacattcttctaaaaatatatttagggatttgagttacctgaaaaaacttttttttcctcagaaatatggagggatgtgagttctagacgtcaagagggcttgcattttgagaagaaacacaaattttcagaagtttttcttccaatttgatctctacaccagtgctctaggaattcttttggtatgactagttagaagttatgtttgtgcctcttttagtaatagatgcctctttaattggcttccaaccagaaacattaataaaccaacattaggaaattatggaaacggattgacatgggagtgtcatgattctcagcagtgctcaaaaggtgaagccatcatcgttttgacatgaaccaaatctctaaatgatttattttataaaccatattctgcctccacctagacagttttattgtggccccaaaattaaaaatgcactttataaaactcactttctcctgggatgtagcttctatagcattaggaaagttatcttccaagccaatgaatctttaaaaagttaatgattagatattctctgaagaatcagtaaagagtaatgacaactattctaagacatcattatttacaaagagcttgcccaccagacggattccaaaaaatcttccagaagacacagtctgaggagaaataagatacaaaatgttaccaaaagttctgacataatgtttaggaacatttcaagtgttactgtgcatatatgttggaggatatacagcccagtgaggaaaatactgatgttccaacattgtcacatattgagcaaaaacttacagaatttagaaataacttttagaaggatggcacttttttggcagattcctttagatatgagaaaaaagtataagaagtagcaacgtttaagttaattgacagaaatacttgagaggaacatgtgacttcccaattaacatgagagaagtattgacttttatttgtgtcccttctatttttactttatggcatttaggggccaatatagtgtagctaaacactcatgtgtgagtgaatgctcataccaagtgctgtgaagtagttgaggacatcagggatgtatgccctaggactacagacatctgtctaaaagcacacttccactttgaaagactatggaggaaaatgtttattcagacctttattatcacttaatcataatacttagaaactcctaaaacatagctttgatcttgttgtctgctccaaaagccatcaatgatttcaagttcccaagttctccacaaattgacttcaaattactttcctggtgttatctttccctactctcttttacagataaattagacagtagacagcatttcattctctgaataggttcagtttcctatgttctcttttttgtgatcattttctgtgtttggaattctatttatctccacctacacctgtaaaaaccctccttcaagatccagttcaaaagacatttttccccccagaatgttttcccctcttcccctaagcaaagcaccttttccatccttgcattttttcttttttgagacatagtctcgttctgtccccaggctggaatgcagtggtgtgatctcagctcactgcaacctccgcctcctgggttcaaacaattctcctgcttcagcctcctgagtagctgggactacaggtgcgcgccaccatgcccagctaatttttgtatttttagtggagacagggtttcacaatgttggccaggatggtctctatctcttgaccttgtgatccacttgcctcggcctcccaaagtgctgggattacaggtgtgagctaccatgcctggccccatccttgaatttttattttaccatctttgtgtctttgtcatgatactaatcataagctgccctatatcaatgttcatccatgatattggcttgaagttttttcttgttgttgtgtctctaccaggttttggtatcaggatgatgctggcctcatagaatgagttggacagttctcagttttttggaatcatttcagcaaaaatggtactggctcttctttgcatatctggtagaatttggctgtgaatccatctagtcctgagctttttaaaatatatatatattttggttggtaggctatttattactgatgcaattttggagcaggttattggtgtgtccaggaatttacccatctcttacaggttttctagtttgtgtgcatagaggtggttgtagtagtttctgatggttattttttatttctgtggggtcagtggtaacatgacctttttcatttctagttgtgatgtttctttcaaaagattagaatggtaaaaattatatctattctgattagggcttctaggcattattaaatgtttacacctttaatttactctggtcaacagtatatttttggggactttttcttaaataatcttgtcactaaaccactatactttataaacagcctgattaaatgaacatgcatttgaacattagactctggatagacaagattaattaacctttgacacaagaagctcacagtacaacaggccactctgataggacaaaagtcctaggaagtctatgtcggcaaaatcccacctaagggctgaactttaagctctattcacttttagctaattaagtaaatatactgccatcccatgctgatagtgatgagcagtctccggggagtttgacttctatagggagggagggaggcgatgtgtttctgcactttgcttcttcagtcagacattctgtgacttcttcatttccttccgctcctcttcaagccctggcatgttggctcagaagcacaagagggcaggataatcctcactgtctcattcacactgactgaaaccctgggctttgaaatacagactcactcctcccaagctctactctgatgctgggagcaatttagagcaaatgttatccaaagtgacattacctagatcactaggttctttctttcaccctcctccaatcctgctgttctttcacttctaagtcaaggaaactccaagtttacactttgcaggagcccctggaatatttggggtttcatattgcacatcaaaactatttctcactgacccaatcatctattaaaaatcttgttgaatttctgccattttaatggctatctgccttcatatgaagttcttggtattataatagtcagtgtgcttccaaattaatcccaattcgtttacttttactttaagatgaaatgtaggcagagcacagtggctcacacctgtaatcccagcactttgggaggccaaggcgggtggatcatgaggtcaggagttcaagaccagcctggccaacatagtgaaaccctgtctctactaaaaatagaaaaaaaaaaaacagccaggcatcgtggcaggcacctgtaatcccagctacttgggattctgaggcaaggagaatcgtttgaacctgggaggtggtggaggttgcaatgagccgaagtcgcgccactgcactccagcctgggtgacagtgcaagactccgtctcaaaaaaaaaaaaaaaaaaagaagaagaaatgtagcttagaaaccattcttccataaaaccaaaaccatatctccttaagaggatgttggaaaatcagcctttctcataaagtagttttccccacaagtttaaacacattactccactataagtttagagactattttaaaaaactattatgcttcagcttttcctgcagttctctctttcttgtctcttacatacttctctgtgatctggtccaacaattattgccatggcaacaaaggctctgtgacatctctagcaagctcattgtcttc
